United States Patent 10,293,058 (RNA CONTAINING COMPOSITION FOR TREATMENT OF TUMOR DISEASES) - sequence listing, part 2

SEQ ID NO: 2412 - RNA, 924 nt, Artificial Sequence
  derived and/or modified sequence opt4 from MAGE-F1__Homo_sapiens__CCDS3269.1
augcugcagacccccgagagcagaggccugcccgugccccaggccgagggcgagaaggacggcggccacgacggcgagaccagagcccccaccgccagccaggagagacccaaggaggagcugggcgccggcagagaggagggcgccgccgagcccgcccugaccagaaagggcgccagagcccuggccgccaaggcccuggccagaagaagagccuacagaagacugaacagaaccguggccgagcuggugcaguuccugcuggugaaggacaagaagaagagccccaucaccagaagcgagauggugaaguacgugaucggcgaccugaagauccuguuccccgacaucaucgccagagccgccgagcaccugagauacguguucggcuucgagcugaagcaguucgacagaaagcaccacaccuacauccugaucaacaagcugaagccccuggaggaggaggaggaggaggaccugggcggcgacggccccagacugggccugcugaugaugauccugggccugaucuacaugagaggcaacagcgccagagaggcccaggugugggagaugcugagaagacugggcgugcagcccagcaaguaccacuuccuguucggcuaccccaagagacugaucauggaggacuucgugcagcagagauaccugagcuacagaagagugccccacaccaacccccccgaguacgaguucagcuggggccccagaagcaaccuggagaucagcaagauggaggugcugggcuucguggccaagcugcacaagaaggagccccagcacuggcccgugcaguacagagaggcccuggccgacgaggccgacagagccagagccaaggccagagccgaggccagcaugagagccagagccagcgccagagccggcauccaccugugguga

SEQ ID NO: 2413 - RNA, 924 nt, Artificial Sequence
  derived and/or modified sequence opt5 from MAGE-F1__Homo_sapiens__CCDS3269.1
augcugcagacccccgagagcagaggccucccugugccgcaagccgaaggggagaaggacggaggccacgauggggaaacacgggcucccacggccucccaggagcgcccuaaagaagaacugggagcgggcagagaggaaggggcugccgagcccgcccuuacccggaagggagcucgcgcccuggcugccaaagcgcucgccagacggcgcgcuuacagacggcugaaccgcacagucgccgaacuuguucaguuccugcucgugaaggacaaaaagaagucuccuaucaccagaagcgagauggugaaauaugucauuggcgaucugaagauccuguuucccgacauuaucgcucgggccgcggagcaucuccgcuacguguucggcuuugaacugaaacaguucgauagaaagcaccauacauauauucuuaucaauaaacugaagccucucgaggaagaggaagaggaggaccuugggggagauggcccgcggcuggggcugcucaugaugauccugggacugauuuacaugcgcggcaacuccgccagagaagcucaaguuugggagaugcuccggagacugggggugcagcccucuaaguaucacuuucuuuucggauacccuaaacgccugaucauggaagacuuuguccagcagcgguaucucagcuacagacgcgugccccauaccaauccucccgaguacgaguucuccuggggcccgcggucuaaccuggagauuagcaagauggagguucuuggcuuuguggccaaacugcacaagaaagaaccucaacacuggcccguccaguauagagaggcucucgccgaugaagccgaccgcgcucgggcgaaggccagagcugaggccuccaugcgcgcccgggcuagcgccagagcggggauccaucugugguga

SEQ ID NO: 2414 - protein, 219 aa, Artificial Sequence
  MAGE-H1__Homo_sapiens__Q9H213
MPRGRKSRRRRNARAAEENRNNRKIQASEASETPMAASVVASTPEDDLSGPEEDPSTPEEASTTPEEASSTAQAQKPSVPRSNFQGTKKSLLMSILALIFIMGNSAKEALVWKVLGKLGMQPGRQHSIFGDPKKIVTEEFVRRGYLIYKPVPRSSPVEYEFFWGPRAHVESSKLKVMHFVARVRNRCSKDWPCNYDWDSDDDAEVEAILNSGARGYSAP

SEQ ID NO: 2415 - RNA, 660 nt, Artificial Sequence
  MAGE-H1__Homo_sapiens__AAD31314
augccucggggacgaaagagucggcgccgccguaaugcgagagccgcagaagagaaccgcaacaaucgcaaaauccaggccucagaggccuccgagaccccuauggccgccucugugguagcgagcacccccgaagacgaccugagcggccccgaggaagacccgagcacuccagaggaggccucuaccaccccugaagaagccucgagcacugcccaagcacaaaagccuucagugccccggagcaauuuucagggcaccaagaaaagucuccugaugucuauauuagcgcucaucuucaucaugggcaacagcgccaaggaagcucuggucuggaaagugcuggggaaguuaggaaugcagccuggacgucagcacagcaucuuuggagauccgaagaagaucgucacagaagaguuugugcgcagaggguaccugauuuauaaaccggugccccguagcaguccgguggaguaugaguucuucugggggccccgagcacacguggaaucgagcaaacugaaagucaugcauuuuguggcaaggguucguaaccgaugcucuaaagacuggccuuguaauuaugacugggauucggacgaugaugcagagguugaggcuauccucaauucaggugcuagggguuauuccgccccuuaa

SEQ ID NO: 2416 - RNA, 660 nt, Artificial Sequence
  derived and/or modified sequence opt1 from MAGE-H1__Homo_sapiens__AAD31314
augccccgcggccgcaagagccggcggcgccggaacgcccgcgccgcggaggagaaccggaacaaccgcaagauccaggccuccgaggccagcgagaccccgauggccgccuccguggucgcgagcacccccgaggacgaccuguccgggcccgaggaggaccccagcacgccggaggaggccuccaccacccccgaggaggccagcuccaccgcccaggcgcagaagcccagcgugccccgguccaacuuccagggcacgaagaagucccuccugaugagcauccuggcccucaucuucaucauggggaacagcgccaaggaggcccugguguggaagguccugggcaagcucgggaugcagccgggccgccagcacuccaucuucggcgaccccaagaagaucgugaccgaggaguucgugcggcgcggguaccugaucuacaagcccgucccccggagcuccccgguggaguacgaguucuucuggggcccccgcgcccacguggagagcuccaagcugaaggucaugcacuucguggcgcgggugcgcaaccggugcagcaaggacuggcccugcaacuacgacugggacagcgacgacgacgccgaggucgaggccauccucaacuccggggcccgcggcuacagcgcccccuga

SEQ ID NO: 2417 - RNA, 660 nt, Artificial Sequence
  derived and/or modified sequence opt2 from MAGE-H1__Homo_sapiens__AAD31314
augccccgcggccgcaagucccgccgccgccgcaacgcccgcgccgccgaggagaaccgcaacaaccgcaagauccaggccuccgaggccuccgagacccccauggccgccuccgucgucgccuccacccccgaggacgaccucuccggccccgaggaggaccccuccacccccgaggaggccuccaccacccccgaggaggccuccuccaccgcccaggcccagaagcccuccgucccccgcuccaacuuccagggcaccaagaagucccuccucauguccauccucgcccucaucuucaucaugggcaacuccgccaaggaggcccucgucuggaagguccucggcaagcucggcaugcagcccggccgccagcacuccaucuucggcgaccccaagaagaucgucaccgaggaguucguccgccgcggcuaccucaucuacaagcccgucccccgcuccucccccgucgaguacgaguucuucuggggcccccgcgcccacgucgaguccuccaagcucaaggucaugcacuucgucgcccgcguccgcaaccgcugcuccaaggacuggcccugcaacuacgacugggacuccgacgacgacgccgaggucgaggccauccucaacuccggcgcccgcggcuacuccgcccccuga

SEQ ID NO: 2418 - RNA, 660 nt, Artificial Sequence
  derived and/or modified sequence opt3 from MAGE-H1__Homo_sapiens__AAD31314
augcccagaggcaggaagucgcggcgccgacguaacgccagagcugcagaggaaaauaggaacaaucggaaaauccaggccuccgaggcgucugaaaccccuauggcugccucaguggucgcaaguacaccagaggacgaucugagcgggccggaagaggaccccuccacuccugaggaagccucuacgaccccagaggaagcuagcucaacagcacaagcccagaagcccagcguuccucgcaguaacuuccagggaacuaaaaagucccuccuuaugucuauucuggcuuugauauuuaucauggguaauagcgccaaagaggcguuaguguggaagguacugggcaagcuagggaugcagccaggaagacaacacuccauuuucggcgaucccaaaaagaucgugaccgaggaauuugucaggcgggguuaccucauuuauaaaccugugccacgcucaaguccgguugaguacgaguucuuuugggggccccgagcacauguggaaagcucuaagcugaaagucaugcacuucguggccagaguaaggaaccggugcuccaaggacuggccuuguaauuaugauugggacucagaugacgaugcugaaguugaggccauccuuaacagcggagcacguggcuacagugcuccauga

SEQ ID NO: 2419 - RNA, 660 nt, Artificial Sequence
  derived and/or modified sequence opt4 from MAGE-H1__Homo_sapiens__AAD31314
augcccagaggcagaaagagcagaagaagaagaaacgccagagccgccgaggagaacagaaacaacagaaagauccaggccagcgaggccagcgagacccccauggccgccagcgugguggccagcacccccgaggacgaccugagcggccccgaggaggaccccagcacccccgaggaggccagcaccacccccgaggaggccagcagcaccgcccaggcccagaagcccagcgugcccagaagcaacuuccagggcaccaagaagagccugcugaugagcauccuggcccugaucuucaucaugggcaacagcgccaaggaggcccugguguggaaggugcugggcaagcugggcaugcagcccggcagacagcacagcaucuucggcgaccccaagaagaucgugaccgaggaguucgugagaagaggcuaccugaucuacaagcccgugcccagaagcagccccguggaguacgaguucuucuggggccccagagcccacguggagagcagcaagcugaaggugaugcacuucguggccagagugagaaacagaugcagcaaggacuggcccugcaacuacgacugggacagcgacgacgacgccgagguggaggccauccugaacagcggcgccagaggcuacagcgcccccuga

SEQ ID NO: 2420 - RNA, 660 nt, Artificial Sequence
  derived and/or modified sequence opt5 from MAGE-H1__Homo_sapiens__AAD31314
augcccagaggccggaagucucgcagacggcgcaacgccagagcugccgaggaaaaucggaacaaucgcaaaauccaggcguccgaggcuucugaaaccccuauggccgccagcguggucgcuuccacaccggaggacgaucugucugggcccgaagaggacccuagcacgcccgaggaagccuccaccacaccugaggaagcuagcagcaccgcccaagcgcagaagcccuccguuccuagaagcaacuuccagggaacaaagaagucucuccugauguccauucuugcccugaucuuuauuaugggcaauagcgcuaaagaggcccucguguggaaggugcuggggaaacuuggaaugcagccgggccggcaacacucuaucuucggggaucccaaaaagauugucaccgaggaauuugugcgcagaggauaccugaucuauaaaccuguuccccgguccagcccuguggaguacgaguucuuuuggggcccccgcgcucaugucgaaucuuccaagcucaaagugaugcacuucguugccagagugcggaaccgcugcagcaaggacuggccguguaauuaugauugggacuccgaugacgaugcggaagucgaggccauccugaacucuggcgcuagaggguacagcgccccuuga

SEQ ID NO: 2421 - protein, 1249 aa, Artificial Sequence
  MAGEL2__Homo_sapiens__Q9UJ55
MSQLSKNLGDSSPPAEAPKPPVYSRPTVLMRAPPASSRAPPVPWDPPPIDLQASLAAWQAPQPAWEAPQGQLPAPVVPMTQPPALGGPIVPAPPLGGPMGKPPTPGVLMVHPPPPGAPMAQPPTPGVLMVHPSAPGAPMAHPPPPGTPMSHPPPPGTPMAHPPPPGTPMAHPPPPGTPMVHPPPPGTPMAHPPPPGTPMAHPPPPGTPMAHPPPPGTPMAHPPPPGTPMAQPPAPGVLMAQPLTPGVLMVQPAAPGAPMVQPPPAAMMTQPQPSGAPMAKPPGPGVLMIHPPGARAPMTQPPASGAPMAQPAAPPAQPMAPPAQPMASWAPQAQPLILQIQSQVIRAPPQVPQGPQAPPAQLATPPGWQATSPGWQATQQGWQATPLTWQTTQVTWQAPAVTWQVPPPMRQGPPPIRPGPPPIRPGPPPVRQAPPLIRQAPPVIRQAPPVIRQAPPVIRQAPAVIRQAPPVIRQAPPVIRQAPPVIRQAPPLIRQAPPPIRPAPQVLATQPPLWQALPPPPPLRQAPQARLPAPQVQAAPQVPTAPPATQVPAAPPAGPQVPQPVLPAPLSAPLSAPQAVHCPSIIWQAPKGQPPVPHEIPTSMEFQEVQQTQALAWQAQKAPTHIWQPLPAQEAQRQAPPLVQLEQPFQGAPPSQKAVQIQLPPQQAQASGPQAEVPTLPLQPSWQAPPAVLQAQPGPPVAAANFPLGSAKSLMTPSGECRASSIDRRGSSKERRTSSKERRAPSKDRMIFAATFCAPKAVSAARAHLPAAWKNLPATPETFAPSSSVFPATSQFQPASLNAFKGPSAASETPKSLPYALQDPFACVEALPAVPWVPQPNMNASKASQAVPTFLMATAAAPQATATTQEASKTSVEPPRRSGKATRKKKHLEAQEDSRGHTLAFHDWQGPRPWENLNLSDWEVQSPIQVSGDWEHPNTPRGLSGWEGPSTSRILSGWEGPSASWALSAWEGPSTSRALGLSESPGSSLPVVVSEVASVSPGSSATQDNSKVEAQPLSPLDERANALVQFLLVKDQAKVPVQRSEMVKVILREYKDECLDIINRANNKLECAFGYQLKEIDTKNHAYIIINKLGYHTGNLVASYLDRPKFGLLMVVLSLIFMKGNCVREDLIFNFLFKLGLDVRETNGLFGNTKKLITEVFVRQKYLEYRRIPYTEPAEYEFLWGPRAFLETSKMLVLRFLAKLHKKDPQSWPFHYLEALAECEWEDTDEDEPDTGDSAHGPTSRPPPR

SEQ ID NO: 2422 - RNA, 3750 nt, Artificial Sequence
  MAGEL2__Homo_sapiens__CCDS73700.1
augucgcagcuaaguaagaaucugggugacucgaguccuccggcggaggccccgaagccgccugucuauagccgcccuacgguucugaugcgggccccgcccgcuuccucccgggcuccgccagucccuugggauccaccuccaauugacuugcaggcuucauuggccgcuuggcaggcaccucagccugccugggaggccccacagggccagcugcccgccccggugguuccgaugacccagccuccugcccuagggggcccgauagucccggcucccccgcuggggggcccgauggguaagccuccgacucccgggguccugauggugcauccuccaccuccgggagccccgauggcccagccuccgaccccgggaguccugauggugcauccuucagcucccggagcucccauggcccauccuccuccuccggggaccccaaugucccacccucccccuccggggaccccaauggcccauccuccuccuccggggaccccgauggcccauccuccuccuccggggaccccgauggugcauccuccuccuccggggaccccgauggcucauccucccccuccggggacaccgauggcucauccucccccuccggggacaccgauggcucauccuccaccuccggggacaccgauggcucauccucccccuccggguacaccgauggcccagccuccagcuccgggaguccugauggcccagccucugacuccgggaguccugaugguccagccugcugcuccgggagcaccgaugguccagccgccuccagcagccaugaugacccagccucagccuucaggagcaccgauggccaagccuccagguccaggaguccugaugauucauccuccaggugcgagagcuccgaugacccagccuccagcuucaggagcaccgauggcacagccggcggccccaccugcacagccgauggccccaccugcacagccgauggcuucuugggccccgcaggcucagccucugauccugcaaauccagucucaaguuauaagggcuccuccgcagguuccccagggcccgcaggcacccccagcgcagcuagccacacccccgggcuggcaggcgaccucgccaggauggcaggccacgcagcaaggcuggcaggccacuccccugacuuggcagaccacgcaggucaccuggcaggcaccagccguuaccuggcaggugccgccgcccaugcgccaggggcccccgcccauccgcccuggcccaccacccauccgcccuggcccaccaccggugcgacaggccccaccgcugauccgccaggccccaccggugauccgccaggccccacccgugauccgccaggccccacccgugauccgccaggcccccgcugugauccgccaggccccaccugugauccgccaggccccaccugugauccgccaggcuccaccugugauccgccaggccccgccgcugauccgccaggcgccgccgcccauccgaccugccccacagguccuggccacccagccaccgcucuggcaggcccugccacccccaccuccacugcggcaggccccgcaggcuaggcugccggccccgcaggugcaggcggcgccgcaggugccuacggccccaccugcuacgcagguacccgcggcgccgcccgcuggcccgcaggugccccagccugugcugccggccccgcugucugccccacugucugccccgcaggcugugcacugcccuuccaucaucuggcaggcccccaaaggucagcccccggugccacacgagauuccaacgucaauggaauuccaggaggugcagcagacacaggcgcuggccuggcaggcccagaaggcccccacucacaucuggcagccccugccugcccaggaggcccagaggcaggcuccccccuugguccagcuggagcagcccuuucagggagccccgcccucccaaaaagccgugcaaauccagcuacccccccagcaggcccaggcaucggguccgcaagcggaggugcccacacugccgcuccagccuuccuggcaggcaccgccugcagucuugcaggcccagcccggacccccgguagcagcggcaaauuuuccccugggcuccgcuaaaucauugaugacuccaucaggagaaugcagggccucuucuauagaccgcaggggcuccucuaaagagcgcaggaccuccucgaaggagcgcagggccccuucaaaagaccgcaugaucuuugcugccaccuucugugcucccaaggcagugucagcugcgcgagcacaccugccagcugccuggaaaaaccugccugccacaccggagaccuuugcucccuccucaagugucuucccagcuaccucccaguuucagccugccucucugaaugccuuuaaaggccccucugcugccucagagaccccaaagucacugccauaugcucugcaggaucccuuugccuguguagaggcccugccugcaguuccaugggucccacagcccaauaugaaugccucaaaggcaucgcaggcagugcccaccuuccugauggcuacagcagcugccccccaggcaacugccaccacucaagaggccuccaagaccuccgucgagccgccacgccgcuccggcaaggccacccggaagaagaagcaucuggaagcccaagaggacagccguggccacacgcuagccuuucaugacuggcagggcccaaggcccugggagaaucuaaaucugagugacugggagguccaaagcccuauccaggucucgggugacugggagcacccaaacaccccccguggccugagugguugggagggcccuagcaccuccaggauccugaguggcugggaagggcccagcgcauccugggcccugagugccugggagggcccgagcaccuccagggcccugggucucucugaaagcccagggagcucucugcccguaguugugucugaggucgcaagugucucuccgggauccagugccacccaggauaauuccaagguggaggcacagcccuugucucccuuggaugagagggcaaaugcguuggugcaguuccucuuagucaaggaccaagccaaggugccuguccagcgcucggagauggugaaagucauccuccgagaguauaaagaugagugcuuagauaucaucaaccgugccaacaauaagcuggagugugccuuugguuaucaauugaaagaaauugauaccaaaaaccacgccuauauuaucaucaacaagcugggcuaccauacagggaauuugguggcauccuauuuagacaggcccaaguuuggccuucugaugguggucuugagccucaucuuuaugaaaggcaacugugucagggaggaucugaucuuuaauuuucuguucaaguuaggguuggauguccgggagacaaacggucucuuuggaaauacuaagaagcucaucaccgaaguguuugucaggcagaaguaccuagaguacaggcgaaucccuuacacugagcccgcagaguaugaguuccucuggggcccucgagcauuccuggaaaccagcaagaugcuuguccugagguuuuuggccaagcuccauaagaaagauccacagagcuggccauuccauuaccuugaagcgcucgcagagugugagugggaagacacagaugaggaugaaccugacaccggugacagugcccacggccccaccagcaggcccccuccccgcuaa

SEQ ID NO: 2423 - RNA, 3750 nt, Artificial Sequence
  derived and/or modified sequence opt1 from MAGEL2__Homo_sapiens__CCDS73700.1
augagccagcuguccaagaaccucggcgacagcucccccccggccgaggcccccaagccccccguguacagccgcccgaccguccugaugcgggcgccccccgccuccagccgcgcccccccggugcccugggacccccccccgaucgaccugcaggccucccucgccgcguggcaggccccccagcccgccugggaggccccccaggggcagcugccggcgcccgugguccccaugacccagcccccggcccugggcgggcccaucgugcccgcccccccgcucggcgggcccaugggcaagccccccacgccgggcgugcugaugguccacccccccccgcccggggcccccauggcccagcccccgacccccggcgugcugauggugcaccccagcgcgcccggggccccgauggcccaccccccccccccgggcacccccaugucccacccccccccgcccgggacccccauggcccaccccccgccccccggcacgcccauggcccacccgccccccccgggcacccccaugguccacccccccccgcccgggacccccauggcgcaccccccgccccccggcacccccauggcccacccgcccccccccgggacgccgauggcccaccccccccccccgggcacccccauggcccacccccccccgcccggcacccccauggcccagcccccggcgcccggggugcucauggcccagccccugaccccgggcgugcugaugguccagcccgccgcccccggggcccccauggugcagccgccccccgcggccaugaugacgcagccccagccgagcggcgcccccauggccaagccccccgggccgggcgugcucaugauccacccccccggcgcgcgggcccccaugacccagccgcccgccuccggggcccccauggcccagcccgcggccccgcccgcccagcccauggcccccccggcccagcccauggcgagcugggccccccaggcccagccccugauccugcagauccagucccaggucauccgcgccccgccccaggugccccagggcccgcaggccccccccgcgcagcucgccacccccccgggguggcaggccaccagccccggcuggcaggccacgcagcagggguggcaggcgaccccccugaccuggcagaccacgcaggugaccuggcaggcccccgccgucaccuggcaggugccgccccccaugcggcagggccccccgcccauccgccccggccccccgcccauccggcccgggcccccgcccgugcgccaggcccccccccugauccggcaggccccgcccgucauccgccaggcgcccccggugauccggcaggccccccccgugauccgccaggcccccgccgucauccggcaggccccgcccgugauccgccaggcgccccccgucauccggcaggccccgcccgugauccgccaggcccccccccucauccggcaggccccgccccccauccgccccgccccgcaggugcuggcgacccagcccccccuguggcaggcccuccccccgccccccccccugcggcaggccccgcaggcccgccugcccgcgccccagguccaggccgccccccaggugccgacggccccccccgccacccaggugccggcggccccccccgccggcccccaggucccgcagcccgugcuccccgccccccuguccgccccgcugagcgcgccccaggccgugcacugccccuccaucaucuggcaggcccccaaggggcagccgcccgucccccacgagauccccaccagcauggaguuccaggaggugcagcagacccaggcccucgccuggcaggcgcagaaggccccgacgcacaucuggcagccccugcccgcccaggaggcccagcggcaggcccccccgcuggugcagcucgagcagcccuuccagggcgcgccccccucccagaaggccguccagauccagcugccgccccagcaggcccaggccagcgggccccaggcggaggugcccacccugccgcuccagcccagcuggcaggcccccccggccgugcugcaggcccagcccggcccccccgucgccgcggccaacuucccgcugggcuccgccaagagccucaugacccccuccggggagugccgcgccagcuccaucgaccgccggggcagcuccaaggagcgccggaccagcuccaaggagcgccgggcccccagcaaggaccgcaugaucuucgcggccacguucugcgcccccaaggccguguccgccgcgcgggcccaccugccggccgccuggaagaaccugcccgcgacccccgagaccuucgcccccagcuccagcguguucccggccaccucccaguuccagcccgccagccucaacgccuucaaggggcccuccgcggccagcgagacgcccaagucccugccguacgcccugcaggaccccuucgccugcgucgaggcccuccccgcggugcccugggugccgcagcccaacaugaacgccagcaaggccagccaggccguccccaccuuccugauggccaccgcggccgccccccaggccaccgcgaccacgcaggaggccuccaagaccagcguggagccgccccgccgguccggcaaggccacccgcaagaagaagcaccuggaggcccaggaggacagccggggccacacccucgccuuccacgacuggcaggggccccgccccugggagaaccugaaccuguccgacugggaggugcagagcccgauccaggucuccggcgacugggagcaccccaacacgccccgggggcucagcggcugggaggggccguccaccagccgcauccuguccggcugggagggccccagcgcguccugggcccugagcgccugggaggggcccuccaccagccgggcccugggccucuccgagagccccgggagcucccugccggugguggucagcgagguggccuccgugagccccggcuccagcgcgacccaggacaacuccaaggucgaggcccagccccugagcccccucgacgagcgcgccaacgcccuggugcaguuccugcucgugaaggaccaggccaaggucccggugcagcgguccgagauggugaaggucauccugcgcgaguacaaggacgagugccuggacaucaucaaccgggcgaacaacaagcucgagugcgccuucggguaccagcugaaggagaucgacacgaagaaccacgccuacaucaucaucaacaagcugggcuaccacaccggcaaccucguggccagcuaccuggaccgccccaaguucgggcugcucauggugguccugucccugaucuucaugaagggcaacugcgugcgcgaggaccucaucuucaacuuccuguucaagcuggggcucgacgugcgggagaccaacggccuguucgggaacaccaagaagcugaucacggaggucuucgugcgccagaaguaccucgaguaccggcgcauccccuacaccgagcccgccgaguacgaguuccuguggggcccgcgggcguuccuggagaccagcaagaugcucgugcugcgcuuccuggccaagcuccacaagaaggacccccaguccuggcccuuccacuaccuggaggcccuggccgagugcgagugggaggacaccgacgaggacgagcccgacacgggcgacagcgcgcacgggccgaccucccggccccccccccgcuga

SEQ ID NO: 2424 - RNA, 3750 nt, Artificial Sequence
  derived and/or modified sequence opt2 from MAGEL2__Homo_sapiens__CCDS73700.1
augucccagcucuccaagaaccucggcgacuccuccccccccgccgaggcccccaagccccccgucuacucccgccccaccguccucaugcgcgccccccccgccuccucccgcgccccccccguccccugggaccccccccccaucgaccuccaggccucccucgccgccuggcaggccccccagcccgccugggaggccccccagggccagcuccccgcccccgucguccccaugacccagccccccgcccucggcggccccaucguccccgcccccccccucggcggccccaugggcaagccccccacccccggcguccucaugguccacccccccccccccggcgcccccauggcccagccccccacccccggcguccucaugguccaccccuccgcccccggcgcccccauggcccacccccccccccccggcacccccaugucccacccccccccccccggcacccccauggcccacccccccccccccggcacccccauggcccacccccccccccccggcacccccaugguccacccccccccccccggcacccccauggcccacccccccccccccggcacccccauggcccacccccccccccccggcacccccauggcccacccccccccccccggcacccccauggcccacccccccccccccggcacccccauggcccagccccccgcccccggcguccucauggcccagccccucacccccggcguccucaugguccagcccgccgcccccggcgcccccaugguccagcccccccccgccgccaugaugacccagccccagcccuccggcgcccccauggccaagccccccggccccggcguccucaugauccacccccccggcgcccgcgcccccaugacccagccccccgccuccggcgcccccauggcccagcccgccgccccccccgcccagcccauggccccccccgcccagcccauggccuccugggccccccaggcccagccccucauccuccagauccagucccaggucauccgcgcccccccccaggucccccagggcccccaggccccccccgcccagcucgccaccccccccggcuggcaggccaccucccccggcuggcaggccacccagcagggcuggcaggccaccccccucaccuggcagaccacccaggucaccuggcaggcccccgccgucaccuggcagguccccccccccaugcgccagggccccccccccauccgccccggccccccccccauccgccccggccccccccccguccgccaggcccccccccucauccgccaggccccccccgucauccgccaggccccccccgucauccgccaggccccccccgucauccgccaggcccccgccgucauccgccaggccccccccgucauccgccaggccccccccgucauccgccaggccccccccgucauccgccaggcccccccccucauccgccaggcccccccccccauccgccccgccccccagguccucgccacccagcccccccucuggcaggcccucccccccccccccccccuccgccaggccccccaggcccgccuccccgccccccagguccaggccgccccccagguccccaccgccccccccgccacccagguccccgccgccccccccgccggcccccaggucccccagcccguccuccccgccccccucuccgccccccucuccgccccccaggccguccacugccccuccaucaucuggcaggcccccaagggccagccccccgucccccacgagauccccaccuccauggaguuccaggagguccagcagacccaggcccucgccuggcaggcccagaaggcccccacccacaucuggcagccccuccccgcccaggaggcccagcgccaggcccccccccucguccagcucgagcagcccuuccagggcgccccccccucccagaaggccguccagauccagcuccccccccagcaggcccaggccuccggcccccaggccgagguccccacccucccccuccagcccuccuggcaggccccccccgccguccuccaggcccagcccggcccccccgucgccgccgccaacuucccccucggcuccgccaagucccucaugacccccuccggcgagugccgcgccuccuccaucgaccgccgcggcuccuccaaggagcgccgcaccuccuccaaggagcgccgcgcccccuccaaggaccgcaugaucuucgccgccaccuucugcgcccccaaggccgucuccgccgcccgcgcccaccuccccgccgccuggaagaaccuccccgccacccccgagaccuucgcccccuccuccuccgucuuccccgccaccucccaguuccagcccgccucccucaacgccuucaagggccccuccgccgccuccgagacccccaagucccuccccuacgcccuccaggaccccuucgccugcgucgaggcccuccccgccguccccugggucccccagcccaacaugaacgccuccaaggccucccaggccguccccaccuuccucauggccaccgccgccgccccccaggccaccgccaccacccaggaggccuccaagaccuccgucgagcccccccgccgcuccggcaaggccacccgcaagaagaagcaccucgaggcccaggaggacucccgcggccacacccucgccuuccacgacuggcagggcccccgccccugggagaaccucaaccucuccgacugggagguccagucccccauccaggucuccggcgacugggagcaccccaacaccccccgcggccucuccggcugggagggccccuccaccucccgcauccucuccggcugggagggccccuccgccuccugggcccucuccgccugggagggccccuccaccucccgcgcccucggccucuccgagucccccggcuccucccuccccgucgucgucuccgaggucgccuccgucucccccggcuccuccgccacccaggacaacuccaaggucgaggcccagccccucuccccccucgacgagcgcgccaacgcccucguccaguuccuccucgucaaggaccaggccaagguccccguccagcgcuccgagauggucaaggucauccuccgcgaguacaaggacgagugccucgacaucaucaaccgcgccaacaacaagcucgagugcgccuucggcuaccagcucaaggagaucgacaccaagaaccacgccuacaucaucaucaacaagcucggcuaccacaccggcaaccucgucgccuccuaccucgaccgccccaaguucggccuccucauggucguccucucccucaucuucaugaagggcaacugcguccgcgaggaccucaucuucaacuuccucuucaagcucggccucgacguccgcgagaccaacggccucuucggcaacaccaagaagcucaucaccgaggucuucguccgccagaaguaccucgaguaccgccgcauccccuacaccgagcccgccgaguacgaguuccucuggggcccccgcgccuuccucgagaccuccaagaugcucguccuccgcuuccucgccaagcuccacaagaaggacccccaguccuggcccuuccacuaccucgaggcccucgccgagugcgagugggaggacaccgacgaggacgagcccgacaccggcgacuccgcccacggccccaccucccgcccccccccccgcuga

SEQ ID NO: 2425 - RNA, 3750 nt, Artificial Sequence
  derived and/or modified sequence opt3 from MAGEL2__Homo_sapiens__CCDS73700.1
augagccagcuguccaagaaccucggcgacucuucacccccugccgaggcuccaaaaccgcccguguacaguagaccuaccguccuuaugagggcaccacccgccagcucccgggcgccuccaguucccugggauccuccaccgaucgaccugcaggcuucuuuggccgcauggcaagcuccccagccugccugggaagcaccacaggggcaauuacccgccccugugguaccaaugacacagcccccggcucugggagguccuauugugcccgccccaccucuaggcgggcccaugggaaagccacccacuccuggcguccucauggugcacccaccgcccccuggugcgccaauggcacagcccccuacgccagggguucugauggugcaucccucggccccgggagcuccuauggcccacccacccccucccggcaccccaaugucacauccucccccaccgggcacaccuauggcacacccaccacccccugggacuccaauggcucaucccccuccgccaggaacccccaugguccacccuccacccccugguacaccgauggcccaucccccaccucccggcaccccaauggcgcacccucccccaccggggacuccuauggcccacccaccacccccuggaacaccaauggcacaucccccuccgccaggcacccccauggcucagccucccgccccaggugugcuuauggcucaaccucugacgcccgggguauugaugguucagccagccgcaccuggagccccgauggugcagcccccucccgcugcgaugaugacucagccccaaccaagcggcgcaccuauggccaaacccccgggcccagggguccucaugauacacccucccggagcucgcgccccaaugacccagcccccugcaaguggugccccgauggcucagcccgccgcacccccugcgcaacccauggcuccuccagcccagcccauggcauccugggccccucaggcucagccacugauccugcaaauucagucucaggugauccgagccccgccccaggugccucaaggcccacaggcacccccugcucagcucgccacaccacccggguggcaggcgacuagcccgggauggcaagccacccagcagggcuggcaggcuacaccuuuaaccuggcaaacgacucaggucacauggcaggcacccgccguuaccuggcaagugccaccucccaugcgucaggguccacccccuauuagaccagggccgcccccuaucaggccaggacccccuccaguacggcaggcucccccucugauacgccaggccccgccagugaucagacaagcacccccugucauuaggcaggcgcccccagugauccggcaggccccugcuguuauucgccaggcacccccagugauccgacaagccccgccugucauaagacaggcucccccagugauuaggcaggcacccccucuuauccggcaggccccacccccuauucguccggccccacaaguauuggcuacucagcccccucuguggcaggcgcuaccacccccucccccacuccgccaagccccgcaggcaagacugccugcuccccagguucaggccgccccacaagugccuacagcucccccagcaacccaggucccugccgcgcccccggcuggcccacaggugccucagcccguccuuccagcaccccuguccgccccuuugucagccccgcaagcugugcacugcccaaguaucaucuggcaggcacccaagggccagccucccguuccacaugagauuccuacgagcauggaguuccaggaagugcaacagacccaggcccucgcguggcaggcucaaaaagcccccacacacauauggcagccacugccugcacaggaagcccaaaggcaggcuccgcccuuaguacagcuggagcagccauuucaaggggccccucccucucagaaggcaguccagauccagcucccaccucaacaggcucaggccuccggaccccaggcggaggugccgacucuuccacugcaaccuucauggcaggcacccccagccguuuugcaggcucaacccgguccucccguggccgcugcaaauuucccacuaggcagcgccaagagucugaugaccccuucuggggaaugucgggccuccagcauugaucgacgcggaucgucuaaagagagaaggacauccucaaaggaacggcgcgcuccgaguaaagacagaaugaucuuugcggcaacuuucugcgcccccaaggcugucagcgccgcaagggcccaucucccagcugcguggaaaaaccugccugccacccccgagacauuugcaccauccucuagcguguucccugcuaccucacaguuucagcccgccagucuuaaugcauucaagggcccguccgccgcuagcgagacuccuaagucucugccauaugccuugcaggaucccuuugcguguguagaagcacucccugccgugccauggguuccccaaccuaacaugaaugcuucaaaagccagucaggcugucccaacguuccugauggcaacagccgcugcaccccaggccaccgcgacuacccaggaggccagcaagacauccguggaaccgccucgucggucugguaaagcuacccgaaagaaaaagcacuuagaggcccaagaagacucgagagggcauacucuggcauuucacgauuggcagggccccaggccaugggagaaccuaaaucucagcgacugggaggugcagucccccauacaggucucaggagauugggaacacccuaacacaccacgcggccugagugggugggagggacccucuacgagccggauucuuuccgguugggaaggcccuucagcuagcugggccuugucugcaugggaggggccauccaccaguagagcccugggacucagcgaaucuccgggcuccucacugcccguuguggugagugagguagcuagcgucucgccugguuccucugcgacucaagacaauagcaaaguggaggcccagccacuuucaccccuggaugaaagggcaaacgcuuugguucaguuccuccuggugaaggaccaggccaaggucccugugcaacgcagugagaugguuaaagugaucuuacgagaauacaaggaugagugccuggacaucauuaaucgggccaacaauaaacuagaaugugcauuuggguaucagcucaaggagaucgacaccaaaaaccaugcuuacauuauaaucaauaagcugggcuaucacacaggaaaccuuguagccuccuacuuggaucguccaaaguucggccugcucauggucgugcugucuuuaauuuucaugaaagggaacugcgugagagaggaccugaucuuuaauuuccuuuuuaaguugggacucgaugucagggaaacaaacggccuguucgguaauacuaaaaagcuaaucaccgagguuuuugugcgccagaaauaucuggaauaccggaggauucccuacacggagccggcggaguaugaguuccucugggggccuagagcuuuucuggaaaccagcaagaugcuuguauugcgauuccuggccaaguuacauaaaaaggacccacaauccuggcccuuucacuaccucgaagcacuggccgagugugaaugggaggauacagacgaggaugaaccugacacuggagauucagcucacggccccaccagccgcccaccgccucgguga

SEQ ID NO: 2426 - RNA, 3750 nt, Artificial Sequence
  derived and/or modified sequence opt4 from MAGEL2__Homo_sapiens__CCDS73700.1
augagccagcugagcaagaaccugggcgacagcagcccccccgccgaggcccccaagccccccguguacagcagacccaccgugcugaugagagccccccccgccagcagcagagccccccccgugcccugggaccccccccccaucgaccugcaggccagccuggccgccuggcaggccccccagcccgccugggaggccccccagggccagcugcccgcccccguggugcccaugacccagccccccgcccugggcggccccaucgugcccgcccccccccugggcggccccaugggcaagccccccacccccggcgugcugauggugcacccccccccccccggcgcccccauggcccagccccccacccccggcgugcugauggugcaccccagcgcccccggcgcccccauggcccacccccccccccccggcacccccaugagccacccccccccccccggcacccccauggcccacccccccccccccggcacccccauggcccacccccccccccccggcacccccauggugcacccccccccccccggcacccccauggcccacccccccccccccggcacccccauggcccacccccccccccccggcacccccauggcccacccccccccccccggcacccccauggcccacccccccccccccggcacccccauggcccagccccccgcccccggcgugcugauggcccagccccugacccccggcgugcugauggugcagcccgccgcccccggcgcccccauggugcagcccccccccgccgccaugaugacccagccccagcccagcggcgcccccauggccaagccccccggccccggcgugcugaugauccacccccccggcgccagagcccccaugacccagccccccgccagcggcgcccccauggcccagcccgccgccccccccgcccagcccauggccccccccgcccagcccauggccagcugggccccccaggcccagccccugauccugcagauccagagccaggugaucagagcccccccccaggugccccagggcccccaggccccccccgcccagcuggccaccccccccggcuggcaggccaccagccccggcuggcaggccacccagcagggcuggcaggccaccccccugaccuggcagaccacccaggugaccuggcaggcccccgccgugaccuggcaggugcccccccccaugagacagggccccccccccaucagacccggccccccccccaucagacccggccccccccccgugagacaggcccccccccugaucagacaggccccccccgugaucagacaggccccccccgugaucagacaggccccccccgugaucagacaggcccccgccgugaucagacaggccccccccgugaucagacaggccccccccgugaucagacaggccccccccgugaucagacaggcccccccccugaucagacaggcccccccccccaucagacccgccccccaggugcuggccacccagcccccccuguggcaggcccugccccccccccccccccugagacaggccccccaggccagacugcccgccccccaggugcaggccgccccccaggugcccaccgccccccccgccacccaggugcccgccgccccccccgccggcccccaggugccccagcccgugcugcccgccccccugagcgccccccugagcgccccccaggccgugcacugccccagcaucaucuggcaggcccccaagggccagccccccgugccccacgagauccccaccagcauggaguuccaggaggugcagcagacccaggcccuggccuggcaggcccagaaggcccccacccacaucuggcagccccugcccgcccaggaggcccagagacaggcccccccccuggugcagcuggagcagcccuuccagggcgccccccccagccagaaggccgugcagauccagcugcccccccagcaggcccaggccagcggcccccaggccgaggugcccacccugccccugcagcccagcuggcaggccccccccgccgugcugcaggcccagcccggcccccccguggccgccgccaacuucccccugggcagcgccaagagccugaugacccccagcggcgagugcagagccagcagcaucgacagaagaggcagcagcaaggagagaagaaccagcagcaaggagagaagagcccccagcaaggacagaaugaucuucgccgccaccuucugcgcccccaaggccgugagcgccgccagagcccaccugcccgccgccuggaagaaccugcccgccacccccgagaccuucgcccccagcagcagcguguuccccgccaccagccaguuccagcccgccagccugaacgccuucaagggccccagcgccgccagcgagacccccaagagccugcccuacgcccugcaggaccccuucgccugcguggaggcccugcccgccgugcccugggugccccagcccaacaugaacgccagcaaggccagccaggccgugcccaccuuccugauggccaccgccgccgccccccaggccaccgccaccacccaggaggccagcaagaccagcguggagccccccagaagaagcggcaaggccaccagaaagaagaagcaccuggaggcccaggaggacagcagaggccacacccuggccuuccacgacuggcagggccccagacccugggagaaccugaaccugagcgacugggaggugcagagccccauccaggugagcggcgacugggagcaccccaacacccccagaggccugagcggcugggagggccccagcaccagcagaauccugagcggcugggagggccccagcgccagcugggcccugagcgccugggagggccccagcaccagcagagcccugggccugagcgagagccccggcagcagccugcccgugguggugagcgagguggccagcgugagccccggcagcagcgccacccaggacaacagcaagguggaggcccagccccugagcccccuggacgagagagccaacgcccuggugcaguuccugcuggugaaggaccaggccaaggugcccgugcagagaagcgagauggugaaggugauccugagagaguacaaggacgagugccuggacaucaucaacagagccaacaacaagcuggagugcgccuucggcuaccagcugaaggagaucgacaccaagaaccacgccuacaucaucaucaacaagcugggcuaccacaccggcaaccugguggccagcuaccuggacagacccaaguucggccugcugaugguggugcugagccugaucuucaugaagggcaacugcgugagagaggaccugaucuucaacuuccuguucaagcugggccuggacgugagagagaccaacggccuguucggcaacaccaagaagcugaucaccgagguguucgugagacagaaguaccuggaguacagaagaauccccuacaccgagcccgccgaguacgaguuccuguggggccccagagccuuccuggagaccagcaagaugcuggugcugagauuccuggccaagcugcacaagaaggacccccagagcuggcccuuccacuaccuggaggcccuggccgagugcgagugggaggacaccgacgaggacgagcccgacaccggcgacagcgcccacggccccaccagcagacccccccccagauga

SEQ ID NO: 2427 - RNA, 3750 nt, Artificial Sequence
  derived and/or modified sequence opt5 from MAGEL2__Homo_sapiens__CCDS73700.1
augagccagcuguccaagaaccucggcgacucuagcccgccugccgaggcuccgaaacccccuguguacuccagacccaccguccugaugcgggccccucccgcgucuagccgcgcuccuccgguucccugggauccucccccuaucgaccuucaagccucccuggccgcuuggcaggcgccccagccggcuugggaagccccucaggggcaacuccccgcgccuguggugcccaugacacagcccccugcccugggaggcccgauuguccccgcuccuccccuugggggaccuaugggcaagcccccgacgccuggggugcugaugguucaucccccucccccuggagcccccauggcucagccgccuacccccggcgugcucaugguccaccccucugccccuggcgcgccgauggcccaucccccucccccugggacacccaugagccacccucccccgccuggaacccccauggcucacccucccccgccuggcacacccauggcccauccuccuccgcccgggacccccauggugcaucccccucccccuggaacacccauggcucacccuccgcccccuggcacccccauggcccacccucccccgccugggacgcccauggcccaucccccucccccuggaaccccgauggcucaucccccucccccuggcacacccauggcgcagccgccugcccccggcguucugauggcucaaccucugacccccggggugcucaugguccagccugccgcccccggagcuccgauggugcagccuccucccgccgcgaugaugacacagccccaaccguccggcgcucccauggccaaaccucccgggccuggagugcugaugauccaucccccuggcgccagagcuccgaugacccagcccccugccagcggggcucccauggcccagccugcggcucccccggcccaaccuauggccccucccgcucagcccauggccucuugggcgccccaggcccagccucuuauucugcaaauccagucccaggucauucgggcuccgccccagguuccucaaggaccccaggccccucccgcucagcucgccacgccgccuggcuggcaggccacaagccccggcuggcaagcuacccagcagggguggcaggcgacaccucugaccuggcaaaccacacaggugacguggcaggcccccgcugugaccuggcaagucccucccccgaugcgccagggaccuccucccaucagacccggcccgcccccuauccggcccgggccucccccugugcgccaggcucccccgcuuauuagacaggccccucccguuauccggcaagccccucccgugauucgccaggccccgccugucaucagacaggcgcccgcugugauucggcaggcucccccuguuauccgccaagcgcccccugugauuagacaggccccgcccgucauccggcaggccccuccccugauccgccaggccccucccccuauuagaccggcuccccaagugcucgccacacagccuccccuguggcaggcccugccucccccgccuccccuccggcaagcuccccaggccagacugccugcuccccagguccaggccgcgccucaagugccgaccgcucccccugccacacagguucccgccgcuccucccgccggaccccaggugccucagcccguccuuccugcuccccugucugccccgcucuccgcgccucaagccgugcacugccccagcaucauuuggcaggcucccaagggccagccucccguuccucacgagaucccgaccucuauggaguuccaggaagugcaacagacgcaggcccuggccuggcaggcucaaaaagcccccacacacauuuggcagccucuucccgcgcaggaagcucaacgccaggccccuccccugguccagcucgagcagccuuuucaaggggccccgcccucccagaaggcugugcagauccagcugccuccccaacaggcccaggcgagcggcccucaggcugaggugcccacccugccgcuccaaccuuccuggcaggccccucccgccguucugcaggcucaacccggacccccugucgccgcugccaauuucccgcuuggcucugccaagagccugaugacccccuccggggaaugucgggccagcucuaucgauagacgcggauccagcaaagagcggagaacaucuagcaaggaacgccgggcuccuuccaaagacagaaugauuuuugccgcuaccuucugcgcccccaaggccgugucugcugcgcgcgcccaccucccugcugccuggaaaaaccugcccgccacaccggagacguuugcuccuagcuccagcguguuccccgccaccucucaguuucagccugcgucccuuaaugcuuucaagggccccagcgccgccucugagacaccuaagucccugcccuaugcucuccaggauccguuugccugugucgaagcgcugcccgccgugccuuggguuccccaaccuaacaugaaugcuagcaaagccucccaggcugugccgaccuuccugauggccacagcugccgcgccccaggccaccgcuacgacccaggaggccucuaagacaagcgucgaaccuccccggagauccgggaaagcuacccgcaagaaaaagcaccucgaggcccaagaagacucucggggacauacacuggccuuucacgauuggcagggcccuagacccugggagaaccuuaaucugagcgacugggaggugcaguccccuauccagguuagcggggauugggaacaccccaacaccccgcggggccucucuggaugggagggcccuuccacgagccgcauucugucugggugggaaggacccuccgcuagcugggcgcugucugccugggagggcccuagcacauccagagcucuugggcucagcgaaucucccggauccagccugccgguggucguguccgagguugccucugugagcccuggcuccucugccacccaagacaauagcaaagucgaggcucagccccugucuccccucgaugaacgggccaacgcgcuggugcaguuccuucuggugaaggaccaggccaaggucccuguucaaagauccgagauggugaaagugauccuccgcgaauacaaggaugagugccuggacauuaucaaucgggcuaacaauaaacuggaaugugccuuuggguaucagcuuaaggagaucgacaccaaaaaccaugcuuacauuaucauuaauaagcucggcuaucacacaggaaaccuggucgccagcuaccuggauagacccaaguucggccuccugauggugguucuuucccugaucuucaugaaagggaacugcgugcgcgaggaccucauuuuuaauuuccuguuuaagcugggacuugaugucagagaaaccaacggccucuucgggaauacgaaaaagcugaucacagagguguuuguucggcagaaauaucuggaauaccgccggauuccuuacaccgagccggcggaguaugaguuccucuggggacccagagccuuucuggaaacaagcaagaugcuugugcugcgcuuccucgcuaagcugcauaaaaaggacccucaaucuuggcccuuucacuaccuggaagcccuugcugagugugaaugggaggauaccgacgaggaugaaccugacacaggcgauuccgcccacgggcccaccagcagaccgccuccccgguga

SEQ ID NO: 2428 - protein, 93 aa, Artificial Sequence
  mammaglobin_A__Homo_sapiens__Q13296
MKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 2429 - RNA, 282 nt, Artificial Sequence
  mammaglobin_A__Homo_sapiens__AAC39608
augaaguugcugaugguccucaugcuggcggcccucucccagcacugcuacgcaggcucuggcugccccuuauuggagaaugugauuuccaagacaaucaauccacaagugucuaagacugaauacaaagaacuucuucaagaguucauagacgacaaugccacuacaaaugccauagaugaauugaaggaauguuuucuuaaccaaacggaugaaacucugagcaauguugagguguuuaugcaauuaauauaugacagcagucuuugugauuuauuuuaa

SEQ ID NO: 2430 - RNA, 282 nt, Artificial Sequence
  derived and/or modified sequence opt1 from mammaglobin_A__Homo_sapiens__AAC39608
augaagcugcucauggugcugaugcuggccgcccucagccagcacugcuacgcgggcuccgggugcccgcugcuggagaacgucaucagcaagaccaucaacccccagguguccaagaccgaguacaaggagcuccugcaggaguucaucgacgacaacgccacgaccaacgccaucgacgagcugaaggagugcuuccucaaccagaccgacgagacccugagcaacguggaggucuucaugcagcugaucuacgacuccagccucugcgaccuguucuga

SEQ ID NO: 2431 - RNA, 282 nt, Artificial Sequence
  derived and/or modified sequence opt2 from mammaglobin_A__Homo_sapiens__AAC39608
augaagcuccucaugguccucaugcucgccgcccucucccagcacugcuacgccggcuccggcugcccccuccucgagaacgucaucuccaagaccaucaacccccaggucuccaagaccgaguacaaggagcuccuccaggaguucaucgacgacaacgccaccaccaacgccaucgacgagcucaaggagugcuuccucaaccagaccgacgagacccucuccaacgucgaggucuucaugcagcucaucuacgacuccucccucugcgaccucuucuga

SEQ ID NO: 2432 - RNA, 282 nt, Artificial Sequence
  derived and/or modified sequence opt3 from mammaglobin_A__Homo_sapiens__AAC39608
augaagcugcucauggugcuuaugcuggccgcuuugagccagcacugcuacgcaggcuccgggugucccuuacuggagaacgucaucucuaaaaccauuaauccucaaguuucaaagacagaauauaaagagcuacuccaggaguucauagacgauaacgccacuacgaaugcgaucgacgaacugaaggaaugcuuucuuaaccagaccgaugagacacugaguaauguggagguauucaugcaguugauuuacgacagcucccucugugaucuguuuuga

SEQ ID NO: 2433 - RNA, 282 nt, Artificial Sequence
  derived and/or modified sequence opt4 from mammaglobin_A__Homo_sapiens__AAC39608
augaagcugcugauggugcugaugcuggccgcccugagccagcacugcuacgccggcagcggcugcccccugcuggagaacgugaucagcaagaccaucaacccccaggugagcaagaccgaguacaaggagcugcugcaggaguucaucgacgacaacgccaccaccaacgccaucgacgagcugaaggagugcuuccugaaccagaccgacgagacccugagcaacguggagguguucaugcagcugaucuacgacagcagccugugcgaccuguucuga

SEQ ID NO: 2434 - RNA, 282 nt, Artificial Sequence
  derived and/or modified sequence opt5 from mammaglobin_A__Homo_sapiens__AAC39608
augaagcugcucauggugcugaugcuugccgcucugagccagcacugcuacgccggcuccggguguccccuccuggagaacgucaucucuaaaaccauuaauccucaaguuagcaagacagaauauaaagagcuucugcaggaauuuaucgacgauaacgcgacgaccaaugcuauugacgagcucaaggaaugcuuucugaaccagacagaugagacccuguccaauguggagguguucaugcagcucaucuacgacucuagccugugugaucuuuucuga

SEQ ID NO: 2435 - protein, 120 aa, Artificial Sequence
  mammaglobin_A__Homo_sapiens__Q6NX70
MKLLMVLMLAALSQHCYAGSGCPLLENVISKTINPQVSKTEYKELLQEFIDDNATTNAIDELKECFLNQTDETLSNVEVFMVISFSSYKLFKSPDQGQVGSSFLTDNAKATSEQAFSYIG

SEQ ID NO: 2436 - RNA, 363 nt, Artificial Sequence
  mammaglobin_A__Homo_sapiens__AAH67220
augaaguugcugaugguccucaugcuggcggcccucucccagcacugcuacgcaggcucuggcugccccuuauuggagaaugugauuuccaagacaaucaauccacaagugucuaagacugaauacaaagaacuucuucaagaguucauagacgacaaugccacuacaaaugccauagaugaauugaaggaauguuuucuuaaccaaacggaugaaacucugagcaauguugagguguuuaugguaauuucauuuucuuccuauaagcuuuuuaaauccccugaccagggacaagugggcucuucauuucucacugacaaugccaaagccacuagugaacaagccuuuucuuacauugguuaa

SEQ ID NO: 2437 - RNA, 363 nt, Artificial Sequence
  derived and/or modified sequence opt1 from mammaglobin_A__Homo_sapiens__AAH67220
augaagcugcucauggugcugaugcuggccgcccucagccagcacugcuacgcgggcuccgggugcccccugcuggagaacgucaucagcaagaccaucaacccccagguguccaagaccgaguacaaggagcuccugcaggaguucaucgacgacaacgccacgaccaacgccaucgacgagcugaaggagugcuuccucaaccagaccgacgagacccugagcaacguggaggucuucauggugaucuccuucagcuccuacaagcuguucaagagcccggaccagggccaggugggguccagcuuccucacggacaacgccaaggccaccuccgagcaggcguucagcuacaucggcuga

SEQ ID NO: 2438 - RNA, 363 nt, Artificial Sequence
  derived and/or modified sequence opt2 from mammaglobin_A__Homo_sapiens__AAH67220
augaagcuccucaugguccucaugcucgccgcccucucccagcacugcuacgccggcuccggcugcccccuccucgagaacgucaucuccaagaccaucaacccccaggucuccaagaccgaguacaaggagcuccuccaggaguucaucgacgacaacgccaccaccaacgccaucgacgagcucaaggagugcuuccucaaccagaccgacgagacccucuccaacgucgaggucuucauggucaucuccuucuccuccuacaagcucuucaagucccccgaccagggccaggucggcuccuccuuccucaccgacaacgccaaggccaccuccgagcaggccuucuccuacaucggcuga

SEQ ID NO: 2439 - RNA, 363 nt, Artificial Sequence
  derived and/or modified sequence opt3 from mammaglobin_A__Homo_sapiens__AAH67220
augaagcugcucauggugcuuaugcuggccgcuuugagccagcacugcuacgcaggcuccgggugucccuuacuggagaacgucaucucuaaaaccauuaauccucaaguuucaaagacagaauauaaagagcuacuccaggaguucauagacgauaacgccacuacgaaugcgaucgacgaacugaaggaaugcuuucuuaaccagaccgaugagacacugaguaauguggagguauucauggugauuagcuuuuccucuuacaaauuguucaagucgccagaccagggacaagucgguagcucauuucucacugauaacgcuaaggccaccagugaacaggcauucuccuauaucggcuga

SEQ ID NO: 2440 - RNA, 363 nt, Artificial Sequence
  derived and/or modified sequence opt4 from mammaglobin_A__Homo_sapiens__AAH67220
augaagcugcugauggugcugaugcuggccgcccugagccagcacugcuacgccggcagcggcugcccccugcuggagaacgugaucagcaagaccaucaacccccaggugagcaagaccgaguacaaggagcugcugcaggaguucaucgacgacaacgccaccaccaacgccaucgacgagcugaaggagugcuuccugaaccagaccgacgagacccugagcaacguggagguguucauggugaucagcuucagcagcuacaagcuguucaagagccccgaccagggccaggugggcagcagcuuccugaccgacaacgccaaggccaccagcgagcaggccuucagcuacaucggcuga

SEQ ID NO: 2441 - RNA, 363 nt, Artificial Sequence
  derived and/or modified sequence opt5 from mammaglobin_A__Homo_sapiens__AAH67220
augaagcugcucauggugcugaugcuugccgcucugagccagcacugcuacgccggcuccggguguccccuccuggagaacgucaucucuaaaaccauuaauccucaaguuagcaagacagaauauaaagagcuucugcaggaguucaucgacgauaacgcgacgaccaaugcuauugacgaacucaaggaaugcuuucugaaccagacagaugagacccuguccaauguggagguguucauggucaucucuuuuagcuccuacaaacucuucaagucuccggaccagggacaagugggcagcuccuuucugacagauaacgccaaggccaccagcgaacaggcuuucucuuauauuggguga

SEQ ID NO: 2442 - protein, 118 aa, Artificial Sequence
  MART-1/melan-A__Homo_sapiens__Q16655
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 2443 - RNA, 357 nt, Artificial Sequence
  MART-1/melan-A__Homo_sapiens__AAA19238
augccaagagaagaugcucacuucaucuaugguuaccccaagaaggggcacggccacucuuacaccacggcugaagaggccgcugggaucggcauccugacagugauccugggagucuuacugcucaucggcuguugguauuguagaagacgaaauggauacagagccuugauggauaaaagucuucauguuggcacucaaugugccuuaacaagaagaugcccacaagaaggguuugaucaucgggacagcaaagugucucuucaagagaaaaacugugaaccugugguucccaaugcuccaccugcuuaugagaaacucucugcagaacagucaccaccaccuuauucaccuuaa

SEQ ID NO: 2444 - RNA, 357 nt, Artificial Sequence
  derived and/or modified sequence opt1 from MART-1/melan-A__Homo_sapiens__AAA19238
augccccgcgaggacgcccacuucaucuacggcuaccccaagaaggggcacggccacagcuacaccaccgccgaggaggcggccgggaucggcauccugacggugauccucgggguccugcugcucaucggcugcugguacugccggcgccggaacggcuaccgcgcccugauggacaagucccugcacguggggacccagugcgcccucacccggcgcugcccccaggagggcuucgaccaccgggacagcaaggugucccugcaggagaagaacugcgagcccgucgugcccaacgccccgcccgcguacgagaagcugagcgccgagcaguccccgccgcccuacagccccuga

SEQ ID NO: 2445 - RNA, 357 nt, Artificial Sequence
  derived and/or modified sequence opt2 from MART-1/melan-A__Homo_sapiens__AAA19238
augccccgcgaggacgcccacuucaucuacggcuaccccaagaagggccacggccacuccuacaccaccgccgaggaggccgccggcaucggcauccucaccgucauccucggcguccuccuccucaucggcugcugguacugccgccgccgcaacggcuaccgcgcccucauggacaagucccuccacgucggcacccagugcgcccucacccgccgcugcccccaggagggcuucgaccaccgcgacuccaaggucucccuccaggagaagaacugcgagcccgucguccccaacgccccccccgccuacgagaagcucuccgccgagcagucccccccccccuacucccccuga

SEQ ID NO: 2446 - RNA, 357 nt, Artificial Sequence
  derived and/or modified sequence opt3 from MART-1/melan-A__Homo_sapiens__AAA19238
augcccagagaggacgcccacuucaucuacggcuauccuaagaaagggcauggacacagcuacaccacagcugaagaggcagccgguauuggcauacugacugugauccucgggguccuucuguugauuggaugcugguauuguaggcggcgcaacggcuaccgagcguuaauggauaagucccugcauguugguacgcagugcgcucuaacccguagauguccacaagaaggguuugaccacagggauucuaaagugucacuccaggagaagaauugcgaaccgguagugcccaacgccccuccagcauaugagaaacugagugccgagcagagcccucccccauacucccccuga

SEQ ID NO: 2447 - RNA, 357 nt, Artificial Sequence
  derived and/or modified sequence opt4 from MART-1/melan-A__Homo_sapiens__AAA19238
augcccagagaggacgcccacuucaucuacggcuaccccaagaagggccacggccacagcuacaccaccgccgaggaggccgccggcaucggcauccugaccgugauccugggcgugcugcugcugaucggcugcugguacugcagaagaagaaacggcuacagagcccugauggacaagagccugcacgugggcacccagugcgcccugaccagaagaugcccccaggagggcuucgaccacagagacagcaaggugagccugcaggagaagaacugcgagcccguggugcccaacgccccccccgccuacgagaagcugagcgccgagcagagccccccccccuacagccccuga

SEQ ID NO: 2448 - RNA, 357 nt, Artificial Sequence
  derived and/or modified sequence opt5 from MART-1/melan-A__Homo_sapiens__AAA19238
augcccagagaggacgcccacuucaucuacggcuauccuaagaaagggcauggacacagcuacaccacagcugaagaggccgcgggcauugggauccugacggugauucucggaguccugcuucugaucggcugcugguauugucggcgcagaaacggguaccgggcucucauggauaagucccugcauguuggaacccagugcgcccuuacacgcagauguccgcaagaaggcuuugaccaccgggauucuaaagugagccugcaggagaagaauugcgaacccguggucccuaacgcucccccugccuaugagaaacucuccgccgagcagucucccccuccguacagccccuga

SEQ ID NO: 2449 - protein, 493 aa, Artificial Sequence
  MART-2__Homo_sapiens__Q5VTY9
MLPRWELALYLLASLGFHFYSFYEVYKVSREHEEELDQEFELETDTLFGGLKKDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 2450 - RNA, 1482 nt, Artificial Sequence
  MART-2__Homo_sapiens__EAW93427
augcugccccgaugggaacuggcacuuuaccuacuugccucacuaggcuuccacuucuauuccuucuaugaaguuuacaaagucuccagagaacacgaagaggagcuggaccaggaauuugagcuggagacugacacuuuauuuggaggauuaaagaaggaugcgaccgacuuugaguggagcuucuggauggaaugggggaagcaguggcugguguggcuucuccuuggccacaugguagugucucaaauggccacacugcuggcaagaaagcacagacccuggauucucaugcucuaugggaugugggccugcuggugugugcuggggaccccugguguggcuaugguuuugcuccauaccaccaucucuuucugcguggcccaguuccggucucagcuccugacguggcucuguucucuccuccuccucuccacacugaggcugcaggguguggaagaaguuaagagaaggugguacaagacagaaaacgaguacuaccugcugcaguucacgcugaccguucgcugccucuacuacaccagcuucagccuggagcucugcuggcagcagcugccugcugcaucgaccuccuacuccuuucccuggaugcuggccuaugucuuuuauuauccagucuuacacaaugggcccauccucagcuucucggaguucaucaaacagaugcagcagcaggagcaugacucccugaaggccagccuguguguccuggcccuggggcugggccgccuucuuugcuggugguggcuggccgagcugauggcucaccugauguacaugcaugccaucuacagcagcaucccccuccuggagacugucucuuguuggaccuuaggaggacuggcguuagcccaggugcucuuuuucuacgugaaguacuuggugcucuuuggcgugccugcucugcucaugcgccuggauggacucacuccacccgcccucccccgcugcgugagcaccauguucaguuucaccgggauguggagguauuuugauguuggacugcauaauuucuuaaucagguauguguacauuccagugggcgggucccagcauggccugcuggggacacuguuuuccacggcgaugacauuugcauuugugagcuacuggcauggcggcuacgacuaccucuggugcugggcagcgcucaacuggcugggagucacuguggagaauggaguccggaggcugguggagacucccugcauccaggacagucuggcccgauacuucuccccacaagcucgccgucgauuccacgcugcccuugcuucuuguuccaccucgaugcugauccuguccaaccugguauuucuugggggcaaugagguugggaaaaccuacuggaauaggaucuucauacaaggcuggccuugggugacccucucuguccugggauuccuguacugcuacucccacgugggcauugccugggcccagaccuacgccacggacuaa

SEQ ID NO: 2451 - RNA, 1482 nt, Artificial Sequence
  derived and/or modified sequence opt1 from MART-2__Homo_sapiens__EAW93427
augcugccccgcugggagcucgcccuguaccugcucgccagccugggcuuccacuucuacuccuucuacgagguguacaaggucagccgggagcacgaggaggagcuggaccaggaguucgagcucgagaccgacacccuguucgggggccugaagaaggacgcgacggacuucgagugguccuucuggauggagugggggaagcaguggcucguguggcugcugcucggccacaugguggucagccagauggccacccugcuggcccgcaagcaccggccguggauccucaugcuguacgggaugugggccugcuggugcgugcugggcacccccggcguggccaugguccuccugcacaccacgaucuccuucugcguggcgcaguuccgcagccagcugcucaccuggcugugcucccugcuccugcugagcacccuccggcugcaggggguggaggaggucaagcgccggugguacaagaccgagaacgaguacuaccugcuccaguucacgcugaccgugcgcugccuguacuacaccuccuucagccucgagcugugcuggcagcagcugcccgccgccuccaccagcuacuccuuccccuggaugcucgccuacguguucuacuacccgguccugcacaacggccccauccugagcuucuccgaguucaucaagcagaugcagcagcaggagcacgacagccucaaggcgucccugugcgugcuggcccucgggcugggccggcugcucugcuggugguggcuggccgagcugauggcccaccucauguacaugcacgccaucuacagcuccaucccccugcuggagacggugagcugcuggacccucgggggccuggcgcuggcccagguccuguucuucuacgugaaguaccucgugcuguucggcguccccgcccugcucaugcgccuggacgggcugaccccgcccgcccucccccggugcgugagcaccauguucuccuucacgggcauguggcgcuacuucgacguggggcugcacaacuuccugauccgguacgucuacauccccgugggcggcagccagcacgggcuccugggcacccuguucuccaccgccaugaccuucgcguucgugagcuacuggcacgggggcuacgacuaccucuggugcugggccgcccugaacuggcugggggucacgguggagaacggcguccgccggcucguggagaccccgugcauccaggacucccuggcccgcuacuucagcccccaggcccggcgccgguuccacgcggcccuggccuccugcagcaccuccaugcucauccugagcaaccugguguuccucggcgggaacgaggucggcaagaccuacuggaaccgcaucuucauccagggguggcccugggugacgcuguccgugcugggcuuccucuacugcuacagccacgucgggaucgccugggcccagaccuacgcgaccgacuga

SEQ ID NO: 2452 - RNA, 1482 nt, Artificial Sequence
  derived and/or modified sequence opt2 from MART-2__Homo_sapiens__EAW93427
augcucccccgcugggagcucgcccucuaccuccucgccucccucggcuuccacuucuacuccuucuacgaggucuacaaggucucccgcgagcacgaggaggagcucgaccaggaguucgagcucgagaccgacacccucuucggcggccucaagaaggacgccaccgacuucgagugguccuucuggauggaguggggcaagcaguggcucgucuggcuccuccucggccacauggucgucucccagauggccacccuccucgcccgcaagcaccgccccuggauccucaugcucuacggcaugugggccugcuggugcguccucggcacccccggcgucgccaugguccuccuccacaccaccaucuccuucugcgucgcccaguuccgcucccagcuccucaccuggcucugcucccuccuccuccucuccacccuccgccuccagggcgucgaggaggucaagcgccgcugguacaagaccgagaacgaguacuaccuccuccaguucacccucaccguccgcugccucuacuacaccuccuucucccucgagcucugcuggcagcagcuccccgccgccuccaccuccuacuccuuccccuggaugcucgccuacgucuucuacuaccccguccuccacaacggccccauccucuccuucuccgaguucaucaagcagaugcagcagcaggagcacgacucccucaaggccucccucugcguccucgcccucggccucggccgccuccucugcuggugguggcucgccgagcucauggcccaccucauguacaugcacgccaucuacuccuccaucccccuccucgagaccgucuccugcuggacccucggcggccucgcccucgcccagguccucuucuucuacgucaaguaccucguccucuucggcguccccgcccuccucaugcgccucgacggccucaccccccccgcccucccccgcugcgucuccaccauguucuccuucaccggcauguggcgcuacuucgacgucggccuccacaacuuccucauccgcuacgucuacauccccgucggcggcucccagcacggccuccucggcacccucuucuccaccgccaugaccuucgccuucgucuccuacuggcacggcggcuacgacuaccucuggugcugggccgcccucaacuggcucggcgucaccgucgagaacggcguccgccgccucgucgagacccccugcauccaggacucccucgcccgcuacuucuccccccaggcccgccgccgcuuccacgccgcccucgccuccugcuccaccuccaugcucauccucuccaaccucgucuuccucggcggcaacgaggucggcaagaccuacuggaaccgcaucuucauccagggcuggcccugggucacccucuccguccucggcuuccucuacugcuacucccacgucggcaucgccugggcccagaccuacgccaccgacuga

SEQ ID NO: 2453 - RNA, 1482 nt, Artificial Sequence
  derived and/or modified sequence opt3 from MART-2__Homo_sapiens__EAW93427
augcugcccagaugggagcucgcccuuuaccuguuggcuagcuuaggcuuccacuuuuauuccuucuacgaaguguauaaggucucuagggagcaugaagaggaacuggaccaggaguuugagcuagaaaccgauacacucuucgggggacugaaaaaggacgcaacugauuuugaguggucauucuggauggaaugggguaaacaauggcuuguuuggcuguugcucggccacauggugguaagucagauggccacgcugcuggcgcggaagcaucgcccuuggauccucauguuauacgggaugugggcuugcuggugugugcugggaaccccaggcgucgccauggugcuuuugcacacaacuauuagcuuuugcguugcacaguuccgaucccagcugcuaaccuggcucuguucucugcuucuguugucgacacuccgucugcaagguguggaggaggucaaaagaaggugguauaagaccgaaaacgaguacuauuuacugcaguuuacucucacagugcggugccuuuacuacaccucauucagccuggaauuguguuggcagcagcuaccggccgcuaguacguccuauucuuuucccuggaugcuggcauacguauucuauuacccuguucuccauaaugggccaauacugagcuuuuccgaguucaucaagcaaaugcagcagcaggaacacgacucacuuaaagccagucugugcguguuggcucucggacugggccgcuuacuguguuggugguggcuagccgagcucauggcgcaccugauguauaugcaugcaauuuacagcucuaucccccuuuuggagacugucuccugcuggacccugggcgggcucgcccuggcucaagugcuuuucuuuuaugugaaguaccuggucuuguucggaguuccugcccuccugaugagauuagauggucugacaccacccgcacuaccuaggugugugucaacuauguuuagcuucaccggcauguggcgguacuuugacguagggcuccacaacuuccugauucgcuauguguacaucccagucggaggcagucagcauggucuuuuggggacacuguuuucuaccgcuaugacguucgccuuuguguccuauuggcacggaggcuacgauuaucucuggugcugggcggcccugaauugguuaggcguuacuguggaaaacgggguccgaagacugguggagacaccguguauacaggacagccuugcaagguacuucucgccccaagcucggcgucgcuuucacgccgcuuuggccucuugcuccaccucaaugcucauccugaguaaucuaguauuccugggagguaacgaaguuggcaaaacuuauuggaauagaauuuuuauccagggguggccuugggugacacucagcguccugggauuccuuuacugcuacucccaugugggcauugcaugggcccagaccuaugcuacggauuga

SEQ ID NO: 2454 - RNA, 1482 nt, Artificial Sequence
  derived and/or modified sequence opt4 from MART-2__Homo_sapiens__EAW93427
augcugcccagaugggagcuggcccuguaccugcuggccagccugggcuuccacuucuacagcuucuacgagguguacaaggugagcagagagcacgaggaggagcuggaccaggaguucgagcuggagaccgacacccuguucggcggccugaagaaggacgccaccgacuucgaguggagcuucuggauggaguggggcaagcaguggcugguguggcugcugcugggccacaugguggugagccagauggccacccugcuggccagaaagcacagacccuggauccugaugcuguacggcaugugggccugcuggugcgugcugggcacccccggcguggccauggugcugcugcacaccaccaucagcuucugcguggcccaguucagaagccagcugcugaccuggcugugcagccugcugcugcugagcacccugagacugcagggcguggaggaggugaagagaagaugguacaagaccgagaacgaguacuaccugcugcaguucacccugaccgugagaugccuguacuacaccagcuucagccuggagcugugcuggcagcagcugcccgccgccagcaccagcuacagcuuccccuggaugcuggccuacguguucuacuaccccgugcugcacaacggccccauccugagcuucagcgaguucaucaagcagaugcagcagcaggagcacgacagccugaaggccagccugugcgugcuggcccugggccugggcagacugcugugcuggugguggcuggccgagcugauggcccaccugauguacaugcacgccaucuacagcagcaucccccugcuggagaccgugagcugcuggacccugggcggccuggcccuggcccaggugcuguucuucuacgugaaguaccuggugcuguucggcgugcccgcccugcugaugagacuggacggccugaccccccccgcccugcccagaugcgugagcaccauguucagcuucaccggcauguggagauacuucgacgugggccugcacaacuuccugaucagauacguguacauccccgugggcggcagccagcacggccugcugggcacccuguucagcaccgccaugaccuucgccuucgugagcuacuggcacggcggcuacgacuaccuguggugcugggccgcccugaacuggcugggcgugaccguggagaacggcgugagaagacugguggagacccccugcauccaggacagccuggccagauacuucagcccccaggccagaagaagauuccacgccgcccuggccagcugcagcaccagcaugcugauccugagcaaccugguguuccugggcggcaacgaggugggcaagaccuacuggaacagaaucuucauccagggcuggcccugggugacccugagcgugcugggcuuccuguacugcuacagccacgugggcaucgccugggcccagaccuacgccaccgacuga

SEQ ID NO: 2455 - RNA, 1482 nt, Artificial Sequence
  derived and/or modified sequence opt5 from MART-2__Homo_sapiens__EAW93427
augcugcccagaugggagcucgcccuguaccuucuggcuagccucggcuuccacuuuuauuccuucuacgaaguguauaaggucucucgggagcaugaagaggaacuggaccaggaguuugagcuugaaaccgauacacuguucgggggacucaaaaaggacgccacggauuuugaguggagcuucuggauggaauggggcaaacaauggcugguuuggcugcuccuggggcacaugguggugucccagauggcgacccuucuggcucgcaagcauagaccuuggauccucaugcuguacggaaugugggccugcugguguguccuuggcacaccggggguggccaugguucugcuccacaccacaauuucuuuuugcguggcucaguuccggagccagcugcugaccuggcucuguucccugcuucugcucucuacacugcgccuucaaggagucgaggaggugaaaagacggugguauaagaccgaaaacgaguacuaucugcuccaguuuacgcugaccguucgcugccuguacuacacauccuucucccucgaacuguguuggcagcagcuucccgccgcuagcaccucuuauuccuuuccuuggaugcuggccuacguguucuauuaccccguccuccauaauggcccuauccugagcuuuucugaguucauuaagcaaaugcagcagcaggaacacgacucccuuaaagcgagccugugcgugcucgcccugggccuggggagacuccuguguuggugguggcuugcugagcugauggcccaccucauguauaugcaugcuaucuacucuuccauuccccugcuggagacagugagcugcuggacccuuggaggccucgcccuggcgcaaguccuguucuuuuauguuaaguaccucgugcuguucggggugccugcccuucugaugcggcucgauggacugacgccgcccgcucugccucgcugugucuccacaauguuuucuuucaccggcauguggagauacuuugacguggggcuucacaacuuccucauccgguauguuuacauccccgugggaggcagccagcauggccugcuggggacacucuuuuccaccgccaugaccuucgcuuuugucagcuauuggcacggaggcuacgauuaucuguggugcugggccgcccuuaauuggcugggggugacaguugaaaacggagugcgcagacucgucgagacgccuuguauucaggacucucuggcucgguacuucagcccccaagcgcgcagacgguuucacgccgcucuggccagcugcucuaccagcaugcuuauccucuccaaucugguguuccugggcgggaacgaagucggaaaaacauauuggaauagaauuuuuauccagggcuggccgugggugacccucucuguucugggcuuccuuuacugcuacagccauguggggauugccugggcucagacauaugccaccgauuga

SEQ ID NO: 2456 - protein, 317 aa, Artificial Sequence
  MC1_R__Homo_sapiens__Q01726
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 2457 - RNA, 954 nt, Artificial Sequence
  MC1_R__Homo_sapiens__AAD41349
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2458 - RNA, 954 nt, Artificial Sequence
  derived and/or modified sequence opt1 from MC1_R__Homo_sapiens__AAD41349
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2459 - RNA, 954 nt, Artificial Sequence
  derived and/or modified sequence opt2 from MC1_R__Homo_sapiens__AAD41349
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2460 - RNA, 954 nt, Artificial Sequence
  derived and/or modified sequence opt3 from MC1_R__Homo_sapiens__AAD41349
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacucucaggaacugcgaagaacccucaaggagguacugacgugcuccugguga

SEQ ID NO: 2461 - RNA, 954 nt, Artificial Sequence
  derived and/or modified sequence opt4 from MC1_R__Homo_sapiens__AAD41349
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2462 - RNA, 954 nt, Artificial Sequence
  derived and/or modified sequence opt5 from MC1_R__Homo_sapiens__AAD41349
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacucccaggaacuucgcagaacacucaaggaggugcugaccugcagcugguga

SEQ ID NO: 2463 - protein, 317 aa, Artificial Sequence; identical to SEQ ID NO: 2456
  MC1_R__Homo_sapiens__Q1JUL4

SEQ ID NO: 2464 - RNA, 954 nt, Artificial Sequence; identical to SEQ ID NO: 2457
  MC1_R__Homo_sapiens__AHC09522

SEQ ID NO: 2465 - RNA, 954 nt, Artificial Sequence; identical to SEQ ID NO: 2458
  derived and/or modified sequence opt1 from MC1_R__Homo_sapiens__AHC09522

SEQ ID NO: 2466 - RNA, 954 nt, Artificial Sequence; identical to SEQ ID NO: 2459
  derived and/or modified sequence opt2 from MC1_R__Homo_sapiens__AHC09522

SEQ ID NO: 2467 - RNA, 954 nt, Artificial Sequence; identical to SEQ ID NO: 2460
  derived and/or modified sequence opt3 from MC1_R__Homo_sapiens__AHC09522

SEQ ID NO: 2468 - RNA, 954 nt, Artificial Sequence; identical to SEQ ID NO: 2461
  derived and/or modified sequence opt4 from MC1_R__Homo_sapiens__AHC09522

SEQ ID NO: 2469 - RNA, 954 nt, Artificial Sequence; identical to SEQ ID NO: 2462
  derived and/or modified sequence opt5 from MC1_R__Homo_sapiens__AHC09522

SEQ ID NO: 2470 - protein, 317 aa, Artificial Sequence
  MC1_R__Homo_sapiens__Q1JUL6
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARQAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 2471 - RNA, 954 nt, Artificial Sequence
  MC1_R__Homo_sapiens__AHC09804
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcaagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2472 - RNA, 954 nt, Artificial Sequence
  derived and/or modified sequence opt1 from MC1_R__Homo_sapiens__AHC09804
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccaggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgggccugccagcacgcccagggcaucgcccgccugcacaagcggcagcgccccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcggcgcacccucaaggaggugcugaccugcagcugguga

SEQ ID NO: 2473 - RNA, 954 nt, Artificial Sequence
  derived and/or modified sequence opt2 from MC1_R__Homo_sapiens__AHC09804
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccaggccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2474 - RNA, 954 nt, Artificial Sequence
  derived and/or modified sequence opt3 from MC1_R__Homo_sapiens__AHC09804
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcaggcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcucgcgccugucagcacgcacaggggaucgccagacuccauaaaaggcaacggcccgugcaccagggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacucucaggaacugcgccgaacccucaaggagguacugacgugcuccugguga

SEQ ID NO: 2475 - RNA, 954 nt, Artificial Sequence
  derived and/or modified sequence opt4 from MC1_R__Homo_sapiens__AHC09804
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagacaggccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2476 - RNA, 954 nt, Artificial Sequence
  derived and/or modified sequence opt5 from MC1_R__Homo_sapiens__AHC09804
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgccaggcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcuagagccugucagcacgcccagggcaucgcucggcuccauaaacgccaaagaccuguucaccagggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacucccaggaacuucggcgcacacucaaggaggugcugaccugcagcugguga

SEQ ID NO: 2477 - protein, 317 aa, Artificial Sequence
  MC1_R__Homo_sapiens__Q1JUL8
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVTDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 2478 - RNA, 954 nt, Artificial Sequence
  MC1_R__Homo_sapiens__BAE94313
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucacugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2479 - RNA, 954 nt, Artificial Sequence
  derived and/or modified sequence opt1 from MC1_R__Homo_sapiens__BAE94313
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaccgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucacgauccugcugggcaucuucuuccucugcuggggcccguucuuccugcaccugacccucaucgugcugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugacgugcagcugguga

SEQ ID NO: 2480 - RNA, 954 nt, Artificial Sequence
  derived and/or modified sequence opt2 from MC1_R__Homo_sapiens__BAE94313
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaccgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2481 - RNA, 954 nt, Artificial Sequence
  derived and/or modified sequence opt3 from MC1_R__Homo_sapiens__BAE94313
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugacagauguaaucacuugcaguuccaugcugucuagccuuuguuuccugggugcaauugccguugaccguuauaucuccauauuuuacgcuuugagauaucauucaaucgugacccucccgagggcccggcgcgcagucgcugccauuuggguggcgaguguggucuucagcacacuguuuaucgccuacuaugaucacguugcaguguuacugugccucguaguguucuuucuugcuaugcuggucuugauggccgugcuauacguucauaugcuggcuagagccugucagcacgcacaggggauugccaggcuccauaaacggcagcgccccgugcaccaaggauucggccugaagggcgcugucacccuuacuauccuguuggggauauuuuuccucugcuggggacccuuuuuccugcacuuaacacugauugugcuauguccagagcauccuaccugcgguuguaucuuuaaaaauuucaaccucuuccuggcgcuuauuaucugcaaugcaaucauugacccuuugauauaugccuuucacucucaggaacugcgaagaacgcucaaggagguacugacuugcuccugguga

SEQ ID NO: 2482 - RNA, 954 nt, Artificial Sequence
  derived and/or modified sequence opt4 from MC1_R__Homo_sapiens__BAE94313
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaccgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2483 - RNA, 954 nt, Artificial Sequence
  derived and/or modified sequence opt5 from MC1_R__Homo_sapiens__BAE94313
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuaccgaugugauuacaugcagcucuaugcuguccagccuuuguuuccugggagcuaucgccgucgaccgcuauaucucuaucuuuuacgcgcucagauaucauuccauugugacccugccccgggcccgcagagcuguggccgcuauuugggucgccagcguuguguucucuacacuuuuuaucgccuacuaugaucacguggcuguccugcucugccuggugguuuucuuucuggcgaugcucgugcugauggccguccuuuacgugcauaugcuggcucgggccugucagcacgcccagggcauugcucgccuccauaaaagacagcggccuguucaccaaggcuucgggcugaagggagccgugacccuuacgauccugcucggcaucuuuuuccugugcugggggcccuuuuuccugcaccucacccugauuguccuuuguccugagcaucccacaugcggauguaucuuuaaaaauuucaaccuguuccucgcgcugauuaucugcaaugcuauuaucgacccucugauuuaugccuuucacucccaggaacuucgcagaacccucaaggaggugcugacaugcagcugguga

SEQ ID NO: 2484 - protein, 317 aa, Artificial Sequence [sequence omitted]

SEQ ID NO: 2485 - RNA, 954 nt, Artificial Sequence
  MC1_R__Homo_sapiens__AHC09531
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacaugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacgugcuccugguga

SEQ ID NO: 2486 - RNA, 954 nt, Artificial Sequence
  derived and/or modified sequence opt1 from MC1_R__Homo_sapiens__AHC09531
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacaugcuggagaccgccgucauccugcuccuggaggccggcgcgcugguggcccgcgccgccgugcuccagcagcuggacaacgucaucgacgugaucacgugcuccagcaugcuguccagccucugcuuccugggggccaucgcgguggaccgguacaucuccaucuucuacgcccugcgcuaccacagcaucgucacccucccccgggcccgccgggccguggccgcgaucuggguggccuccgucguguucagcacccuguucaucgccuacuacgaccacguggccguccugcucugccuggugguguucuuccuggccaugcucguccugauggcggugcuguacgugcacaugcucgcccgcgccugccagcacgcccagggcaucgcccggcugcacaagcgccagcggcccguccaccagggguucggccugaagggggcggugacccucaccauccugcugggcaucuucuuccucugcuggggcccguucuuccugcaccugacgcucaucguccugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2487 - RNA, 954 nt, Artificial Sequence
  derived and/or modified sequence opt2 from MC1_R__Homo_sapiens__AHC09531
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacaugcucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2488 - RNA, 954 nt, Artificial Sequence
  derived and/or modified sequence opt3 from MC1_R__Homo_sapiens__AHC09531
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauauguuagagaccgcugugauucugcuuuuggaagcaggcgcccugguugcucgagccgcggugcuacagcaacucgacaacgucaucgaugugauuacaugcaguuccaugcugucuagccuuuguuuccugggugcaaucgccguagaccguuauauauccaucuuuuacgcuuugagauaucauucaauuguuacucucccgagggcccggcgcgcaguggcugccaucugggucgcgagugugguguucagcacccuguuuauugccuacuaugaucacgucgcaguuuuacugugccucgugguauucuuucuugcuaugcugguguugauggccguccuauacgugcauaugcuggcuagagccugucagcacgcacaggggaucgccaggcuccauaaacggcagcgccccguucaccaaggauucggccugaagggcgcugugacacuuaccauacuguuggggaucuuuuuccucugcuggggaccauuuuuccugcacuuaacucugauuguccuauguccugagcaucccacaugcgguuguauuuuuaaaaauuucaaccucuuccuggcgcuuaucaucugcaaugcaauuauagacccuuugaucuaugccuuucacucucaggaacugcgaagaacccucaaggaggugcugacgugcuccugguga

SEQ ID NO: 2489 - RNA, 954 nt, Artificial Sequence
  derived and/or modified sequence opt4 from MC1_R__Homo_sapiens__AHC09531
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacaugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2490 - RNA, 954 nt, Artificial Sequence
  derived and/or modified sequence opt5 from MC1_R__Homo_sapiens__AHC09531
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauaugcuggagacagcuguuauccuucugcucgaagccggggcgcugguggcccgggcugccguccugcagcaacucgacaacgugauugauguuauuaccugcagcucuaugcuguccagccuuuguuuccugggagcuaucgccguggaccgcuauaucucuaucuuuuacgcgcucagauaucauuccauugucacacugccccgggcccgcagagcuguggccgcuaucuggguggccagcgucguuuucucuacccuuuuuauugccuacuaugaucacguggcugugcugcucugccuggucguguucuuucuggcgaugcucguucugauggccgugcuuuacguccauaugcuggcucgggccugucagcacgcccagggcaucgcucgccuccauaaaagacagcggccugugcaccaaggcuucgggcugaagggagccguuacacuuaccauucugcucggcaucuuuuuccugugcugggggcccuuuuuccugcaccucacgcugaucgugcuuuguccugagcauccuaccugcggauguauuuuuaaaaauuucaaccuguuccucgcgcugaucauuugcaaugcuaucauugacccccugaucuaugccuuucacucccaggaacuucgcagaacacucaaggagguccugaccugcagcugguga

SEQ ID NO: 2491 - protein, 317 aa, Artificial Sequence [sequence omitted]

SEQ ID NO: 2492 - RNA, 954 nt, Artificial Sequence
  MC1_R__Homo_sapiens__BAE94311
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccagaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcaagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2493 - RNA, 954 nt, Artificial Sequence
  derived and/or modified sequence opt1 from MC1_R__Homo_sapiens__BAE94311
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccagaaccugcacucccccauguacugcuucaucugcugccucgcccugagcgaccugcucguguccggcagcaacguccuggagaccgccgugauccugcuccuggaggccggcgcgcugguggcccgggccgccguccuccagcagcuggacaacgugaucgacgugaucacgugcuccagcaugcuguccagccucugcuuccugggggccaucgcggucgaccgcuacaucuccaucuucuacgcccugcgguaccacagcaucgugacccucccccgcgcccggcaggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2494 - RNA, 954 nt, Artificial Sequence
  derived and/or modified sequence opt2 from MC1_R__Homo_sapiens__BAE94311
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccagaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccaggccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2495 - RNA, 954 nt, Artificial Sequence
  derived and/or modified sequence opt3 from MC1_R__Homo_sapiens__BAE94311
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucagaacuugcacucuccaauguacuguuuuaucugcugucucgcccugucggaucugcucgucucaggaagcaauguguuagagaccgcuguuauucugcuuuuggaagcaggcgcccugguggcucgcgccgcgguccuacaacagcucgacaacgugaucgauguaauuacaugcaguuccaugcugucuagccuuuguuuccugggugcaaucgccguugaccgauauauauccaucuuuuacgcuuugcguuaucauucaauugugacucucccgagagccaggcaggcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcucgggccugucagcacgcacaagggaucgcccgccuccauaaaagacagaggcccgugcaccagggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacucucaggaacugcggcgcacccucaaggagguacugacgugcuccugguga

SEQ ID NO: 2496 - RNA, 954 nt, Artificial Sequence
  derived and/or modified sequence opt4 from MC1_R__Homo_sapiens__BAE94311
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaaccagaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagacaggccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2497 - RNA, 954 nt, Artificial Sequence
  derived and/or modified sequence opt5 from MC1_R__Homo_sapiens__BAE94311
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaaucagaaccuccacuccccgauguacuguuuuauuugcugucuggcccuuucugaucugcucgugagcggcuccaauguucuggagacagcugugauccuucugcucgaagccggggcgcuggucgccagagcugccgugcugcaacagcucgacaacguuauugaugugauuaccugcagcucuaugcuguccagccuuuguuuccugggagcuaucgccgucgaccgguauaucucuaucuuuuacgcgcuccgcuaucauuccauugugacacugcccagagcccggcaggcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgcgccugucagcacgcccaaggcaucgcuagacuccauaaacggcagcgcccuguucaccagggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacucccaggaacuuagacggacacucaaggaggugcugaccugcagcugguga

SEQ ID NO: 2498 - protein, 317 aa, Artificial Sequence [sequence omitted]

SEQ ID NO: 2499 - RNA, 954 nt, Artificial Sequence
  MC1_R__Homo_sapiens__BAE94309
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcaagccguuggggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2500 - RNA, 954 nt, Artificial Sequence
  derived and/or modified sequence opt1 from MC1_R__Homo_sapiens__BAE94309
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccaggccgugggcgccaucugggucgcguccgugguguucagcacccuguucaucgccuacuacgaccacgucgccgugcugcucugccugguggucuucuuccuggccaugcucgugcugauggccgugcuguacguccacaugcucgcgcgggccugccagcacgcccaggggaucgcccgccugcacaagcggcagcgccccgugcaccagggcuucgggcugaagggcgccgucacccucaccauccugcugggcaucuucuuccucugcugggggccguucuuccugcaccugacgcucaucgugcugugccccgagcacccgaccugcggcugcaucuucaagaacuucaaccuguuccucgcgcugaucaucugcaacgccaucaucgacccccugaucuacgccuuccacucccaggagcugcggcgcacccucaaggaggugcugaccugcagcugguga

SEQ ID NO: 2501 - RNA, 954 nt, Artificial Sequence
  derived and/or modified sequence opt2 from MC1_R__Homo_sapiens__BAE94309
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccaggccgucggcgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2502 - RNA, 954 nt, Artificial Sequence
  derived and/or modified sequence opt3 from MC1_R__Homo_sapiens__BAE94309
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcaggcagucggggcuaucuggguggccaguguggucuucagcacccuguuuauugcguacuaugaucacguugccguguuacugugccucguaguguucuuucuugcaaugcuggucuugauggcugugcuauacguucauaugcuggcccgcgcuugucagcacgcccagggaaucgcaagacuccauaaaaggcaacggcccgugcaccagggcuucggccugaagggggccgucacacuuaccauacuguugggaaucuuuuuccucugcugggguccauuuuuccugcacuuaacucugauugugcuauguccugagcaucccacaugcggcuguauuuuuaaaaauuucaaccucuuccuggcucuuaucaucugcaaugcgauuauagacccuuugaucuaugcauuucacucucaggaacugcgccgaacccucaaggagguacugacgugcuccugguga

SEQ ID NO: 2503 - RNA, 954 nt, Artificial Sequence
  derived and/or modified sequence opt4 from MC1_R__Homo_sapiens__BAE94309
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagacaggccgugggcgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2504 - RNA, 954 nt, Artificial Sequence
  derived and/or modified sequence opt5 from MC1_R__Homo_sapiens__BAE94309
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgccaggcugugggcgccaucugggucgcuagcguuguguucucuacccuuuuuauugccuacuaugaucacguggccguccugcucugccuggugguuuucuuucuggcuaugcucgugcugauggcgguccuuuacgugcauaugcuggccagagcuugucagcacgcccagggcaucgcccggcuccauaaacgccaaagaccuguucaccagggguucggacugaagggcgcugugacacuuaccauucugcucgggaucuuuuuccugugcuggggacccuuuuuccugcaccucacgcugaucguccuuuguccugagcauccuaccugcggcuguauuuuuaaaaauuucaaccuguuccucgcccugaucauuugcaaugcgaucauugacccccugaucuaugcuuuucacucccaggaacuucggcgcacacucaaggaggugcugaccugcagcugguga

SEQ ID NO: 2505 - protein, 317 aa, Artificial Sequence [sequence omitted]

SEQ ID NO: 2506 - RNA, 954 nt, Artificial Sequence
  MC1_R__Homo_sapiens__BAE94308
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucacugacgugaucaccugcagcuccaugcuguccagccucugcuuccugggcgccaucgccguggaccgcuacaucuccaucuucuacgcacugcgcuaccacagcaucgugacccugacgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2507 - RNA, 954 nt, Artificial Sequence
  derived and/or modified sequence opt1 from MC1_R__Homo_sapiens__BAE94308
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaccgacgugaucacgugcuccagcaugcuguccagccucugcuuccugggggccaucgcggucgaccgguacaucuccaucuucuacgcccugcgcuaccacagcaucgugacccucacccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacgcucaccauccugcugggcaucuucuuccucugcuggggccccuucuuccugcaccugacccucaucgugcugugcccggagcacccgaccugcgggugcaucuucaagaacuucaaccuguuccucgcccugaucaucugcaacgccaucaucgacccccugaucuacgccuuccacucccaggagcugcgccggacgcucaaggaggugcugaccugcagcugguga

SEQ ID NO: 2508 - RNA, 954 nt, Artificial Sequence
  derived and/or modified sequence opt2 from MC1_R__Homo_sapiens__BAE94308
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaccgacgucaucaccugcuccuccaugcucuccucccucugcuuccucggcgccaucgccgucgaccgcuacaucuccaucuucuacgcccuccgcuaccacuccaucgucacccucacccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2509 - RNA, 954 nt, Artificial Sequence
  derived and/or modified sequence opt3 from MC1_R__Homo_sapiens__BAE94308
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugacagauguaaucacuugcaguuccaugcugucuagccuuuguuuccugggugcaauugccguugaccguuauaucuccauauuuuacgcuuugagauaucauucaaucgugacccucacaagggcccggcgcgcagucgcugccauuuggguggcgaguguggucuucagcacccuguuuaucgccuacuaugaucacguugcaguguuacugugccucguaguguucuuucuugcuaugcuggucuugauggccgugcuauacguucauaugcuggcuagagccugucagcacgcacaggggauugccaggcuccauaaacggcagcgcccggugcaccaaggauucggccugaagggcgcugucacucuuacaauccuguuggggauauuuuuccucugcuggggacccuuuuuccugcacuuaacccugauugugcuauguccugagcauccaacgugcgguuguaucuuuaaaaauuucaaccucuuccuggcgcuuauuaucugcaaugcaaucauugaccccuugauauaugccuuucacucucaggaacugcgaagaacucucaaggagguacugaccugcuccugguga

SEQ ID NO: 2510 - RNA, 954 nt, Artificial Sequence
  derived and/or modified sequence opt4 from MC1_R__Homo_sapiens__BAE94308
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaccgacgugaucaccugcagcagcaugcugagcagccugugcuuccugggcgccaucgccguggacagauacaucagcaucuucuacgcccugagauaccacagcaucgugacccugaccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2511 - RNA, 954 nt, Artificial Sequence
  derived and/or modified sequence opt5 from MC1_R__Homo_sapiens__BAE94308
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuaccgaugugauuacaugcagcucuaugcuguccagccuuuguuuccugggagcuaucgccgucgaccgcuauaucucuaucuuuuacgcgcucagauaucauuccauugugacccugacacgggcccgcagagcuguggccgcuauuugggucgccagcguuguguucucuacccuuuuuaucgccuacuaugaucacguggcuguccugcucugccuggugguuuucuuucuggcgaugcucgugcugauggccguccuuuacgugcauaugcuggcucgggccugucagcacgcccagggcauugcucgccuccauaaaagacagcggcccguucaccaaggcuucgggcugaagggagccgugacgcuuaccauccugcucggcaucuuuuuccugugcugggggcccuuuuuccugcaccucacacugauuguccuuuguccugagcauccuaccugcggauguaucuuuaaaaauuucaaccuguuccucgcgcugauuaucugcaaugcuauuaucgacccccugauuuaugccuuucacucccaggaacuucgcagaacacucaaggaggugcugaccugcagcugguga

SEQ ID NO: 2512 - protein, 317 aa, Artificial Sequence [sequence omitted]

SEQ ID NO: 2513 - RNA, 954 nt, Artificial Sequence
  MC1_R__Homo_sapiens__BAE94307
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacaugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugauccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacgugcuccugguga

SEQ ID NO: 2514 - RNA, 954 nt, Artificial Sequence
  derived and/or modified sequence opt1 from MC1_R__Homo_sapiens__BAE94307
auggccgugcagggcagccagcgccggcugcucgggucccugaacagcacccccaccgccaucccgcagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacaugcuggagaccgccgucauccugcuccuggaggccggcgcgcugguggcccgcgccgccgugcuccagcagcuggacaacgucaucgacgugaucacgugcuccagcaugcuguccagccucugcuuccugggggccaucgcgguggaccgguacaucuccaucuucuacgcccugcgcuaccacagcaucgucauccucccccgggcccgccgggccguggccgcgaucuggguggccuccgucguguucagcacccuguucaucgccuacuacgaccacguggccguccugcucugccuggugguguucuuccuggccaugcucguccugauggcggugcuguacgugcacaugcucgcccgcgccugccagcacgcccagggcaucgcccggcugcacaagcgccagcggcccguccaccagggguucggccugaagggggcggugacccucaccauccugcugggcaucuucuuccucugcuggggcccguucuuccugcaccugacccucaucguccugugccccgagcaccccacgugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2515 - RNA, 954 nt, Artificial Sequence
  derived and/or modified sequence opt2 from MC1_R__Homo_sapiens__BAE94307
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacaugcucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucauccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2516 - RNA, 954 nt, Artificial Sequence
  derived and/or modified sequence opt3 from MC1_R__Homo_sapiens__BAE94307
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauauguuagagaccgcugugauucugcuuuuggaagcaggcgcccugguugcucgagccgcggugcuacagcaacucgacaacgucaucgaugugauuacaugcaguuccaugcugucuagccuuuguuuccugggugcaaucgccguagaccguuauauauccaucuuuuacgcuuugagauaucauucaauuguuauccucccgagggcccggcgcgcaguggcugccauuugggucgcgagugugguguucagcacucuguuuaucgccuacuaugaucacgucgcaguuuuacugugccucgugguauucuuucuugcuaugcugguguugauggccguccuauacgugcauaugcuggcuagagccugucagcacgcacaggggauagccaggcuccauaaacggcagcgccccguucaccaaggauucggccugaagggcgcugugacccuuacaauucuguuggggaucuuuuuccucugcuggggaccauuuuuccugcacuuaacccugauuguccuauguccugagcaucccacuugcgguuguaucuuuaaaaauuucaaccucuuccuggcgcuuaucauuugcaaugcaauaaucgacccuuugauuuaugccuuucacucucaggaacugcgaagaacacucaaggaggugcugaccugcuccugguga

SEQ ID NO: 2517 - RNA, 954 nt, Artificial Sequence
  derived and/or modified sequence opt4 from MC1_R__Homo_sapiens__BAE94307
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacaugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugauccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2518 - RNA, 954 nt, Artificial Sequence
  derived and/or modified sequence opt5 from MC1_R__Homo_sapiens__BAE94307
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauaugcuggagacagcuguuauccuucugcucgaagccggggcgcugguggcccgggcugccguccugcagcaacucgacaacgugauugauguuauuaccugcagcucuaugcuguccagccuuuguuuccugggagcuaucgccguggaccgcuauaucucuaucuuuuacgcgcucagauaucauuccauugucauccugccccgggcccgcagagcuguggccgcuauuuggguggccagcgucguuuucucuacacuuuuuaucgccuacuaugaucacguggcugugcugcucugccuggucguguucuuucuggcgaugcucguucugauggccgugcuuuacguccauaugcuggcucgggccugucagcacgcccagggcauugcucgccuccauaaaagacagcggccugugcaccaaggcuucgggcugaagggagccguuacccuuacaauccugcucggcaucuuuuuccugugcugggggcccuuuuuccugcaccucacccugauugugcuuuguccugagcaucccacgugcggauguaucuuuaaaaauuucaaccuguuccucgcgcugauuaucugcaaugcuauuaucgacccucugaucuaugccuuucacucccaggaacuucgcagaacccucaaggagguccugacaugcagcugguga

SEQ ID NO: 2519 - protein, 316 aa, Artificial Sequence
  MC1_R__Homo_sapiens__Q1JUM5
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIYALRYHSIVTLPRARQAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 2520 - RNA, 951 nt, Artificial Sequence
  MC1_R__Homo_sapiens__BAE94306
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuacgcacugcgcuaccacagcaucgugacccugccgcgggcgcggcaagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2521 - RNA, 951 nt, Artificial Sequence
  derived and/or modified sequence opt1 from MC1_R__Homo_sapiens__BAE94306
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuacgcccugcgcuaccacagcaucgugacccucccccgggcccgccaggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgggccugccagcacgcccagggcaucgcccgccugcacaagcggcagcgccccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcggcgcacccucaaggaggugcugaccugcagcugguga

SEQ ID NO: 2522 - RNA, 951 nt, Artificial Sequence
  derived and/or modified sequence opt2 from MC1_R__Homo_sapiens__BAE94306
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuacgcccuccgcuaccacuccaucgucacccucccccgcgcccgccaggccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2523 - RNA, 951 nt, Artificial Sequence
  derived and/or modified sequence opt3 from MC1_R__Homo_sapiens__BAE94306
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuacgcuuugagauaucauucaauugugacucucccgagggcccggcaggcagucgcugccaucuggguggcgaguguggucuuuagcacccuguucauugccuacuaugaucacguugcaguguuacugugccucguaguguuuuuccuugcuaugcuggucuugauggccgugcuauacguucauaugcuggcucgcgccugucagcacgcacaggggaucgccagacuccauaaaaggcaacggcccgugcaccagggauuuggccugaagggcgcugucacacuuaccauacuguuggggauuuucuuucucugcuggggaccuuucuuucugcacuuaacucugaucgugcuauguccagagcaucccacaugcgguuguauuuucaaaaauuuuaaccucuuccuggcgcuuaucaucugcaaugcaauuauagacccuuugaucuaugccuuccacucucaggaacugcgccgaacccucaaggagguacugacgugcuccugguga

SEQ ID NO: 2524 - RNA, 951 nt, Artificial Sequence
  derived and/or modified sequence opt4 from MC1_R__Homo_sapiens__BAE94306
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuacgcccugagauaccacagcaucgugacccugcccagagccagacaggccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2525 - RNA, 951 nt, Artificial Sequence
  derived and/or modified sequence opt5 from MC1_R__Homo_sapiens__BAE94306
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuacgcgcucagauaucauuccauugugacacugccccgggcccgccaggcuguggccgcuaucugggucgccagcguuguguuuucuacccuuuucauugccuacuaugaucacguggcuguccugcucugccuggugguguuuuuccuggcgaugcucguucugauggccguccuuuacgugcauaugcuggcuagagccugucagcacgcccagggcaucgcucggcuccauaaacgccaaagaccuguucaccagggcuuugggcugaagggagccgugacacuuaccauucugcucggcaucuucuuucugugcugggggcccuucuuucugcaccucacgcugaucguccuuuguccugagcauccuaccugcggauguauuuucaaaaauuuuaaccuguuccucgcgcugaucauuugcaaugcuaucauugacccccugaucuaugccuuccacucccaggaacuucggcgcacacucaaggaggugcugaccugcagcugguga

SEQ ID NO: 2526 - protein, 317 aa, Artificial Sequence [sequence omitted]

SEQ ID NO: 2527 - RNA, 954 nt, Artificial Sequence
  MC1_R__Homo_sapiens__AAQ62977
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucauccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2528 - RNA, 954 nt, Artificial Sequence
  derived and/or modified sequence opt1 from MC1_R__Homo_sapiens__AAQ62977
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucauccugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2529 - RNA, 954 nt, Artificial Sequence
  derived and/or modified sequence opt2 from MC1_R__Homo_sapiens__AAQ62977
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucauccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2530 - RNA, 954 nt, Artificial Sequence
  derived and/or modified sequence opt3 from MC1_R__Homo_sapiens__AAQ62977
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauuauucuauguccugagcaucccacaugcgguuguaucuuuaaaaauuucaaccucuuccuggcgcuuaucauuugcaaugcaauaaucgacccuuugauuuaugccuuucacucucaggaacugcgaagaacccucaaggaggugcugacgugcuccugguga

SEQ ID NO: 2531 - RNA, 954 nt, Artificial Sequence
  derived and/or modified sequence opt4 from MC1_R__Homo_sapiens__AAQ62977
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucauccugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2532 - RNA, 954 nt, Artificial Sequence
  derived and/or modified sequence opt5 from MC1_R__Homo_sapiens__AAQ62977
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucauucuuuguccugagcauccuaccugcggauguaucuuuaaaaauuucaaccuguuccucgcgcugauuaucugcaaugcuauuaucgacccccugaucuaugccuuucacucccaggaacuucgcagaacacucaaggagguccugaccugcagcugguga

SEQ ID NO: 2533 - protein, 317 aa, Artificial Sequence [sequence omitted]

SEQ ID NO: 2534 - RNA, 954 nt, Artificial Sequence
  MC1_R__Homo_sapiens__AAQ62975
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcuguggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2535 - RNA, 954 nt, Artificial Sequence
  derived and/or modified sequence opt1 from MC1_R__Homo_sapiens__AAQ62975
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgucgugcuccagcagcuggacaacgugaucgacgucaucacgugcuccagcaugcuguccagccucugcuuccugggggccaucgccguggaccgguacaucuccaucuucuacgcgcugcgcuaccacagcaucgugacccucccccgggcccgccgggccgucgccgccaucuggguggcguccguggucuucagcacccuguucaucgccuacuacgaccacguggccgugcugcucugccuggucguguucuuccuggccaugcucgugcugauggccguccuguacgugcacaugcucgcgcgcgccugccagcacgcccagggcaucgcccggcugcacaagcgccagcggcccguccaccagggguucggccugaagggggccgugacccucaccauccugcugggcaucuucuuccucugcuggggcccguucuuccugcaccugacgcucaucgugcugugccccgagcacccgaccugcgggugcaucuucaagaacuucaaccuguuccucgcgcugaucaucugcaacgccaucaucgacccccugaucuacgccuuccacucccaggagcugcgccggacccucaaggagguccugaccugcagcugguga

SEQ ID NO: 2536 - RNA, 954 nt, Artificial Sequence
  derived and/or modified sequence opt2 from MC1_R__Homo_sapiens__AAQ62975
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgucguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2537 - RNA, 954 nt, Artificial Sequence
  derived and/or modified sequence opt3 from MC1_R__Homo_sapiens__AAQ62975
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgucgugcuacagcaacucgacaacguaaucgauguuauuacaugcaguuccaugcugucuagccuuuguuuccugggugcgaucgcaguggaccguuauauauccaucuuuuacgccuugagauaucauucaauugucacucucccgagggcucggcgcgccguggcagcuaucuggguggccagugucguuuucagcacccuguuuauugcguacuaugaucacguggccguauuacugugccucguggucuucuuucuugcaaugcugguguugauggcuguucuauacgugcauaugcuggccagagcuugucagcacgcccaggggaucgcaaggcuccauaaacggcagcgccccguccaccaaggauucggccugaagggcgccgugacacuuaccauacuguuggggaucuuuuuccucugcuggggaccauuuuuccugcacuuaacucugauuguacuauguccugagcaucccacaugcgguuguauuuuuaaaaauuucaaccucuuccuggcucuuaucaucugcaaugcgauuauagacccuuugaucuaugcauuucacucucaggaacugcgaagaacccucaaggagguucugacgugcuccugguga

SEQ ID NO: 2538 - RNA, 954 nt, Artificial Sequence
  derived and/or modified sequence opt4 from MC1_R__Homo_sapiens__AAQ62975
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccguggugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2539 - RNA, 954 nt, Artificial Sequence
  derived and/or modified sequence opt5 from MC1_R__Homo_sapiens__AAQ62975
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugugguucugcagcaacucgacaacgugauugaugucauuaccugcagcucuaugcuguccagccuuuguuuccugggagccaucgcuguggaccgcuauaucucuaucuuuuacgcccucagauaucauuccauugugacacugccccgggcgcgcagagccgucgcugccaucuggguugcuagcgugguguucucuacccuuuuuauugccuacuaugaucacgucgccgugcugcucugccugguuguguucuuucuggcuaugcucguccugauggcggugcuuuacguucauaugcuggcccgggcuugucagcacgcccagggcaucgcccgccuccauaaaagacagcggccugugcaccaaggcuucgggcugaagggagcugucacacuuaccauucugcucggcaucuuuuuccugugcugggggcccuuuuuccugcaccucacgcugaucgugcuuuguccugagcauccuaccugcggauguauuuuuaaaaauuucaaccuguuccucgcccugaucauuugcaaugcgaucauugacccccugaucuaugcuuuucacucccaggaacuucgcagaacacucaaggagguccugaccugcagcugguga

SEQ ID NO: 2540 - protein, 317 aa, Artificial Sequence [sequence omitted]

SEQ ID NO: 2541 - RNA, 954 nt, Artificial Sequence
  MC1_R__Homo_sapiens__AAQ62974
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacacgcuccugguga

SEQ ID NO: 2542 - RNA, 954 nt, Artificial Sequence
  derived and/or modified sequence opt1 from MC1_R__Homo_sapiens__AAQ62974
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugacccgcagcugguga

SEQ ID NO: 2543 - RNA, 954 nt, Artificial Sequence
  derived and/or modified sequence opt2 from MC1_R__Homo_sapiens__AAQ62974
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucacccgcuccugguga

SEQ ID NO: 2544 - RNA, 954 nt, Artificial Sequence
  derived and/or modified sequence opt3 from MC1_R__Homo_sapiens__AAQ62974
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacucucaggaacugcgaagaacccucaaggagguacugacgagguccugguga

SEQ ID NO: 2545 - RNA, 954 nt, Artificial Sequence
  derived and/or modified sequence opt4 from MC1_R__Homo_sapiens__AAQ62974
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccagaagcugguga

SEQ ID NO: 2546 - RNA, 954 nt, Artificial Sequence
  derived and/or modified sequence opt5 from MC1_R__Homo_sapiens__AAQ62974
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacucccaggaacuucgcagaacacucaaggaggugcugacccggagcugguga

SEQ ID NO: 2547 - protein, 317 aa, Artificial Sequence [sequence omitted]

SEQ ID NO: 2548 - RNA, 954 nt, Artificial Sequence
  MC1_R__Homo_sapiens__AAQ62973
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggaugcucaaggaggugcugacaugcuccugguga

SEQ ID NO: 2549 - RNA, 954 nt, Artificial Sequence
  derived and/or modified sequence opt1 from MC1_R__Homo_sapiens__AAQ62973
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcgccggaugcucaaggaggugcugaccugcagcugguga

SEQ ID NO: 2550 - RNA, 954 nt, Artificial Sequence
  derived and/or modified sequence opt2 from MC1_R__Homo_sapiens__AAQ62973
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcaugcucaaggagguccucaccugcuccugguga

SEQ ID NO: 2551 - RNA, 954 nt, Artificial Sequence
  derived and/or modified sequence opt3 from MC1_R__Homo_sapiens__AAQ62973
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacucucaggaacugcgaagaaugcucaaggagguacugaccugcuccugguga

SEQ ID NO: 2552 - RNA, 954 nt, Artificial Sequence
  derived and/or modified sequence opt4 from MC1_R__Homo_sapiens__AAQ62973
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaaugcugaaggaggugcugaccugcagcugguga

SEQ ID NO: 2553 - RNA, 954 nt, Artificial Sequence
  derived and/or modified sequence opt5 from MC1_R__Homo_sapiens__AAQ62973
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacucccaggaacuucgcagaaugcucaaggaggugcugacaugcagcugguga

SEQ ID NO: 2554 - protein, 317 aa, Artificial Sequence [sequence omitted]

SEQ ID NO: 2555 - RNA, 954 nt, Artificial Sequence
  MC1_R__Homo_sapiens__AAQ62972
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggccugggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2556 - RNA, 954 nt, Artificial Sequence
  derived and/or modified sequence opt1 from MC1_R__Homo_sapiens__AAQ62972
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgccugggccugccagcacgcccagggcaucgcccgccugcacaagcggcagcgccccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcggcgcacccucaaggaggugcugaccugcagcugguga

SEQ ID NO: 2557 - RNA, 954 nt, Artificial Sequence
  derived and/or modified sequence opt2 from MC1_R__Homo_sapiens__AAQ62972
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgccugggccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2558 - RNA, 954 nt, Artificial Sequence
  derived and/or modified sequence opt3 from MC1_R__Homo_sapiens__AAQ62972
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuugggccugucagcacgcacaggggaucgccagacuccauaaaaggcagcggcccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacucucaggaacugcgccgaacccucaaggagguacugacgugcuccugguga

SEQ ID NO: 2559 - RNA, 954 nt, Artificial Sequence
  derived and/or modified sequence opt4 from MC1_R__Homo_sapiens__AAQ62972
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccugggccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2560 - RNA, 954 nt, Artificial Sequence
  derived and/or modified sequence opt5 from MC1_R__Homo_sapiens__AAQ62972
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcuugggccugucagcacgcccagggcaucgcucggcuccauaaacgccagagaccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacucccaggaacuucggcgcacacucaaggaggugcugaccugcagcugguga

SEQ ID NO: 2561 - protein, 317 aa, Artificial Sequence [sequence omitted]

SEQ ID NO: 2562 - RNA, 954 nt, Artificial Sequence
  MC1_R__Homo_sapiens__AAQ62971
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcaggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2563 - RNA, 954 nt, Artificial Sequence
  derived and/or modified sequence opt1 from MC1_R__Homo_sapiens__AAQ62971
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccaggcccggcgcgccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgggccugccagcacgcccagggcaucgcccgccugcacaagcggcagcgccccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcggcgcacccucaaggaggugcugaccugcagcugguga

SEQ ID NO: 2564 - RNA, 954 nt, Artificial Sequence
  derived and/or modified sequence opt2 from MC1_R__Homo_sapiens__AAQ62971
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccaggcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2565 - RNA, 954 nt, Artificial Sequence
  derived and/or modified sequence opt3 from MC1_R__Homo_sapiens__AAQ62971
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgcaggccaggcgggcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcucgcgccugucagcacgcacaggggaucgccagacuccauaaaaggcaacggcccgugcaccagggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacucucaggaacugcgccgaacccucaaggagguacugacgugcuccugguga

SEQ ID NO: 2566 - RNA, 954 nt, Artificial Sequence
  derived and/or modified sequence opt4 from MC1_R__Homo_sapiens__AAQ62971
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugccccaggccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2567 - RNA, 954 nt, Artificial Sequence
  derived and/or modified sequence opt5 from MC1_R__Homo_sapiens__AAQ62971
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccaggcccggcgcgcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcuagagccugucagcacgcccagggcaucgcucggcuccauaaacgccaaagaccuguucaccagggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacucccaggaacuucggcgcacacucaaggaggugcugaccugcagcugguga

SEQ ID NO: 2568 - protein, 317 aa, Artificial Sequence [sequence omitted]

SEQ ID NO: 2569 - RNA, 954 nt, Artificial Sequence
  MC1_R__Homo_sapiens__AAQ62970
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuuguuggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2570 - RNA, 954 nt, Artificial Sequence
  derived and/or modified sequence opt1 from MC1_R__Homo_sapiens__AAQ62970
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugcuggaccuccuggugagcggcuccaacguccuggagaccgccgugauccuccugcuggaggccggcgcgcucguggcccgcgccgccguccugcagcagcuggacaacgugaucgacgugaucacgugcagcuccaugcucagcucccugugcuuccugggggccaucgcggucgaccgguacaucagcaucuucuacgcccuccgcuaccacuccaucgugacccugccccgggcccgccgggccguggccgcgaucugggucgccagcgugguguucuccacccuguucaucgccuacuacgaccacgucgccgugcuccugugccugguggucuucuuccucgccaugcuggugcugauggcggugcucuacguccacaugcuggcccgcgccugccagcacgcccagggcaucgcccggcugcacaagcgccagcggcccgugcaccagggguucggccucaagggggcggucacccugaccauccugcucggcaucuucuuccugugcuggggcccguucuuccugcaccucacgcugaucgugcugugccccgagcacccgaccugcgggugcaucuucaagaacuucaaccucuuccuggcccugaucaucugcaacgccaucaucgacccccugaucuacgccuuccacagccaggagcuccgccggacccugaaggaggugcugaccugcuccugguga

SEQ ID NO: 2571 - RNA, 954 nt, Artificial Sequence
  derived and/or modified sequence opt2 from MC1_R__Homo_sapiens__AAQ62970
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccuccucgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2572 - RNA, 954 nt, Artificial Sequence
  derived and/or modified sequence opt3 from MC1_R__Homo_sapiens__AAQ62970
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugcuggaucucuuagucucgggaucaaaugugcuggagaccgcuguuauucuuuugcuggaagcaggcgcccuaguggcucgagccgcgguccuccagcaacuggacaacgugaucgauguaauuacaugcagcaguaugcuuuccucucuguguuucuugggugcaaucgccguugaccguuauauaagcaucuuuuacgcucucagauaucauuccauugugacucugccgagggcccggcgcgcagucgcugccaucuggguggcgucaguggucuucaguaccuuauuuauugccuacuaugaucacguugcagugcugcucugccuuguaguguucuuucuggcuauguugguccuaauggccgugcuguacguucauaugcucgcuagagccugucagcacgcacaggggaucgccaggcugcauaaacggcagcgccccgugcaccaaggauucggccuuaagggcgcugucacacugaccauauugcucgggaucuuuuuccugugcuggggaccauuuuucuuacaccugacucuaauugugcucuguccugagcaucccacaugcgguuguauuuuuaaaaauuucaaccuguuccuugcguugaucaucugcaaugcaauuauagacccucugaucuaugccuuucacagccaggaacuccgaagaacccugaaggagguacuuacgugcucuugguga

SEQ ID NO: 2573 - RNA, 954 nt, Artificial Sequence
  derived and/or modified sequence opt4 from MC1_R__Homo_sapiens__AAQ62970
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugcuggaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2574 - RNA, 954 nt, Artificial Sequence
  derived and/or modified sequence opt5 from MC1_R__Homo_sapiens__AAQ62970
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuucuggaucuccuggugucuggcagcaauguucuugagacagcugugauccugcuccuggaagccggggcgcuggucgcccgggcugccgugcuccagcaacuggacaacguuauugaugugauuaccugcuccagcaugcuuucuucccuguguuuccucggagcuaucgccgucgaccgcuauaucagcaucuuuuacgcgcugagauaucauucuauugugacacuuccccgggcccgcagagcuguggccgcuaucugggucgccuccguuguguucagcacccuguuuauugccuacuaugaucacguggcuguccuccugugccuggugguuuucuuucucgcgaugcuggugcuuauggccguccuguacgugcauaugcucgcucgggccugucagcacgcccagggcaucgcucgccugcauaaaagacagcggccuguucaccaaggcuucgggcuuaagggagccgugacacugaccauucuccugggcaucuuuuuccugugcugggggcccuuuuuccuccaccugacgcuuaucguccuguguccugagcauccuaccugcggauguauuuuuaaaaauuucaaccucuuccuggcgcugaucauuugcaaugcuaucauugacccccuuaucuaugccuuucacucucaggaacuccgcagaacacugaaggaggugcugaccugcuccugguga

SEQ ID NO: 2575 - protein, 317 aa, Artificial Sequence [sequence omitted]

SEQ ID NO: 2576 - RNA, 954 nt, Artificial Sequence
  MC1_R__Homo_sapiens__AAQ62969
auggcugugcagggaucccagagaagacuucugggcucccucaacuccacccccacagccaucccccagcuggggcuggcugccaaccagacaggagcccggugccuggagguguccaucucugacgggcuccuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2577 - RNA, 954 nt, Artificial Sequence
  derived and/or modified sequence opt1 from MC1_R__Homo_sapiens__AAQ62969
auggccgugcagggcagccagcgccggcugcucgggucccugaacagcacccccaccgccaucccccagcugggccucgcggccaaccagacgggggcccgcugccuggaggucuccaucagcgacggccugcuccugucccuggggcucgugagccugguggagaacgcccuggucguggccaccaucgcgaagaaccggaaccuccacucccccauguacugcuucaucugcugccuggcccugagcgaccuccugguguccggcagcaacguccuggagaccgccgugauccuccugcuggaggccggcgcgcucguggcccgcgccgccguccugcagcagcuggacaacgugaucgacgugaucacgugcuccagcaugcucuccagccugugcuuccugggggccaucgcggucgaccgguacaucuccaucuucuacgcccuccgcuaccacagcaucgugacccugccccgggcccgccgggccguggccgcgaucugggucgccuccgugguguucagcacccuguucaucgccuacuacgaccacgucgccgugcuccugugccugguggucuucuuccucgccaugcuggugcugauggcggugcucuacguccacaugcuggcccgcgccugccagcacgcccagggcaucgcccggcugcacaagcgccagcggcccgugcaccagggguucggccucaagggggcggucacccugaccauccugcucggcaucuucuuccugugcuggggcccguucuuccugcaccucacgcugaucgugcugugccccgagcacccgaccugcgggugcaucuucaagaacuucaaccucuuccuggcccugaucaucugcaacgccaucaucgacccccugaucuacgccuuccacucccaggagcuccgccggacccugaaggaggugcugaccugcagcugguga

SEQ ID NO: 2578 - RNA, 954 nt, Artificial Sequence
  derived and/or modified sequence opt2 from MC1_R__Homo_sapiens__AAQ62969
auggccguccagggcucccagcgccgccuccucggcucccucaacuccacccccaccgccaucccccagcucggccucgccgccaaccagaccggcgcccgcugccucgaggucuccaucuccgacggccuccuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2579 - RNA, 954 nt, Artificial Sequence
  derived and/or modified sequence opt3 from MC1_R__Homo_sapiens__AAQ62969
auggccgugcagggcagccaaagaaggcugcucgggucccuuaacucuacccccacagcuaucccucagcugggauuggcagccaaucagacuggugcgcggugcuuagaggucucaauuagugacggccugcuacucagccuggggcuuguuucccugguggaaaacgcuuugguaguggccacgauagcaaagaaucgcaaccuccacucuccaauguacuguuucaucugcugucuggcccugucggaucucuuagucucaggaagcaaugugcuggagaccgcuguuauucuuuugcuggaagcaggcgcccuaguggcucgagccgcgguccuccagcaacuggacaacgugaucgauguaauuacaugcaguuccaugcuuucuagccugugcuuuuugggugcaaucgccguugaccguuauauauccaucuucuacgcucucagauaucauucaauugugacucugccgagggcccggcgcgcagucgcugccaucuggguggcgaguguggucuuuagcaccuuauucauugccuacuaugaucacguugcagugcugcucugucuuguaguguuuuuccuggcuauguugguccuaauggccgugcuguacguucauaugcucgcuagagccugucagcacgcacaggggaucgccaggcugcauaaacggcagcgccccgugcaccaaggauuuggccuuaagggcgcugucacacugaccauauugcucgggauuuucuuucugugcuggggaccuuucuuuuuacaccugacucuaaucgugcucuguccagagcaucccacaugcgguuguauuuucaaaaauuuuaaccuguuccuugcguugaucaucugcaaugcaauuauagacccucugaucuaugccuuccacucucaggaacuccgaagaacccugaaggagguacuuacgugcuccugguga

SEQ ID NO: 2580 - RNA, 954 nt, Artificial Sequence
  derived and/or modified sequence opt4 from MC1_R__Homo_sapiens__AAQ62969
auggccgugcagggcagccagagaagacugcugggcagccugaacagcacccccaccgccaucccccagcugggccuggccgccaaccagaccggcgccagaugccuggaggugagcaucagcgacggccugcugcugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2581 - RNA, 954 nt, Artificial Sequence
  derived and/or modified sequence opt5 from MC1_R__Homo_sapiens__AAQ62969
auggccgugcagggcagccaaagacggcugcucgggucccugaacucuacccccacagcuaucccucagcuuggacuggccgcgaaucagacgggcgcucgcugccucgaggucagcauuuccgacgggcugcuucugucucucggacugguuagccugguggaaaacgcccucguggucgccaccaucgcuaagaauagaaaccugcacuccccgauguacuguuucauuugcugucuugcccugucugaucuccuggugagcggcuccaauguucuugagacagcugugauccugcuccuggaagccggggcgcuggucgcccgggcugccgugcuccagcaacuggacaacguuauugaugugauuaccugcagcucuaugcuuuccagccuguguuuucucggagcuaucgccgucgaccgcuauaucucuaucuucuacgcgcugagauaucauuccauugugacacuuccccgggcccgcagagcuguggccgcuaucugggucgccagcguuguguuuucuacccuguucauugccuacuaugaucacguggcuguccuccugugccuggugguguuuuuccucgcgaugcugguucuuauggccguccuguacgugcauaugcucgcucgggccugucagcacgcccagggcaucgcucgccugcauaaaagacagcggccuguucaccaaggcuuugggcuuaagggagccgugacacugaccauucuccugggcaucuucuuucugugcugggggcccuucuuucuccaccugacgcuuaucguccuguguccugagcauccuaccugcggauguauuuucaaaaauuuuaaccucuuccuggcgcugaucauuugcaaugcuaucauugacccccuuaucuaugccuuccacucccaggaacuccgcagaacacugaaggaggugcugaccugcagcugguga

SEQ ID NO: 2582 - protein, 317 aa, Artificial Sequence [sequence omitted]

SEQ ID NO: 2583 - RNA, 954 nt, Artificial Sequence
  MC1_R__Homo_sapiens__AAO21073
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcgggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2584 - RNA, 954 nt, Artificial Sequence
  derived and/or modified sequence opt1 from MC1_R__Homo_sapiens__AAO21073
auggccgugcagggcagccagcgccggcuccucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccgcgagaccgccgugauccugcugcucgaggccggcgcgcugguggcccgggccgccguccugcagcagcucgacaacgugaucgacgugaucacgugcuccagcaugcuguccagccugugcuuccucggggccaucgcggucgaccgcuacaucuccaucuucuacgcccugcgguaccacagcaucgugacccugccccgcgcccggcgcgccguggccgcgaucugggucgccuccgugguguucagcacccucuucaucgccuacuacgaccacgucgccgugcugcugugccucguggucuucuuccuggccaugcuggugcucauggcggugcuguacguccacaugcuggcccgggccugccagcacgcccagggcaucgcccgccuccacaagcggcagcgccccgugcaccagggguucggccugaagggggcggucacccugaccauccuccugggcaucuucuuccugugcuggggcccguucuuccuccaccugacgcugaucgugcucugccccgagcacccgaccugcgggugcaucuucaagaacuucaaccuguuccuggcccucaucaucugcaacgccaucaucgacccccugaucuacgccuuccacucccaggagcugcggcgcacccugaaggaggugcugaccugcagcugguga

SEQ ID NO: 2585 - RNA, 954 nt, Artificial Sequence
  derived and/or modified sequence opt2 from MC1_R__Homo_sapiens__AAO21073
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccgcgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2586 - RNA, 954 nt, Artificial Sequence
  derived and/or modified sequence opt3 from MC1_R__Homo_sapiens__AAO21073
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaaugugcgagagaccgcuguuauuuuacugcuugaagcaggcgccuugguggcucgugccgcgguccugcagcaacuagacaacgugaucgauguaauuacaugcaguuccaugcucucuagccuguguuuccuuggugcaaucgccguugacagauauauauccaucuuuuacgcucugagguaucauucaauugugacuuugccgcgggcccgcagagcagucgcugccaucuggguggcgaguguggucuucagcacccucuuuauugccuacuaugaucacguugcagugcuguuaugccugguaguguucuuucucgcuaugcuuguccugauggccguguuguacguucauaugcuagcuagggccugucagcacgcacaggggaucgcccggcugcauaaacgccagcgacccgugcaccaaggauucggccucaagggcgcugucacacugaccauacuucuggggaucuuuuucuugugcuggggaccauuuuuccuccaccugacuuuaauugugcuguguccugagcaucccacaugcgguuguauuuuuaaaaauuucaaccuauuccucgcgcugaucaucugcaaugcaauuauagacccucuuaucuaugccuuucacucucaggaauugagaaggacccugaaggagguacucacgugcuccugguga

SEQ ID NO: 2587 - RNA, 954 nt, Artificial Sequence
  derived and/or modified sequence opt4 from MC1_R__Homo_sapiens__AAO21073
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugagagagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2588 - RNA, 954 nt, Artificial Sequence
  derived and/or modified sequence opt5 from MC1_R__Homo_sapiens__AAO21073
auggccgugcagggcagccaaagacggcuccucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucgggagacagcugugauccugcuucuggaagccggggcgcucgucgcccgcgcugccgugcugcagcaacuggacaacguuauugaugugauuaccugcagcucuaugcucuccagccuguguuuccuuggagcuaucgccgucgacagauauaucucuaucuuuuacgcgcugcgguaucauuccauugugacacucccccgcgccagacgggcuguggccgcuaucugggucgccagcguuguguucucuacccuguuuauugccuacuaugaucacguggcuguccuucugugccucgugguuuucuuucuggcgaugcuggugcucauggccguccuguacgugcauaugcuugcucgcgccugucagcacgcccagggcaucgcuagacugcauaaacggcagcgcccuguucaccaaggcuucgggcucaagggagccgugacacugaccauucuucugggcaucuuuuuccucugcugggggcccuuuuuccugcaccugacgcucaucguccuguguccugagcauccuaccugcggauguauuuuuaaaaauuucaaccuuuuccuggcgcucaucauuugcaaugcuaucauugacccccugaucuaugccuuucacucccaggaacugagacggacacuuaaggaggugcugaccugcagcugguga

SEQ ID NO: 2589 - protein, 317 aa, Artificial Sequence [sequence omitted]

SEQ ID NO: 2590 - RNA, 954 nt, Artificial Sequence
  MC1_R__Homo_sapiens__AHC09567
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugccggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2591 - RNA, 954 nt, Artificial Sequence
  derived and/or modified sequence opt1 from MC1_R__Homo_sapiens__AHC09567
auggccgugcagggcagccagcgccggcugcucgggucccugaacagcacccccaccgccaucccgcagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugcccgaccugcucgugagcggcuccaacguccuggagaccgccgugauccugcuccuggaggccggcgcgcugguggcccgcgccgccguccuccagcagcuggacaacgugaucgacgugaucacgugcagcuccaugcugagcucccucugcuuccugggggccaucgcggucgaccgguacaucagcaucuucuacgcccugcgcuaccacuccaucgugacccucccccgggcccgccgggccguggccgcgaucugggucgccagcgugguguucuccacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggccggugcaccagggguucggccugaagggggcggucacccucaccauccugcugggcaucuucuuccucugcuggggccccuucuuccugcaccugacgcucaucgugcugugccccgagcacccgaccugcgggugcaucuucaagaacuucaaccuguuccucgcccugaucaucugcaacgccaucaucgacccccugaucuacgccuuccacagccaggagcugcgccggacccucaaggaggugcugaccugcuccugguga

SEQ ID NO: 2592 - RNA, 954 nt, Artificial Sequence
  derived and/or modified sequence opt2 from MC1_R__Homo_sapiens__AHC09567
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccuccccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2593 - RNA, 954 nt, Artificial Sequence
  derived and/or modified sequence opt3 from MC1_R__Homo_sapiens__AHC09567
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugccggaucugcucgucucgggaucaaauguguuagagaccgcuguuauucugcuuuuggaagcaggcgcccugguggcucgagccgcgguccuacagcaacucgacaacgugaucgauguaauuacaugcagcaguaugcuguccucucuuuguuuccugggugcaaucgccguugaccguuauauaagcaucuuuuacgcuuugagauaucauuccauugugacucuccccagggcccggcgcgcagucgcugccaucuggguggcgucaguggucuucaguacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgcccugugcaccaaggauucggccugaagggcgcugucacacuuaccauacuguuggggaucuuuuuccucugcuggggaccauuuuuccugcacuuaacucugauugugcuaugucccgagcauccuacaugcgguuguauuuuuaaaaauuucaaccucuuccuggcgcuuaucaucugcaaugcaauuauagacccauugaucuaugccuuucacagccaggaacugcgaagaacccucaaggagguacugacgugcucuugguga

SEQ ID NO: 2594 - RNA, 954 nt, Artificial Sequence
  derived and/or modified sequence opt4 from MC1_R__Homo_sapiens__AHC09567
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugcccgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2595 - RNA, 954 nt, Artificial Sequence
  derived and/or modified sequence opt5 from MC1_R__Homo_sapiens__AHC09567
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuucccgaucugcucgugucuggcagcaauguucuggagacagcugugauccuucugcucgaagccggggcgcuggucgcccgggcugccgugcugcagcaacucgacaacguuauugaugugauuaccugcuccagcaugcugucuucccuuuguuuccugggagcuaucgccgucgaccgcuauaucagcaucuuuuacgcgcucagauaucauucuauugugacacugccucgggcccgcagagcuguggccgcuaucugggucgccuccguuguguucagcacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggcccguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccgcugaucuaugccuuucacucucaggaacuucgcagaacacucaaggaggugcugaccugcuccugguga

SEQ ID NO: 2596 - protein, 317 aa, Artificial Sequence [sequence omitted]

SEQ ID NO: 2597 - RNA, 954 nt, Artificial Sequence
  MC1_R__Homo_sapiens__AHC09812
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucauggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2598 - RNA, 954 nt, Artificial Sequence
  derived and/or modified sequence opt1 from MC1_R__Homo_sapiens__AHC09812
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugaugguguucuuccuggccaugcucguccugauggcggugcuguacgugcacaugcucgcccgcgccugccagcacgcccagggcaucgcccggcugcacaagcgccagcggcccguccaccagggguucggccugaagggggcggugacccucaccauccugcugggcaucuucuuccucugcuggggcccguucuuccugcaccugacgcucaucguccugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2599 - RNA, 954 nt, Artificial Sequence
  derived and/or modified sequence opt2 from MC1_R__Homo_sapiens__AHC09812
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucauggucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2600 - RNA, 954 nt, Artificial Sequence
  derived and/or modified sequence opt3 from MC1_R__Homo_sapiens__AHC09812
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucaugguauucuuucuugcuaugcugguguugauggccguccuauacgugcauaugcuggcuagagccugucagcacgcacaggggaucgccaggcuccauaaacggcagcgccccguucaccaaggauucggccugaagggcgcugugacacuuaccauacuguuggggaucuuuuuccucugcuggggaccauuuuuccugcacuuaacucugauuguccuauguccugagcaucccacaugcgguuguauuuuuaaaaauuucaaccucuuccuggcgcuuaucaucugcaaugcaauuauagacccuuugaucuaugccuuucacucucaggaacugcgaagaacccucaaggaggugcugacgugcuccugguga

SEQ ID NO: 2601 - RNA, 954 nt, Artificial Sequence
  derived and/or modified sequence opt4 from MC1_R__Homo_sapiens__AHC09812
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccugaugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2602 - RNA, 954 nt, Artificial Sequence
  derived and/or modified sequence opt5 from MC1_R__Homo_sapiens__AHC09812
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccugaugguguucuuucuggcgaugcucguucugauggccgugcuuuacguccauaugcuggcucgggccugucagcacgcccagggcaucgcucgccuccauaaaagacagcggccugugcaccaaggcuucgggcugaagggagccguuacacuuaccauucugcucggcaucuuuuuccugugcugggggcccuuuuuccugcaccucacgcugaucgugcuuuguccugagcauccuaccugcggauguauuuuuaaaaauuucaaccuguuccucgcgcugaucauuugcaaugcuaucauugacccccugaucuaugccuuucacucccaggaacuucgcagaacacucaaggagguccugaccugcagcugguga

SEQ ID NO: 2603 - protein, 317 aa, Artificial Sequence [sequence omitted]

SEQ ID NO: 2604 - RNA, 954 nt, Artificial Sequence
  MC1_R__Homo_sapiens__AHC10192
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaccgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2605 - RNA, 954 nt, Artificial Sequence
  derived and/or modified sequence opt1 from MC1_R__Homo_sapiens__AHC10192
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaccgcccggcugcacaagcgccagcggcccgugcaccagggguucggccugaagggggcggucacccucacgauccugcugggcaucuucuuccucugcuggggcccguucuuccugcaccugacccucaucgugcugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugacgugcagcugguga

SEQ ID NO: 2606 - RNA, 954 nt, Artificial Sequence
  derived and/or modified sequence opt2 from MC1_R__Homo_sapiens__AHC10192
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaccgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2607 - RNA, 954 nt, Artificial Sequence
  derived and/or modified sequence opt3 from MC1_R__Homo_sapiens__AHC10192
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggacagccaggcuccauaaacggcagcgccccgugcaccaaggauucggccugaagggcgcugucacccuuacuauccuguuggggauauuuuuccucugcuggggacccuuuuuccugcacuuaacacugauugugcuauguccagagcauccuaccugcgguuguaucuuuaaaaauuucaaccucuuccuggcgcuuauuaucugcaaugcaaucauugacccuuugauauaugccuuucacucucaggaacugcgaagaacgcucaaggagguacugacuugcuccugguga

SEQ ID NO: 2608 - RNA, 954 nt, Artificial Sequence
  derived and/or modified sequence opt4 from MC1_R__Homo_sapiens__AHC10192
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaccgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2609 - RNA, 954 nt, Artificial Sequence
  derived and/or modified sequence opt5 from MC1_R__Homo_sapiens__AHC10192
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauauuucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcacagcucgccuccauaaaagacagcggccuguucaccaaggcuucgggcugaagggagccgugacccuuacgauccugcucggcaucuuuuuccugugcugggggcccuuuuuccugcaccucacccugaucguccuuuguccugagcaucccacaugcggauguaucuuuaaaaauuucaaccuguuccucgcgcugauuaucugcaaugcuauuaucgacccucugauuuaugccuuucacucccaggaacuucgcagaacccucaaggaggugcugacaugcagcugguga

SEQ ID NO: 2610 - protein, 317 aa, Artificial Sequence
  MC1_R__Homo_sapiens__V9Q7F1
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSTVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 2611 - RNA, 954 nt, Artificial Sequence
  MC1_R__Homo_sapiens__AHC09641
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaccgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacgugcuccugguga

SEQ ID NO: 2612 - RNA, 954 nt, Artificial Sequence
  derived and/or modified sequence opt1 from MC1_R__Homo_sapiens__AHC09641
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaccgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucacgauccugcugggcaucuucuuccucugcuggggcccguucuuccugcaccugacccucaucgugcugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugacgugcagcugguga

SEQ ID NO: 2613 - RNA, 954 nt, Artificial Sequence
  derived and/or modified sequence opt2 from MC1_R__Homo_sapiens__AHC09641
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaccgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2614 - RNA, 954 nt, Artificial Sequence
  derived and/or modified sequence opt3 from MC1_R__Homo_sapiens__AHC09641
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaacugugacccucccgagggcccggcgcgcagucgcugccauuuggguggcgaguguggucuucagcacacuguuuaucgccuacuaugaucacguugcaguguuacugugccucguaguguucuuucuugcuaugcuggucuugauggccgugcuauacguucauaugcuggcuagagccugucagcacgcacaggggauugccaggcuccauaaacggcagcgccccgugcaccaaggauucggccugaagggcgcugucacccuuacuauccuguuggggauauuuuuccucugcuggggacccuuuuuccugcacuuaacacugauugugcuauguccagagcauccuaccugcgguuguaucuuuaaaaauuucaaccucuuccuggcgcuuauuaucugcaaugcaaucauugacccuuugauauaugccuuucacucucaggaacugcgaagaacgcucaaggagguacugacuugcuccugguga

SEQ ID NO: 2615 - RNA, 954 nt, Artificial Sequence
  derived and/or modified sequence opt4 from MC1_R__Homo_sapiens__AHC09641
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaccgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2616 - RNA, 954 nt, Artificial Sequence
  derived and/or modified sequence opt5 from MC1_R__Homo_sapiens__AHC09641
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauauuucuaucuuuuacgcgcucagauaucauuccacagugacccugccccgggcccgcagagcuguggccgcuauuugggucgccagcguuguguucucuacacuuuuuaucgccuacuaugaucacguggcuguccugcucugccuggugguuuucuuucuggcgaugcucgugcugauggccguccuuuacgugcauaugcuggcucgggccugucagcacgcccagggcauugcucgccuccauaaaagacagcggccuguucaccaaggcuucgggcugaagggagccgugacccuuacgauccugcucggcaucuuuuuccugugcugggggcccuuuuuccugcaccucacccugaucguccuuuguccugagcaucccacaugcggauguaucuuuaaaaauuucaaccuguuccucgcgcugauuaucugcaaugcuauuaucgacccucugauuuaugccuuucacucccaggaacuucgcagaacccucaaggaggugcugacaugcagcugguga

SEQ ID NO: 2617 - protein, 317 aa, Artificial Sequence [sequence omitted]

SEQ ID NO: 2618 - RNA, 954 nt, Artificial Sequence
  MC1_R__Homo_sapiens__AHC10044
auggcugugcagggaucccagagaagacuucugggcucccucaacuccacccccacagccaucccccagcuggggcuggcugccaaccagacaggagcccgguaccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2619 - RNA, 954 nt, Artificial Sequence
  derived and/or modified sequence opt1 from MC1_R__Homo_sapiens__AHC10044
auggccgugcagggcagccagcgccggcugcucgggucccugaacagcacccccaccgccaucccccagcugggccucgcggccaaccagacgggggcccgcuaccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2620 - RNA, 954 nt, Artificial Sequence
  derived and/or modified sequence opt2 from MC1_R__Homo_sapiens__AHC10044
auggccguccagggcucccagcgccgccuccucggcucccucaacuccacccccaccgccaucccccagcucggccucgccgccaaccagaccggcgcccgcuaccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2621 - RNA, 954 nt, Artificial Sequence
  derived and/or modified sequence opt3 from MC1_R__Homo_sapiens__AHC10044
auggccgugcagggcagccaaagaaggcugcucgggucccuuaacucuacccccacagcuaucccucagcugggauuggcagccaaucagacuggugcgcgguacuuagaggucucaauuagugacggccuguuccuaagccucgggcugguuucccuuguggaaaacgcucugguaguggccacgauagcaaagaaucgcaacuugcacucuccaauguauugcuuuaucuguugccucgcccugucggaucugcucgucucaggaagcaauguguuagagaccgcuguuauucugcuuuuggaagcaggcgcccugguggcucgagccgcgguccuacagcaacucgacaacgugaucgauguaauuacauguaguuccaugcugucuagccuuugcuuccugggugcaaucgccguugaccguuacauauccaucuuuuaugcuuugagauaccauucaauugugacucucccgagggcccggcgcgcagucgcugccaucuggguggcgaguguggucuucagcacccuguuuauugccuauuacgaucacguugcaguguuacugugucucguaguguucuuucuugcuaugcuggucuugauggccgugcuauauguucauaugcuggcuagagccugccagcacgcacaggggaucgccaggcuccauaaacggcagcgccccgugcaccaaggauucggccugaagggcgcugucacacuuaccauacuguuggggaucuuuuuccucuguuggggaccauuuuuccugcacuuaacucugauugugcuaugcccugagcaucccacaugugguugcauuuuuaaaaauuucaaccucuuccuggcgcuuaucaucuguaaugcaauuauagacccuuugaucuacgccuuucacucucaggaacugcgaagaacccucaaggagguacugacgugcuccugguga

SEQ ID NO: 2622 - RNA, 954 nt, Artificial Sequence
  derived and/or modified sequence opt4 from MC1_R__Homo_sapiens__AHC10044
auggccgugcagggcagccagagaagacugcugggcagccugaacagcacccccaccgccaucccccagcugggccuggccgccaaccagaccggcgccagauaccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2623 - RNA, 954 nt, Artificial Sequence
  derived and/or modified sequence opt5 from MC1_R__Homo_sapiens__AHC10044
auggccgugcagggcagccaaagacggcugcucgggucccugaacucuacccccacagcuaucccucagcuuggacuggccgcgaaucagacgggcgcucgcuaccucgaggucagcauuuccgacgggcuguuccuuucucugggacucguuagccugguggaaaacgcccugguggucgccaccaucgcuaagaauagaaaccuccacuccccgauguauugcuuuauuuguugccuggcccuuucugaucugcucgugagcggcuccaauguucuggagacagcugugauccuucugcucgaagccggggcgcuggucgcccgggcugccgugcugcagcaacucgacaacguuauugaugugaucaccuguagcucuaugcuguccagccuuugcuuccugggagcuaucgccgucgaccgcuacauuucuaucuuuuaugcgcucagauaccauuccauugugacacugccccgggcccgcagagcuguggccgcuaucugggucgccagcguuguguucucuacccuuuuuauugccuauuacgaucacguggcuguccugcucugucuggugguuuucuuucuggcgaugcucgugcugauggccguccuuuaugugcauaugcuggcucgggccugccagcacgcccagggcaucgcucgccuccauaaaagacagcggccuguucaccaaggcuucgggcugaagggagccgugacacuuaccauucugcucggcaucuuuuuccuguguugggggcccuuuuuccugcaccucacgcugaucguccuuugcccugagcaucccaccuguggaugcauuuuuaaaaauuucaaccuguuccucgcgcugaucauuuguaaugcuaucauugacccucugaucuacgccuuucacucccaggaacuucgcagaacacucaaggaggugcugaccugcagcugguga

SEQ ID NO: 2624 - protein, 317 aa, Artificial Sequence [sequence omitted]

SEQ ID NO: 2625 - RNA, 954 nt, Artificial Sequence
  MC1_R__Homo_sapiens__AHC09532
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcugguguuggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2626 - RNA, 954 nt, Artificial Sequence
  derived and/or modified sequence opt1 from MC1_R__Homo_sapiens__AHC09532
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccugguccuggccaccaucgcgaagaaccggaaccuccacucccccauguacugcuucaucugcugccuggcccugagcgaccuccugguguccggcagcaacgugcuggagaccgccgucauccuccugcuggaggccggcgcgcucguggcccgcgccgccgugcugcagcagcuggacaacgucaucgacgugaucacgugcuccagcaugcucuccagccugugcuuccugggggccaucgcgguggaccgguacaucuccaucuucuacgcccuccgcuaccacagcaucgucacccugccccgggcccgccgggccguggccgcgaucuggguggccuccgucguguucagcacccuguucaucgccuacuacgaccacguggccguccuccugugccuggugguguucuuccucgccaugcugguccugauggcggugcucuacgugcacaugcuggcccgcgccugccagcacgcccagggcaucgcccggcugcacaagcgccagcggcccguccaccagggguucggccucaagggggcggugacccugaccauccugcucggcaucuucuuccugugcuggggcccguucuuccugcaccucacgcugaucguccugugccccgagcacccgaccugcgggugcaucuucaagaacuucaaccucuuccuggcccugaucaucugcaacgccaucaucgacccccugaucuacgccuuccacucccaggagcuccgccggacccugaaggaggugcugaccugcagcugguga

SEQ ID NO: 2627 - RNA, 954 nt, Artificial Sequence
  derived and/or modified sequence opt2 from MC1_R__Homo_sapiens__AHC09532
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucguccucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2628 - RNA, 954 nt, Artificial Sequence
  derived and/or modified sequence opt3 from MC1_R__Homo_sapiens__AHC09532
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguauuggccacgauagcaaagaaucgcaaccuccacucuccaauguacuguuuuaucugcugucuggcccugucggaucucuuagugucaggaagcaauguccuggagaccgcugugauucuuuugcuggaagcaggcgcccuaguugcucgagccgcggugcuccagcaacuggacaacgucaucgaugugauuacaugcaguuccaugcuuucuagccuguguuucuugggugcaaucgccguagaccguuauauauccaucuuuuacgcucucagauaucauucaauuguuacucugccgagggcccggcgcgcaguggcugccaucugggucgcgagugugguguucagcaccuuauuuauugccuacuaugaucacgucgcaguucugcucugccuugugguauucuuucuggcuauguuggugcuaauggccguccuguacgugcauaugcucgcuagagccugucagcacgcacaggggaucgccaggcugcauaaacggcagcgccccguucaccaaggauucggccuuaagggcgcugugacacugaccauauugcucgggaucuuuuuccugugcuggggaccauuuuucuuacaccugacucuaauuguccucuguccugagcaucccacaugcgguuguauuuuuaaaaauuucaaccuguuccuugcguugaucaucugcaaugcaauuauagacccucugaucuaugccuuucacucucaggaacuccgaagaacccugaaggaggugcuuacgugcuccugguga

SEQ ID NO: 2629 - RNA, 954 nt, Artificial Sequence
  derived and/or modified sequence opt4 from MC1_R__Homo_sapiens__AHC09532
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugcuggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2630 - RNA, 954 nt, Artificial Sequence
  derived and/or modified sequence opt5 from MC1_R__Homo_sapiens__AHC09532
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccuggugcucgccaccaucgcuaagaauagaaaccugcacuccccgauguacuguuuuauuugcugucuugcccugucugaucuccuggucagcggcuccaaugugcuugagacagcuguuauccugcuccuggaagccggggcgcugguggcccgggcugccguccuccagcaacuggacaacgugauugauguuauuaccugcagcucuaugcuuuccagccuguguuuccucggagcuaucgccguggaccgcuauaucucuaucuuuuacgcgcugagauaucauuccauugucacacuuccccgggcccgcagagcuguggccgcuaucuggguggccagcgucguuuucucuacccuguuuauugccuacuaugaucacguggcugugcuccugugccuggucguguucuuucucgcgaugcugguucuuauggccgugcuguacguccauaugcucgcucgggccugucagcacgcccagggcaucgcucgccugcauaaaagacagcggccugugcaccaaggcuucgggcuuaagggagccguuacacugaccauucuccugggcaucuuuuuccugugcugggggcccuuuuuccuccaccugacgcuuaucgugcuguguccugagcauccuaccugcggauguauuuuuaaaaauuucaaccucuuccuggcgcugaucauuugcaaugcuaucauugacccccuuaucuaugccuuucacucccaggaacuccgcagaacacugaaggagguccugaccugcagcugguga

SEQ ID NO: 2631 - protein, 317 aa, Artificial Sequence [sequence omitted]

SEQ ID NO: 2632 - RNA, 954 nt, Artificial Sequence
  MC1_R__Homo_sapiens__AHC11042
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccugcccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2633 - RNA, 954 nt, Artificial Sequence
  derived and/or modified sequence opt1 from MC1_R__Homo_sapiens__AHC11042
auggccgugcagggcagccagcgccggcugcucgggucccugaacagcacccccaccgccaucccgcagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucccccugagcgaccugcucguguccggcagcaacguccuggagaccgccgugauccugcuccuggaggccggcgcccugguggcgcgcgccgccguccuccagcagcuggacaacgugaucgacgugaucacgugcuccagcaugcuguccagccucugcuuccugggggccaucgccgucgaccgguacaucuccaucuucuacgcgcugcgcuaccacagcaucgugacccucccccgggcccgccgggccguggccgccaucugggucgcguccgugguguucagcacccuguucaucgccuacuacgaccacgucgccgugcugcucugccugguggucuucuuccuggccaugcucgugcugauggccgugcuguacguccacaugcucgcgcgcgccugccagcacgcccagggcaucgcccggcugcacaagcgccagcggccggugcaccagggguucggccugaagggggccgucacccucaccauccugcugggcaucuucuuccucugcuggggccccuucuuccugcaccugacgcucaucgugcugugccccgagcacccgaccugcgggugcaucuucaagaacuucaaccuguuccucgcgcugaucaucugcaacgccaucaucgacccccugaucuacgccuuccacucccaggagcugcgccggacccucaaggaggugcugaccugcagcugguga

SEQ ID NO: 2634 - RNA, 954 nt, Artificial Sequence
  derived and/or modified sequence opt2 from MC1_R__Homo_sapiens__AHC11042
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucccccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2635 - RNA, 954 nt, Artificial Sequence
  derived and/or modified sequence opt3 from MC1_R__Homo_sapiens__AHC11042
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucccgcugucggaucugcucgucucaggaagcaauguguuagagaccgccguuauucugcuuuuggaagcuggcgcacugguggcccgagcugccguccuacagcaacucgacaacgugaucgauguaauuacaugcaguuccaugcugucuagccuuuguuuccugggugcgaucgcaguugaccguuauauauccaucuuuuacgccuugagauaucauucaauugugacucuccccagggcucggcgcgccgucgcagcuaucuggguggccaguguggucuucagcacccuguuuauugcguacuaugaucacguugccguguuacugugccucguaguguucuuucuugcaaugcuggucuugauggcugugcuauacguucauaugcuggccagagcuugucagcacgcccaggggaucgcaaggcuccauaaacggcagcgcccugugcaccaaggauucggccugaagggcgccgucacacuuaccauacuguuggggaucuuuuuccucugcuggggaccauuuuuccugcacuuaacucugauugugcuaugucccgagcauccuacaugcgguuguauuuuuaaaaauuucaaccucuuccuggcucuuaucaucugcaaugcgauuauagacccauugaucuaugcauuucacucucaggaacugcgaagaacccucaaggagguacugacgugcuccugguga

SEQ ID NO: 2636 - RNA, 954 nt, Artificial Sequence
  derived and/or modified sequence opt4 from MC1_R__Homo_sapiens__AHC11042
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccugccccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2637 - RNA, 954 nt, Artificial Sequence
  derived and/or modified sequence opt5 from MC1_R__Homo_sapiens__AHC11042
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucugccccuuucugaucugcucgugagcggcuccaauguucuggagacagccgugauccuucugcucgaagcuggggcccuggucgcgcgggccgcugugcugcagcaacucgacaacguuauugaugugauuaccugcagcucuaugcuguccagccuuuguuuccugggagccaucgcugucgaccgcuauaucucuaucuuuuacgcccucagauaucauuccauugugacacugccucgggcgcgcagagccguggcugccaucugggucgcuagcguuguguucucuacccuuuuuauugccuacuaugaucacguggccguccugcucugccuggugguuuucuuucuggcuaugcucgugcugauggcgguccuuuacgugcauaugcuggcccgggcuugucagcacgcccagggcaucgcccgccuccauaaaagacagcggcccguucaccaaggcuucgggcugaagggagcugugacacuuaccauucugcucggcaucuuuuuccugugcugggggcccuuuuuccugcaccucacgcugaucguccuuuguccugagcauccuaccugcggauguauuuuuaaaaauuucaaccuguuccucgcccugaucauuugcaaugcgaucauugacccgcugaucuaugcuuuucacucccaggaacuucgcagaacacucaaggaggugcugaccugcagcugguga

SEQ ID NO: 2638 - protein, 317 aa, Artificial Sequence [sequence omitted]

SEQ ID NO: 2639 - RNA, 954 nt, Artificial Sequence
  MC1_R__Homo_sapiens__AHC10733
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucagccucuuucucgcccucaucaucugcaaugccaucaucgacccccucaucuacgccuuccacagccaggagcuccgcaggacgcucaaggaggugcugacaugcuccugguga

SEQ ID NO: 2640 - RNA, 954 nt, Artificial Sequence
  derived and/or modified sequence opt1 from MC1_R__Homo_sapiens__AHC10733
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucucccuguuccucgcccugaucaucugcaacgccaucaucgacccccugaucuacgccuuccacagccaggagcugcgccggacccucaaggaggugcugaccugcagcugguga

SEQ ID NO: 2641 - RNA, 954 nt, Artificial Sequence
  derived and/or modified sequence opt2 from MC1_R__Homo_sapiens__AHC10733
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucucccucuuccucgcccucaucaucugcaacgccaucaucgacccccucaucuacgccuuccacucccaggagcuccgccgcacccucaaggagguccucaccugcuccugguga

SEQ ID NO: 2642 - RNA, 954 nt, Artificial Sequence
  derived and/or modified sequence opt3 from MC1_R__Homo_sapiens__AHC10733
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucucucucuuccuggcgcuuaucaucugcaacgcaauuauagacccuuugaucuaugccuuucacucccaggaacugcgaagaacccucaaggagguacugacgugcucaugguga

SEQ ID NO: 2643 - RNA, 954 nt, Artificial Sequence
  derived and/or modified sequence opt4 from MC1_R__Homo_sapiens__AHC10733
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucagccuguuccuggcccugaucaucugcaacgccaucaucgacccccugaucuacgccuuccacagccaggagcugagaagaacccugaaggaggugcugaccugcagcugguga

SEQ ID NO: 2644 - RNA, 954 nt, Artificial Sequence
  derived and/or modified sequence opt5 from MC1_R__Homo_sapiens__AHC10733
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucucccuguuccucgcgcugaucauuugcaacgcuaucauugacccccugaucuaugccuuucacagccaggaacuucgcagaacacucaaggaggugcugaccugcuccugguga

SEQ ID NO: 2645 - protein, 317 aa, Artificial Sequence [sequence omitted]

SEQ ID NO: 2646 - RNA, 954 nt, Artificial Sequence
  MC1_R__Homo_sapiens__AHC10696
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucauccacgccuuccacagccaggagcuccgcaggacgcucaaggaggugcugacaugcuccugguga

SEQ ID NO: 2647 - RNA, 954 nt, Artificial Sequence
  derived and/or modified sequence opt1 from MC1_R__Homo_sapiens__AHC10696
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugauccacgccuuccacucccaggagcugcgccggacccucaaggaggugcugaccugcagcugguga

SEQ ID NO: 2648 - RNA, 954 nt, Artificial Sequence
  derived and/or modified sequence opt2 from MC1_R__Homo_sapiens__AHC10696
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucauccacgccuuccacucccaggagcuccgccgcacccucaaggagguccucaccugcuccugguga

SEQ ID NO: 2649 - RNA, 954 nt, Artificial Sequence
  derived and/or modified sequence opt3 from MC1_R__Homo_sapiens__AHC10696
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugauccacgccuuucauucucaggaacugcgaagaacccucaaggagguacugacgugcuccugguga

SEQ ID NO: 2650 - RNA, 954 nt, Artificial Sequence
  derived and/or modified sequence opt4 from MC1_R__Homo_sapiens__AHC10696
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugauccacgccuuccacagccaggagcugagaagaacccugaaggaggugcugaccugcagcugguga

SEQ ID NO: 2651 - RNA, 954 nt, Artificial Sequence
  derived and/or modified sequence opt5 from MC1_R__Homo_sapiens__AHC10696
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugauccacgccuuucauucccaggaacuucgcagaacacucaaggaggugcugaccugcagcugguga

SEQ ID NO: 2652 - protein, 317 aa, Artificial Sequence [sequence omitted]

SEQ ID NO: 2653 - RNA, 954 nt, Artificial Sequence
  MC1_R__Homo_sapiens__AHC09527
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucauccacccccucaucuacgccuuccacagccaggagcuccgcaggacgcucaaggaggugcugacaugcuccugguga

SEQ ID NO: 2654 - RNA, 954 nt, Artificial Sequence
  derived and/or modified sequence opt1 from MC1_R__Homo_sapiens__AHC09527
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucauccacccccugaucuacgccuuccacucccaggagcugcgccggacccucaaggaggugcugaccugcagcugguga

SEQ ID NO: 2655 - RNA, 954 nt, Artificial Sequence
  derived and/or modified sequence opt2 from MC1_R__Homo_sapiens__AHC09527
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucauccacccccucaucuacgccuuccacucccaggagcuccgccgcacccucaaggagguccucaccugcuccugguga

SEQ ID NO: 2656 - RNA, 954 nt, Artificial Sequence
  derived and/or modified sequence opt3 from MC1_R__Homo_sapiens__AHC09527
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauacacccuuugaucuaugccuuucauucucaggaacugcgaagaacccucaaggagguacugacgugcuccugguga

SEQ ID NO: 2657 - RNA, 954 nt, Artificial Sequence
  derived and/or modified sequence opt4 from MC1_R__Homo_sapiens__AHC09527
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucauccacccccugaucuacgccuuccacagccaggagcugagaagaacccugaaggaggugcugaccugcagcugguga

SEQ ID NO: 2658 - RNA, 954 nt, Artificial Sequence
  derived and/or modified sequence opt5 from MC1_R__Homo_sapiens__AHC09527
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauucacccccugaucuaugccuuucauucccaggaacuucgcagaacacucaaggaggugcugaccugcagcugguga

SEQ ID NO: 2659 - protein, 317 aa, Artificial Sequence [sequence omitted]

SEQ ID NO: 2660 - RNA, 954 nt, Artificial Sequence
  MC1_R__Homo_sapiens__AHC10869
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcacccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2661 - RNA, 954 nt, Artificial Sequence
  derived and/or modified sequence opt1 from MC1_R__Homo_sapiens__AHC10869
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcaccccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcggcgcacccucaaggaggugcugaccugcagcugguga

SEQ ID NO: 2662 - RNA, 954 nt, Artificial Sequence
  derived and/or modified sequence opt2 from MC1_R__Homo_sapiens__AHC10869
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcaccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2663 - RNA, 954 nt, Artificial Sequence
  derived and/or modified sequence opt3 from MC1_R__Homo_sapiens__AHC10869
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcaccccgugcaccaaggauucggccugaagggcgcugucacacuuaccauacuguuggggaucuuuuuccucugcuggggaccauuuuuccugcauuuaacucugauugugcuauguccugagcaccccacaugcgguuguauuuuuaaaaauuucaaccucuuccuggcgcuuaucaucugcaaugcaauuauagacccuuugaucuaugccuuucauucucaggaacugcgccgaacccucaaggagguacugacgugcuccugguga

SEQ ID NO: 2664 - RNA, 954 nt, Artificial Sequence
  derived and/or modified sequence opt4 from MC1_R__Homo_sapiens__AHC10869
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagcaccccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2665 - RNA, 954 nt, Artificial Sequence
  derived and/or modified sequence opt5 from MC1_R__Homo_sapiens__AHC10869
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcacccuguucaccaaggcuucgggcugaagggagccgugacacuuaccauucugcucggcaucuuuuuccugugcugggggcccuuuuuccugcaucucacgcugaucguccuuuguccugagcacccuaccugcggauguauuuuuaaaaauuucaaccuguuccucgcgcugaucauuugcaaugcuaucauugacccccugaucuaugccuuucauucccaggaacuucggcgcacacucaaggaggugcugaccugcagcugguga

SEQ ID NO: 2666 - protein, 317 aa, Artificial Sequence [sequence omitted]

SEQ ID NO: 2667 - RNA, 954 nt, Artificial Sequence
  MC1_R__Homo_sapiens__AHC11615
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucacccucaucaucugcaaugccaucaucgacccccucaucuacgccuuccacagccaggagcuccgcaggacgcucaaggaggugcugacaugcuccugguga

SEQ ID NO: 2668 - RNA, 954 nt, Artificial Sequence
  derived and/or modified sequence opt1 from MC1_R__Homo_sapiens__AHC11615
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucacccugaucaucugcaacgccaucaucgacccccugaucuacgccuuccacucccaggagcugcgccggacccucaaggaggugcugacgugcagcugguga

SEQ ID NO: 2669 - RNA, 954 nt, Artificial Sequence
  derived and/or modified sequence opt2 from MC1_R__Homo_sapiens__AHC11615
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucacccucaucaucugcaacgccaucaucgacccccucaucuacgccuuccacucccaggagcuccgccgcacccucaaggagguccucaccugcuccugguga

SEQ ID NO: 2670 - RNA, 954 nt, Artificial Sequence
  derived and/or modified sequence opt3 from MC1_R__Homo_sapiens__AHC11615
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccugacccuuaucaucugcaaugcgauuauagacccuuugaucuaugcauuucacucucaggaacugcgaagaacgcucaaggagguacugacuugcuccugguga

SEQ ID NO: 2671 - RNA, 954 nt, Artificial Sequence
  derived and/or modified sequence opt4 from MC1_R__Homo_sapiens__AHC11615
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccugacccugaucaucugcaacgccaucaucgacccccugaucuacgccuuccacagccaggagcugagaagaacccugaaggaggugcugaccugcagcugguga

SEQ ID NO: 2672 - RNA, 954 nt, Artificial Sequence
  derived and/or modified sequence opt5 from MC1_R__Homo_sapiens__AHC11615
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucacacugaucauuugcaaugcgaucauugacccccugaucuaugcuuuucacucccaggaacuucgcagaacccucaaggaggugcugacaugcagcugguga

SEQ ID NO: 2673 - protein, 317 aa, Artificial Sequence [sequence omitted]

SEQ ID NO: 2674 - RNA, 954 nt, Artificial Sequence
  MC1_R__Homo_sapiens__AHC09535
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccacuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2675 - RNA, 954 nt, Artificial Sequence
  derived and/or modified sequence opt1 from MC1_R__Homo_sapiens__AHC09535
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccacuacaucuccaucuucuacgcccugcgguaccacagcaucgugacccucccccgcgcccggcgcgccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgggccugccagcacgcccagggcaucgcccgccugcacaagcggcagcgccccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcggcgcacccucaaggaggugcugaccugcagcugguga

SEQ ID NO: 2676 - RNA, 954 nt, Artificial Sequence
  derived and/or modified sequence opt2 from MC1_R__Homo_sapiens__AHC09535
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccacuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2677 - RNA, 954 nt, Artificial Sequence
  derived and/or modified sequence opt3 from MC1_R__Homo_sapiens__AHC09535
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccauuauauauccaucuuuuacgcuuugcguuaucacucaauugugacucucccgagagccaggcgggcagucgcugccaucuggguggcgaguguggucuucagcacccuguuuauugccuacuaugaucauguugcaguguuacugugccucguaguguucuuucuugcuaugcuggucuugauggccgugcuauacguucacaugcuggcucgcgccugucagcaugcacaggggaucgccagacuccacaaaaggcagcggcccgugcaccaaggauucggccugaagggcgcugucacacuuaccauacuguuggggaucuuuuuccucugcuggggaccauuuuuccugcauuuaacucugauugugcuauguccugagcaccccacaugcgguuguauuuuuaaaaauuucaaccucuuccuggcgcuuaucaucugcaaugcaauuauagacccuuugaucuaugccuuucauucucaggaacugcgccgaacccucaaggagguacugacgugcuccugguga

SEQ ID NO: 2678 - RNA, 954 nt, Artificial Sequence
  derived and/or modified sequence opt4 from MC1_R__Homo_sapiens__AHC09535
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggaccacuacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2679 - RNA, 954 nt, Artificial Sequence
  derived and/or modified sequence opt5 from MC1_R__Homo_sapiens__AHC09535
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccauuauaucucuaucuuuuacgcgcuccgcuaucacuccauugugacacugcccagagcccggcgcgcuguggccgcuaucugggucgccagcguuguguucucuacccuuuuuauugccuacuaugaucauguggcuguccugcucugccuggugguuuucuuucuggcgaugcucgugcugauggccguccuuuacgugcacaugcuggcuagagccugucagcaugcccagggcaucgcucggcuccacaaacgccagagaccuguucaccaaggcuucgggcugaagggagccgugacacuuaccauucugcucggcaucuuuuuccugugcugggggcccuuuuuccugcaucucacgcugaucguccuuuguccugagcacccuaccugcggauguauuuuuaaaaauuucaaccuguuccucgcgcugaucauuugcaaugcuaucauugacccccugaucuaugccuuucauucccaggaacuucggcgcacacucaaggaggugcugaccugcagcugguga

SEQ ID NO: 2680 - protein, 317 aa, Artificial Sequence [sequence omitted]

SEQ ID NO: 2681 - RNA, 954 nt, Artificial Sequence
  MC1_R__Homo_sapiens__AHC11840
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacaaccaggagcuccgcaggacgcucaaggaggugcugacaugcuccugguga

SEQ ID NO: 2682 - RNA, 954 nt, Artificial Sequence
  derived and/or modified sequence opt1 from MC1_R__Homo_sapiens__AHC11840
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacaaccaggagcugcgccggacccucaaggaggugcugaccugcuccugguga

SEQ ID NO: 2683 - RNA, 954 nt, Artificial Sequence
  derived and/or modified sequence opt2 from MC1_R__Homo_sapiens__AHC11840
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacaaccaggagcuccgccgcacccucaaggagguccucaccugcuccugguga

SEQ ID NO: 2684 - RNA, 954 nt, Artificial Sequence
  derived and/or modified sequence opt3 from MC1_R__Homo_sapiens__AHC11840
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacaaccaggaacugcgaagaacccucaaggagguacugacgugcucuugguga

SEQ ID NO: 2685 - RNA, 954 nt, Artificial Sequence
  derived and/or modified sequence opt4 from MC1_R__Homo_sapiens__AHC11840
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacaaccaggagcugagaagaacccugaaggaggugcugaccugcagcugguga

SEQ ID NO: 2686 - RNA, 954 nt, Artificial Sequence
  derived and/or modified sequence opt5 from MC1_R__Homo_sapiens__AHC11840
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacaaccaggaacuucgcagaacacucaaggaggugcugaccugcuccugguga

SEQ ID NO: 2687 - protein, 317 aa, Artificial Sequence [sequence omitted]

SEQ ID NO: 2688 - RNA, 954 nt, Artificial Sequence
  MC1_R__Homo_sapiens__AHC09665
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacaugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2689 - RNA, 954 nt, Artificial Sequence
  derived and/or modified sequence opt1 from MC1_R__Homo_sapiens__AHC09665
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacaugaucacgugcuccagcaugcuguccagccucugcuuccugggggccaucgcgguggaccgguacaucuccaucuucuacgcccugcgcuaccacagcaucgucacccucccccgggcccgccgggccguggccgcgaucuggguggccuccgucguguucagcacccuguucaucgccuacuacgaccacguggccguccugcucugccuggugguguucuuccuggccaugcucguccugauggcggugcuguacgugcacaugcucgcccgcgccugccagcacgcccagggcaucgcccggcugcacaagcgccagcggcccguccaccagggguucggccugaagggggcggugacccucaccauccugcugggcaucuucuuccucugcuggggcccguucuuccugcaccugacgcucaucguccugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2690 - RNA, 954 nt, Artificial Sequence
  derived and/or modified sequence opt2 from MC1_R__Homo_sapiens__AHC09665
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacaugaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2691 - RNA, 954 nt, Artificial Sequence
  derived and/or modified sequence opt3 from MC1_R__Homo_sapiens__AHC09665
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauaugauuacaugcaguuccaugcugucuagccuuuguuuccugggugcaaucgccguagaccguuauauauccaucuuuuacgcuuugagauaucauucaauuguuacucucccgagggcccggcgcgcaguggcugccaucugggucgcgagugugguguucagcacccuguuuauugccuacuaugaucacgucgcaguuuuacugugccucgugguauucuuucuugcuaugcugguguugauggccguccuauacgugcauaugcuggcuagagccugucagcacgcacaggggaucgccaggcuccauaaacggcagcgccccguucaccaaggauucggccugaagggcgcugugacacuuaccauacuguuggggaucuuuuuccucugcuggggaccauuuuuccugcacuuaacucugauuguccuauguccugagcaucccacaugcgguuguauuuuuaaaaauuucaaccucuuccuggcgcuuaucaucugcaaugcaauuauagacccuuugaucuaugccuuucacucucaggaacugcgaagaacccucaaggaggugcugacgugcuccugguga

SEQ ID NO: 2692 - RNA, 954 nt, Artificial Sequence
  derived and/or modified sequence opt4 from MC1_R__Homo_sapiens__AHC09665
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacaugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2693 - RNA, 954 nt, Artificial Sequence
  derived and/or modified sequence opt5 from MC1_R__Homo_sapiens__AHC09665
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugauaugauuaccugcagcucuaugcuguccagccuuuguuuccugggagcuaucgccguggaccgcuauaucucuaucuuuuacgcgcucagauaucauuccauugucacacugccccgggcccgcagagcuguggccgcuaucuggguggccagcgucguuuucucuacccuuuuuauugccuacuaugaucacguggcugugcugcucugccuggucguguucuuucuggcgaugcucguucugauggccgugcuuuacguccauaugcuggcucgggccugucagcacgcccagggcaucgcucgccuccauaaaagacagcggccugugcaccaaggcuucgggcugaagggagccguuacacuuaccauucugcucggcaucuuuuuccugugcugggggcccuuuuuccugcaccucacgcugaucgugcuuuguccugagcauccuaccugcggauguauuuuuaaaaauuucaaccuguuccucgcgcugaucauuugcaaugcuaucauugacccccugaucuaugccuuucacucccaggaacuucgcagaacacucaaggagguccugaccugcagcugguga

SEQ ID NO: 2694 - protein, 317 aa, Artificial Sequence [sequence omitted]

SEQ ID NO: 2695 - RNA, 954 nt, Artificial Sequence
  MC1_R__Homo_sapiens__AHC11324
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucauccgcaaugccaucaucgacccccucaucuacgccuuccacagccaggagcuccgcaggacgcucaaggaggugcugacaugcuccugguga

SEQ ID NO: 2696 - RNA, 954 nt, Artificial Sequence
  derived and/or modified sequence opt1 from MC1_R__Homo_sapiens__AHC11324
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucauccgcaacgccaucaucgacccccugaucuacgccuuccacucccaggagcugcggcgcacccucaaggaggugcugaccugcagcugguga

SEQ ID NO: 2697 - RNA, 954 nt, Artificial Sequence
  derived and/or modified sequence opt2 from MC1_R__Homo_sapiens__AHC11324
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucauccgcaacgccaucaucgacccccucaucuacgccuuccacucccaggagcuccgccgcacccucaaggagguccucaccugcuccugguga

SEQ ID NO: 2698 - RNA, 954 nt, Artificial Sequence
  derived and/or modified sequence opt3 from MC1_R__Homo_sapiens__AHC11324
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucauccgaaaugcaauuauagacccuuugaucuaugccuuucacucucaggaacugagaaggacccucaaggagguacugacgugcuccugguga

SEQ ID NO: 2699 - RNA, 954 nt, Artificial Sequence
  derived and/or modified sequence opt4 from MC1_R__Homo_sapiens__AHC11324
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucagaaacgccaucaucgacccccugaucuacgccuuccacagccaggagcugagaagaacccugaaggaggugcugaccugcagcugguga

SEQ ID NO: 2700 - RNA, 954 nt, Artificial Sequence
  derived and/or modified sequence opt5 from MC1_R__Homo_sapiens__AHC11324
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauucgcaaugcuaucauugacccccugaucuaugccuuucacucccaggaacuuagacggacacucaaggaggugcugaccugcagcugguga

SEQ ID NO: 2701 - protein, 317 aa, Artificial Sequence [sequence omitted]

SEQ ID NO: 2702 - RNA, 954 nt, Artificial Sequence
  MC1_R__Homo_sapiens__AHC09521
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgugggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2703 - RNA, 954 nt, Artificial Sequence
  derived and/or modified sequence opt1 from MC1_R__Homo_sapiens__AHC09521
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccuccccugggcccggcgcgccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgggccugccagcacgcccagggcaucgcccgccugcacaagcggcagcgccccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcggcgcacccucaaggaggugcugaccugcagcugguga

SEQ ID NO: 2704 - RNA, 954 nt, Artificial Sequence
  derived and/or modified sequence opt2 from MC1_R__Homo_sapiens__AHC09521
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccuccccugggcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2705 - RNA, 954 nt, Artificial Sequence
  derived and/or modified sequence opt3 from MC1_R__Homo_sapiens__AHC09521
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgugggccaggcgggcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcucgcgccugucagcacgcacaggggaucgccagacuccauaaaaggcagcggcccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacucucaggaacugcgccgaacccucaaggagguacugacgugcuccugguga

SEQ ID NO: 2706 - RNA, 954 nt, Artificial Sequence
  derived and/or modified sequence opt4 from MC1_R__Homo_sapiens__AHC09521
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccugggccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2707 - RNA, 954 nt, Artificial Sequence
  derived and/or modified sequence opt5 from MC1_R__Homo_sapiens__AHC09521
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugcccugggcccggcgcgcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcuagagccugucagcacgcccagggcaucgcucggcuccauaaacgccagagaccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacucccaggaacuucggcgcacacucaaggaggugcugaccugcagcugguga

SEQ ID NO: 2708 - protein, 317 aa, Artificial Sequence [sequence omitted]

SEQ ID NO: 2709 - RNA, 954 nt, Artificial Sequence
  MC1_R__Homo_sapiens__AHC11794
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccgagugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2710 - RNA, 954 nt, Artificial Sequence
  derived and/or modified sequence opt1 from MC1_R__Homo_sapiens__AHC11794
auggccgugcagggcagccagcgccggcugcucgggucccugaacagcacccccaccgccaucccgcagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcaccccgagugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2711 - RNA, 954 nt, Artificial Sequence
  derived and/or modified sequence opt2 from MC1_R__Homo_sapiens__AHC11794
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccgagugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2712 - RNA, 954 nt, Artificial Sequence
  derived and/or modified sequence opt3 from MC1_R__Homo_sapiens__AHC11794
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccgaaugcgguuguauuuuuaaaaauuucaaccucuuccuggcgcuuaucaucugcaaugcaauuauagacccuuugaucuaugccuuucacucucaggagcugcgaagaacacucaaggagguacugaccugcuccugguga

SEQ ID NO: 2713 - RNA, 954 nt, Artificial Sequence
  derived and/or modified sequence opt4 from MC1_R__Homo_sapiens__AHC11794
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccgagugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2714 - RNA, 954 nt, Artificial Sequence
  derived and/or modified sequence opt5 from MC1_R__Homo_sapiens__AHC11794
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcaucccgaaugcggauguauuuuuaaaaauuucaaccuguuccucgcgcugaucauuugcaaugcuaucauugacccucugaucuaugccuuucacucccaggagcuucgcagaacccucaaggaggugcugacaugcagcugguga

SEQ ID NO: 2715 - protein, 317 aa, Artificial Sequence [sequence omitted]

SEQ ID NO: 2716 - RNA, 954 nt, Artificial Sequence
  MC1_R__Homo_sapiens__AHC10874
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaacugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugcgcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2717 - RNA, 954 nt, Artificial Sequence
  derived and/or modified sequence opt1 from MC1_R__Homo_sapiens__AHC10874
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgagcugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 2718 - RNA, 954 nt, Artificial Sequence
  derived and/or modified sequence opt2 from MC1_R__Homo_sapiens__AHC10874
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgagcuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2719 - RNA, 954 nt, Artificial Sequence
  derived and/or modified sequence opt3 from MC1_R__Homo_sapiens__AHC10874
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggagcugcucgucucaggaagcaauguguuagaaaccgcuguuauucugcuuuuggaggcaggcgcccugguggcucgagccgcgguccuacagcaacucgauaacgugaucgacguaauuacaugcaguuccaugcugucuagccuuuguuuccugggugcaaucgccguugaucguuauauauccaucuuuuacgcuuugagauaucauucaauugugacucucccgagggcccggcgcgcagucgcugccaucuggguggcgaguguggucuucagcacccuguuuauugccuacuaugaccacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugaacaucccacaugcgguuguauuuuuaaaaauuucaaccucuuccuggcgcuuaucaucugcaaugcaauuauagauccuuugaucuaugccuuucacucucaggagcugcgaagaacccucaaggagguacugacgugcuccugguga

SEQ ID NO: 2720 - RNA, 954 nt, Artificial Sequence
  derived and/or modified sequence opt4 from MC1_R__Homo_sapiens__AHC10874
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgagcugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2721 - RNA, 954 nt, Artificial Sequence
  derived and/or modified sequence opt5 from MC1_R__Homo_sapiens__AHC10874
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugagcugcucgugagcggcuccaauguucuggaaacagcugugauccuucugcucgaggccggggcgcuggucgcccgggcugccgugcugcagcaacucgauaacguuauugacgugauuaccugcagcucuaugcuguccagccuuuguuuccugggagcuaucgccgucgaucgcuauaucucuaucuuuuacgcgcucagauaucauuccauugugacacugccccgggcccgcagagcuguggccgcuaucugggucgccagcguuguguucucuacccuuuuuauugccuacuaugaccacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugaacauccuaccugcggauguauuuuuaaaaauuucaaccuguuccucgcgcugaucauuugcaaugcuaucauugauccccugaucuaugccuuucacucccaggagcuucgcagaacacucaaggaggugcugaccugcagcugguga

SEQ ID NO: 2722 - protein, 317 aa, Artificial Sequence [sequence omitted]

SEQ ID NO: 2723 - RNA, 954 nt, Artificial Sequence
  MC1_R__Homo_sapiens__AHC09597
auggcugugcagggaucccagagaagacuucugggcucccucaacuccacccccacagccaucccccagcuggggcuggcugccaaccagacaggagcccggugccuggagguguccaucucugacgggcucuuccucagccuggggcuggugagcuugguggagaacgcgcuggugguggccaccaucgccaagaaccggaaccugcacucacccauguacugcuucaucugcugccuggccuugucggaccugcuggugagcgggagcaacgugcuggagacggccgucauccuccugcuggaggccggugcacugguggcccgggcugcggugcugcagcagcuggacaaugucauugacgugaucaccugcagcuccaugcuguccagccucugcuuccugggcgccaucgccguggaccgcuacaucuccaucuucuacgcacugugcuaccacagcaucgugacccugccgcgggcgcggcgagccguugcggccaucuggguggccagugucgucuucagcacgcucuucaucgccuacuacgaccacguggccguccugcugugccucguggucuucuuccuggcuaugcuggugcucauggccgugcuguacguccacaugcuggcccgggccugccagcacgcccagggcaucgcccggcuccacaagaggcagcgcccgguccaccagggcuuuggccuuaaaggcgcugucacccucaccauccugcugggcauuuucuuccucugcuggggccccuucuuccugcaucucacacucaucguccucugccccgagcaccccacgugcggcugcaucuucaagaacuucaaccucuuucucgcccucaucaucugcaaugccaucaucgacccccucaucuacgccuuccacagccaggagcuccgcaggacgcucaaggaggugcugacaugcuccugguga

SEQ ID NO: 2724 - RNA, 954 nt, Artificial Sequence
  derived and/or modified sequence opt1 from MC1_R__Homo_sapiens__AHC09597
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugugcuaccacagcaucgugacccucccccgcgcccggcgcgccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgggccugccagcacgcccagggcaucgcccgccugcacaagcggcagcgccccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcggcgcacccucaaggaggugcugaccugcagcugguga

SEQ ID NO: 2725 - RNA, 954 nt, Artificial Sequence
  derived and/or modified sequence opt2 from MC1_R__Homo_sapiens__AHC09597
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccucugcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 2726 - RNA, 954 nt, Artificial Sequence
  derived and/or modified sequence opt3 from MC1_R__Homo_sapiens__AHC09597
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugugcuaucauucaauugugacucucccgagagccaggcgggcagucgcugccaucuggguggcgaguguggucuucagcacccuguuuauugccuacuaugaucacguugcaguguuacugugucucguaguguucuuucuugcuaugcuggucuugauggccgugcuauacguucauaugcuggcucgcgccugccagcacgcacaggggaucgccagacuccauaaaaggcagcggcccgugcaccaaggauucggccugaagggcgcugucacacuuaccauacuguuggggaucuuuuuccucuguuggggaccauuuuuccugcacuuaacucugauugugcuaugcccugagcaucccacaugugguugcauuuuuaaaaauuucaaccucuuccuggcgcuuaucaucugcaaugcaauuauagacccuuugaucuaugccuuucacucucaggaacugcgccgaacccucaaggagguacugacguguuccugguga

SEQ ID NO: 2727 - RNA, 954 nt, Artificial Sequence
  derived and/or modified sequence opt4 from MC1_R__Homo_sapiens__AHC09597
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugugcuaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguga

SEQ ID NO: 2728 - RNA, 954 nt, Artificial Sequence
  derived and/or modified sequence opt5 from MC1_R__Homo_sapiens__AHC09597
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucugcuaucauuccauugugacacugcccagagcccggcgcgcuguggccgcuaucugggucgccagcguuguguucucuacccuuuuuauugccuacuaugaucacguggcuguccugcucugucuggugguuuucuuucuggcgaugcucgugcugauggccguccuuuacgugcauaugcuggcuagagccugccagcacgcccagggcaucgcucggcuccauaaacgccagagaccuguucaccaaggcuucgggcugaagggagccgugacacuuaccauucugcucggcaucuuuuuccuguguugggggcccuuuuuccugcaccucacgcugaucguccuuugcccugagcaucccaccuguggaugcauuuuuaaaaauuucaaccuguuccucgcgcugaucauuugcaaugcuaucauugacccucugaucuaugccuuucacucccaggaacuucggcgcacacucaaggaggugcugaccuguagcugguga

SEQ ID NO: 2729 - protein, 630 aa, Artificial Sequence
  mesothelin__Homo_sapiens__Q13421
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 2730 - RNA, 1893 nt, Artificial Sequence
  mesothelin__Homo_sapiens__EAW85719
auggccuugccaacggcucgaccccuguugggguccugugggacccccgcccucggcagccuccuguuccugcucuucagccucggaugggugcagcccucgaggacccuggcuggagagacagggcaggaggcugcgccccuggacggaguccuggccaacccaccuaacauuuccagccucuccccucgccaacuccuuggcuucccgugugcggagguguccggccugagcacggagcguguccgggagcuggcuguggccuuggcacagaagaaugucaagcucucaacagagcagcugcgcugucuggcucaccggcucucugagccccccgaggaccuggacgcccucccauuggaccugcugcuauuccucaacccagaugcguucucggggccccaggccugcacccguuucuucucccgcaucacgaaggccaauguggaccugcucccgaggggggcucccgagcgacagcggcugcugccugcggcucuggccugcuggggugugcgggggucucugcugagcgaggcugaugugcgggcucugggaggccuggcuugcgaccugccugggcgcuuuguggccgagucggccgaagugcugcuaccccggcuggugagcugcccgggaccccuggaccaggaccagcaggaggcagccagggcggcucugcagggcgggggaccccccuacggccccccgucgacauggucugucuccacgauggacgcucugcggggccugcugcccgugcugggccagcccaucauccgcagcaucccgcagggcaucguggccgcguggcggcaacgcuccucucgggacccauccuggcggcagccugaacggaccauccuccggccgcgguuccggcgggaaguggagaagacagccuguccuucaggcaagaaggcccgcgagauagacgagagccucaucuucuacaagaagugggagcuggaagccugcguggaugcggcccugcuggccacccagauggaccgcgugaacgccauccccuucaccuacgagcagcuggacguccuaaagcauaaacuggaugagcucuacccacaagguuaccccgagucugugauccagcaccugggcuaccucuuccucaagaugagcccugaggacauucgcaaguggaaugugacgucccuggagacccugaaggcuuugcuugaagucaacaaagggcacgaaaugaguccucaggcuccucggcggccccucccacagguggccacccugaucgaccgcuuugugaagggaaggggccagcuagacaaagacacccuagacacccugaccgccuucuacccuggguaccugugcucccucagccccgaggagcugagcuccgugccccccagcagcaucugggcggucaggccccaggaccuggacacgugugacccaaggcagcuggacguccucuaucccaaggcccgccuugcuuuccagaacaugaacggguccgaauacuucgugaagauccaguccuuccuggguggggcccccacggaggauuugaaggcgcucagucagcagaaugugagcauggacuuggccacguucaugaagcugcggacggaugcggugcugccguugacuguggcugaggugcagaaacuucugggaccccacguggagggccugaaggcggaggagcggcaccgcccggugcgggacuggauccuacggcagcggcaggacgaccuggacacgcuggggcuggggcuacagggcggcauccccaacggcuaccugguccuagaccucagcaugcaagaggcccucucggggacgcccugccuccuaggaccuggaccuguucucaccguccuggcacugcuccuagccuccacccuggccuga

SEQ ID NO: 2731 - RNA, 1893 nt, Artificial Sequence
  derived and/or modified sequence opt1 from mesothelin__Homo_sapiens__EAW85719
auggcccugcccaccgcccgcccgcuccugggcagcugcgggacccccgcgcugggcucccuccuguuccuccuguucagccuggggugggugcagcccucccggacgcuggccggcgagaccgggcaggaggccgcgccccucgacggcguccuggccaacccgcccaacaucagcucccugagcccccgccagcuccugggcuuccccugcgccgagguguccgggcugagcaccgagcgggugcgcgagcucgccgucgcccuggcccagaagaacgugaagcuguccaccgagcagcuccggugccuggcgcaccgccugagcgagccgcccgaggaccucgacgcccugccccuggaccuccugcuguuccucaaccccgacgccuucuccggcccgcaggccugcacgcgguucuucagccgcaucaccaaggccaacguggaccugcugccccgcggggcgcccgagcggcagcggcuccugcccgccgcccuggccugcuggggcguccgcgggucccuccugagcgaggccgacgugcgggcgcugggcggccucgccugcgaccugccggggcgcuucguggccgaguccgccgagguccugcucccccggcuggugagcugccccggcccccuggaccaggaccagcaggaggccgcgcgcgccgcccuccagggcgggggcccgcccuacgggccgcccuccaccuggagcguguccaccauggacgcccugcggggccugcuccccguccuggggcagcccaucauccgcagcaucccccagggcaucguggccgcguggcggcagcgcagcucccgggaccccagcuggcgccagccggagcgcacgauccugcggccccgcuuccggcgcgagguggagaagaccgccugccccuccgggaagaaggcccgggagaucgacgagagccucaucuucuacaagaagugggagcuggaggccugcgucgacgcggcccugcuggccacccagauggaccgcgugaacgccaucccguucaccuacgagcagcucgacgugcugaagcacaagcuggacgagcucuacccccagggcuaccccgaguccgucauccagcaccugggcuaccuguuccucaagaugagccccgaggacauccggaaguggaacgugacgucccuggagacccugaaggcccuccuggaggugaacaaggggcacgagaugagcccgcaggcgccccgccggccccugccccaggucgccacccucaucgaccgcuucgugaagggccgggggcagcuggacaaggacacccuggacacgcucaccgccuucuacccgggcuaccugugcucccugagccccgaggagcucuccagcgugccgcccuccagcaucugggccguccgcccccaggaccuggacacgugcgacccccggcagcuggacgugcucuaccccaaggcccgccuggcguuccagaacaugaacggguccgaguacuucgucaagauccagagcuuccugggcggcgcccccaccgaggaccucaaggcccugucccagcagaacgugagcauggaccuggccaccuucaugaagcuccggaccgacgccgugcugccgcugaccgucgcggaggugcagaagcuccuggggccccacguggagggccugaaggccgaggagcgccaccggcccguccgcgacuggauccuccggcagcgccaggacgaccuggacacccuggggcucggccugcagggcgggauccccaacggcuaccuggugcucgaccuguccaugcaggaggcccugagcgggacgccgugccuccugggccccgggcccgugcugaccguccucgcccugcugcucgcgagcacccuggccuga

SEQ ID NO: 2732 - RNA, 1893 nt, Artificial Sequence
  derived and/or modified sequence opt2 from mesothelin__Homo_sapiens__EAW85719
auggcccuccccaccgcccgcccccuccucggcuccugcggcacccccgcccucggcucccuccucuuccuccucuucucccucggcuggguccagcccucccgcacccucgccggcgagaccggccaggaggccgccccccucgacggcguccucgccaacccccccaacaucuccucccucuccccccgccagcuccucggcuuccccugcgccgaggucuccggccucuccaccgagcgcguccgcgagcucgccgucgcccucgcccagaagaacgucaagcucuccaccgagcagcuccgcugccucgcccaccgccucuccgagccccccgaggaccucgacgcccucccccucgaccuccuccucuuccucaaccccgacgccuucuccggcccccaggccugcacccgcuucuucucccgcaucaccaaggccaacgucgaccuccucccccgcggcgcccccgagcgccagcgccuccuccccgccgcccucgccugcuggggcguccgcggcucccuccucuccgaggccgacguccgcgcccucggcggccucgccugcgaccuccccggccgcuucgucgccgaguccgccgagguccuccucccccgccucgucuccugccccggcccccucgaccaggaccagcaggaggccgcccgcgccgcccuccagggcggcggcccccccuacggcccccccuccaccugguccgucuccaccauggacgcccuccgcggccuccuccccguccucggccagcccaucauccgcuccaucccccagggcaucgucgccgccuggcgccagcgcuccucccgcgaccccuccuggcgccagcccgagcgcaccauccuccgcccccgcuuccgccgcgaggucgagaagaccgccugccccuccggcaagaaggcccgcgagaucgacgagucccucaucuucuacaagaagugggagcucgaggccugcgucgacgccgcccuccucgccacccagauggaccgcgucaacgccauccccuucaccuacgagcagcucgacguccucaagcacaagcucgacgagcucuacccccagggcuaccccgaguccgucauccagcaccucggcuaccucuuccucaagaugucccccgaggacauccgcaaguggaacgucaccucccucgagacccucaaggcccuccucgaggucaacaagggccacgagauguccccccaggccccccgccgcccccucccccaggucgccacccucaucgaccgcuucgucaagggccgcggccagcucgacaaggacacccucgacacccucaccgccuucuaccccggcuaccucugcucccucucccccgaggagcucuccuccgucccccccuccuccaucugggccguccgcccccaggaccucgacaccugcgacccccgccagcucgacguccucuaccccaaggcccgccucgccuuccagaacaugaacggcuccgaguacuucgucaagauccaguccuuccucggcggcgcccccaccgaggaccucaaggcccucucccagcagaacgucuccauggaccucgccaccuucaugaagcuccgcaccgacgccguccucccccucaccgucgccgagguccagaagcuccucggcccccacgucgagggccucaaggccgaggagcgccaccgccccguccgcgacuggauccuccgccagcgccaggacgaccucgacacccucggccucggccuccagggcggcauccccaacggcuaccucguccucgaccucuccaugcaggaggcccucuccggcacccccugccuccucggccccggccccguccucaccguccucgcccuccuccucgccuccacccucgccuga

SEQ ID NO: 2733 - RNA, 1893 nt, Artificial Sequence
  derived and/or modified sequence opt3 from mesothelin__Homo_sapiens__EAW85719
auggcccugcccaccgcuagaccucuccuuggcagcugcgggacaccagcacugggauccuuguuauuccugcuauuuucucucgguugggugcagccgucaaggacucuggccggcgagacggggcaagaagcggcuccccuugacggaguccuggccaacccuccaaauaucaguagcuugucuccccggcagcuccugggcuucccuugugcagagguuuccggucugucgaccgaacgcgugcgagagcucgccguagcuuuagcacagaagaacgugaaacugucaacagaacagcuucguugcuuggcccacagacugagcgagccacccgaggaucuagacgcucucccucuggaucuucuguuguuucucaauccagacgccuucagugggccgcaagcguguacuagguuuuucucccggauuaccaaggcaaacgucgaucuguuaccccgcggagccccugaaagacagaggcugcucccagcugcccuugcaugcuggggcgugcggggcucucuguugagcgaggcugacguucgcgcccuagggggacuggcgugugaucuccccggucgauuuguggccgaauccgcagagguccugcuuccuagacuggugucaugcccaggccccuuggaccaggaucagcaagaggcugccagggcugcccuccaagggggaggcccgccuuacggucccccaaguacauggagcguaucuaccauggacgcacugcggggguuacugccuguucuaggacagcccauaauccguuccauuccacagggcaucguggccgcuuggcgccagagaucaagcagggaucccaguuggcggcagccugaacgaacuauucuccgcccaagauucaggcgggaggucgaaaagacagcguguccgucuggcaagaaagcacgcgagaucgacgaaucccugauauuuuauaagaagugggagcuugaggccugcguggaugcugccuugcuggcaacccagauggacagagugaaugccauccccuucacguacgaacaacucgacguccugaaacauaaacuugaugagcuguauccucagggguacccagaaagcguuauucagcacuugggauaucucuuucugaaaaugucgcccgaggacaucaggaaguggaacgugacuucuuuagaaacccugaaagcucuacucgagguaaauaagggucaugagauguccccucaggccccacgucggccccugccgcaaguggcaacacuuauugaucgauucgucaagggcagagggcaguuggacaaagauacucuggacacccucacagcguuuuacccuggauaucuguguucauuaaguccagaggaacugagcuccgugcccccuucuagcaucugggcuguuaggccccaggaucuugauaccugcgacccacgccaguuggacgugcucuacccuaaggcccggcuggcauuccaaaacaugaauggcucagaauacuucgucaaaauacagaguuuucuagguggggcccccacggaggaucugaaggcucucucccagcagaacgugagcauggaccuggccacuuucaugaaacuuagaacagacgcaguauugccacugaccguugcugaagugcaaaaguuacucggcccgcacgucgagggacugaaagccgaggaaaggcaucgcccugugcgagauuggauucuucggcagcgucaggacgaucuggacacuuugggccucgggcugcagggagguauccccaauggcuaucuaguccuggaucucucuaugcaagaggcgcugucagggacaccaugucuuuugggacccggcccugugcugaccguuuuagcccuccugcuugcuaguacgcuggcauga

SEQ ID NO: 2734 - RNA, 1893 nt, Artificial Sequence
  derived and/or modified sequence opt4 from mesothelin__Homo_sapiens__EAW85719
auggcccugcccaccgccagaccccugcugggcagcugcggcacccccgcccugggcagccugcuguuccugcuguucagccugggcugggugcagcccagcagaacccuggccggcgagaccggccaggaggccgccccccuggacggcgugcuggccaacccccccaacaucagcagccugagccccagacagcugcugggcuuccccugcgccgaggugagcggccugagcaccgagagagugagagagcuggccguggcccuggcccagaagaacgugaagcugagcaccgagcagcugagaugccuggcccacagacugagcgagccccccgaggaccuggacgcccugccccuggaccugcugcuguuccugaaccccgacgccuucagcggcccccaggccugcaccagauucuucagcagaaucaccaaggccaacguggaccugcugcccagaggcgcccccgagagacagagacugcugcccgccgcccuggccugcuggggcgugagaggcagccugcugagcgaggccgacgugagagcccugggcggccuggccugcgaccugcccggcagauucguggccgagagcgccgaggugcugcugcccagacuggugagcugccccggcccccuggaccaggaccagcaggaggccgccagagccgcccugcagggcggcggcccccccuacggcccccccagcaccuggagcgugagcaccauggacgcccugagaggccugcugcccgugcugggccagcccaucaucagaagcaucccccagggcaucguggccgccuggagacagagaagcagcagagaccccagcuggagacagcccgagagaaccauccugagacccagauucagaagagagguggagaagaccgccugccccagcggcaagaaggccagagagaucgacgagagccugaucuucuacaagaagugggagcuggaggccugcguggacgccgcccugcuggccacccagauggacagagugaacgccauccccuucaccuacgagcagcuggacgugcugaagcacaagcuggacgagcuguacccccagggcuaccccgagagcgugauccagcaccugggcuaccuguuccugaagaugagccccgaggacaucagaaaguggaacgugaccagccuggagacccugaaggcccugcuggaggugaacaagggccacgagaugagcccccaggcccccagaagaccccugccccagguggccacccugaucgacagauucgugaagggcagaggccagcuggacaaggacacccuggacacccugaccgccuucuaccccggcuaccugugcagccugagccccgaggagcugagcagcgugccccccagcagcaucugggccgugagaccccaggaccuggacaccugcgaccccagacagcuggacgugcuguaccccaaggccagacuggccuuccagaacaugaacggcagcgaguacuucgugaagauccagagcuuccugggcggcgcccccaccgaggaccugaaggcccugagccagcagaacgugagcauggaccuggccaccuucaugaagcugagaaccgacgccgugcugccccugaccguggccgaggugcagaagcugcugggcccccacguggagggccugaaggccgaggagagacacagacccgugagagacuggauccugagacagagacaggacgaccuggacacccugggccugggccugcagggcggcauccccaacggcuaccuggugcuggaccugagcaugcaggaggcccugagcggcacccccugccugcugggccccggccccgugcugaccgugcuggcccugcugcuggccagcacccuggccuga

SEQ ID NO: 2735 - RNA, 1893 nt, Artificial Sequence
  derived and/or modified sequence opt5 from mesothelin__Homo_sapiens__EAW85719
auggcccugcccaccgcuagaccucuccugggcagcugcgggacaccggcccuuggaucccuucucuuccugcuguuuucucugggcugggugcagcccagccggacgcucgcgggggagaccggacaagaagcugccccucuggacggcguccuggccaaucccccuaacaucuccucucucagcccccgccagcugcuuggguucccuugugcugagguuuccggacugucuacagaaagagugcgggagcucgccguggcucuggcccagaagaacgucaaacuuagcaccgaacagcugcgcugccucgcgcacagacuguccgagccgcccgaggaucuggacgcccucccucuggaucuucugcucuuucugaaucccgacgcuuucagcggcccucaagccuguacacgguuuuucucucgcauuaccaaggcuaacguggaucuucugcccagaggcgccccggaacggcagcgccuccugccugcggcccuggcuugcuggggcguuagaggaucccuccugagcgaggccgacgugcgggcucuuggcgggcuggccugugaucuccccggacgcuuugucgccgaaucugcugaggugcugcuuccuagacugguuuccugccccggcccccucgaccaggaucagcaagaggcggcccgggcugcccugcaagggggaggcccuccguacgggcccccuagcacauggucuguguccaccauggacgcccugcgcgggcuccugcccguccuuggacagccuaucauuagaagcaucccccagggcauuguggcugccuggcggcagagauccucucgcgauccgagcuggcggcagccugaaagaacgauccugcgcccccgguucagacgcgagguggagaaaaccgcguguccuuccgggaagaaagcucgggagaucgacgaaagccucaucuuuuauaagaagugggagcuggaggccugcgucgaugccgcucugcuugccacacagauggacagaguuaaugcuauucccuucaccuacgaacaacucgacgugcugaaacauaagcuggaugagcucuauccucagggauaccccgaaucugugauucagcaccugggcuaucuuuuucugaaaauguccccggaggacauccgcaaguggaacgucacaagccucgaaacccugaaagcccugcuugaggugaauaaggggcaugagaugucuccucaggcgccccggagaccccucccucaaguugccacgcugauugaucgcuucgugaagggacggggccagcuggacaaagauacacucgacacccugacagcuuuuuacccgggcuaucuuuguagccugucccccgaagaacucucuagcgucccucccuccagcaucugggccgugagaccucaggaucuggauaccugcgacccccggcagcuggacguucuuuacccuaaggcucgccucgccuuccaaaacaugaaugggucugaauacuucgugaaaauucaguccuuucugggaggcgcgcccaccgaggaucugaaggcccucagccagcagaacgucucuauggaccuggcuacauucaugaaacuuagaacggacgccgugcugccgcucaccgucgcugaagugcaaaagcugcuggggccucacguugagggacuuaaagccgaggaacggcauagacccgugcgcgauuggauccuccggcagagacaggacgaucuggacacacugggccucgggcugcagggcggaaucccuaauggcuaucuuguccuggaucucuccaugcaagaggcccugagcgggacccccugucugcuuggaccgggcccugugcugacaguucucgcucugcuccuggcguccacccuugccuga

SEQ ID NO: 2736 - protein, 504 aa, Artificial Sequence
  MITF__Homo_sapiens__O75030-8
MEALRVQMFMPCSFESLYLSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 2737 - RNA, 1515 nt, Artificial Sequence
  MITF__Homo_sapiens__CCDS46865.1
auggaggcgcuuagaguucagauguucaugccaugcuccuuugaaagcuuguaucucaguuccgccgagcauccuggggccuccaagccuccgauaagcuccuccaguaugacaucacgcaucuugcuacgccagcaacucaugcgugagcagaugcaggagcaggagcgcagggagcagcagcagaagcugcaggcggcccaguucaugcaacagagagugcccgugagucagacaccagccauaaacgucagugugcccaccacccuucccucugccacgcaggugccgauggaaguccuuaaggugcagacccaccucgaaaaccccaccaaguaccacauacagcaagcccaacggcagcagguaaagcaguaccuuucuaccacuuuagcaaauaaacaugccaaccaaguccugagcuugccauguccaaaccagccuggcgaucaugucaugccaccggugccggggagcagcgcacccaacagccccauggcuaugcuuacgcuuaacuccaacugugaaaaagagggauuuuauaaguuugaagagcaaaacagggcagagagcgagugcccaggcaugaacacacauucacgagcguccuguaugcagauggaugauguaaucgaugacaucauuagccuagaaucaaguuauaaugaggaaaucuugggcuugauggauccugcuuugcaaauggcaaauacguugccugucucgggaaacuugauugaucuuuauggaaaccaaggucugcccccaccaggccucaccaucagcaacuccuguccagccaaccuucccaacauaaaaagggagcucacagagucugaagcaagagcacuggccaaagagaggcagaaaaaggacaaucacaaccugauugaacgaagaagaagauuuaacauaaaugaccgcauuaaagaacuagguacuuugauucccaagucaaaugauccagacaugcgcuggaacaagggaaccaucuuaaaagcauccguggacuauauccgaaaguugcaacgagaacagcaacgcgcaaaagaacuugaaaaccgacagaagaaacuggagcacgccaaccggcauuuguugcucagaauacaggaacuugaaaugcaggcucgagcucauggacuuucccuuauuccauccacgggucucugcucuccagauuuggugaaucggaucaucaagcaagaacccguucuugagaacugcagccaagaccuccuucagcaucaugcagaccuaaccuguacaacaacucucgaucucacggauggcaccaucaccuucaacaacaaccucggaacugggacugaggccaaccaagccuauaguguccccacaaaaaugggauccaaacuggaagacauccugauggacgacacccuuucucccgucggugucacugauccacuccuuuccucagugucccccggagcuuccaaaacaagcagccggaggagcaguaugagcauggaagagacggagcacacuuguuag

SEQ ID NO: 2738 - RNA, 1515 nt, Artificial Sequence
  derived and/or modified sequence opt1 from MITF__Homo_sapiens__CCDS46865.1
auggaggcccugcgcgugcagauguucaugcccugcagcuucgagucccucuaccugagcuccgccgagcacccgggcgcgagcaagccgcccaucuccagcuccagcaugaccucccggauccugcuccgccagcagcugaugcgggagcagaugcaggagcaggagcgccgggagcagcagcagaagcugcaggccgcccaguucaugcagcagcgcguccccgugagccagacccccgccaucaacguguccguccccaccacccuccccagcgccacccaggugcccauggaggugcugaagguccagacccaccuggagaacccgacgaaguaccacauccagcaggcgcagcggcagcaggucaagcaguaccucuccaccacccuggccaacaagcacgccaaccaggugcugagccuccccugccccaaccagcccggggaccacgugaugccgcccgugcccggcuccagcgcccccaacuccccgauggcgaugcugacccugaacagcaacugcgagaaggagggguucuacaaguucgaggagcagaaccgcgccgaguccgagugccccggcaugaacacgcacagccgggccagcugcaugcagauggacgacgugaucgacgacaucaucucccucgagagcuccuacaacgaggagauccuggggcugauggaccccgcccuccagauggccaacacccugcccgucagcggcaaccugaucgaccucuacggcaaccaggggcugccgccgcccggccugaccaucuccaacagcugccccgcgaaccuccccaacaucaagcgcgagcugaccgaguccgaggcccgggcccuggccaaggagcgccagaagaaggacaaccacaaccucaucgagcggcgccggcgcuucaacaucaacgaccggaucaaggagcuggggacgcugauccccaagagcaacgaccccgacaugcgcuggaacaagggcaccauccucaaggccuccguggacuacauccggaagcugcagcgcgagcagcagcgggcgaaggagcuggagaaccgccagaagaagcucgagcacgccaaccgccaccuccugcuccggauccaggagcuggagaugcaggcccgcgcccacgggcugagccucauccccuccaccggccugugcagcccggaccuggugaaccggaucaucaagcaggagcccguccucgagaacugcucccaggaccugcugcagcaccacgccgaccugaccugcacgaccacccuggaccugaccgacggcacgaucaccuucaacaacaaccucgggaccggcaccgaggcgaaccaggccuacagcgugcccacgaagaugggguccaagcuggaggacauccugauggacgacacccugagcccggugggcgucaccgacccccuccuguccagcgugucccccggcgccagcaagaccagcucccgccggagcuccaugagcauggaggagacggagcacacgugcuga

SEQ ID NO: 2739 - RNA, 1515 nt, Artificial Sequence
  derived and/or modified sequence opt2 from MITF__Homo_sapiens__CCDS46865.1
auggaggcccuccgcguccagauguucaugcccugcuccuucgagucccucuaccucuccuccgccgagcaccccggcgccuccaagccccccaucuccuccuccuccaugaccucccgcauccuccuccgccagcagcucaugcgcgagcagaugcaggagcaggagcgccgcgagcagcagcagaagcuccaggccgcccaguucaugcagcagcgcguccccgucucccagacccccgccaucaacgucuccguccccaccacccuccccuccgccacccagguccccauggagguccucaagguccagacccaccucgagaaccccaccaaguaccacauccagcaggcccagcgccagcaggucaagcaguaccucuccaccacccucgccaacaagcacgccaaccagguccucucccuccccugccccaaccagcccggcgaccacgucaugccccccguccccggcuccuccgcccccaacucccccauggccaugcucacccucaacuccaacugcgagaaggagggcuucuacaaguucgaggagcagaaccgcgccgaguccgagugccccggcaugaacacccacucccgcgccuccugcaugcagauggacgacgucaucgacgacaucaucucccucgaguccuccuacaacgaggagauccucggccucauggaccccgcccuccagauggccaacacccuccccgucuccggcaaccucaucgaccucuacggcaaccagggccuccccccccccggccucaccaucuccaacuccugccccgccaaccuccccaacaucaagcgcgagcucaccgaguccgaggcccgcgcccucgccaaggagcgccagaagaaggacaaccacaaccucaucgagcgccgccgccgcuucaacaucaacgaccgcaucaaggagcucggcacccucauccccaaguccaacgaccccgacaugcgcuggaacaagggcaccauccucaaggccuccgucgacuacauccgcaagcuccagcgcgagcagcagcgcgccaaggagcucgagaaccgccagaagaagcucgagcacgccaaccgccaccuccuccuccgcauccaggagcucgagaugcaggcccgcgcccacggccucucccucauccccuccaccggccucugcucccccgaccucgucaaccgcaucaucaagcaggagcccguccucgagaacugcucccaggaccuccuccagcaccacgccgaccucaccugcaccaccacccucgaccucaccgacggcaccaucaccuucaacaacaaccucggcaccggcaccgaggccaaccaggccuacuccguccccaccaagaugggcuccaagcucgaggacauccucauggacgacacccucucccccgucggcgucaccgacccccuccucuccuccgucucccccggcgccuccaagaccuccucccgccgcuccuccauguccauggaggagaccgagcacaccugcuga

SEQ ID NO: 2740 - RNA, 1515 nt, Artificial Sequence
  derived and/or modified sequence opt3 from MITF__Homo_sapiens__CCDS46865.1
auggaggcccugagagugcagauguucaugcccugcagcuuugaaucccucuaccuuucuucagcugagcacccuggcgcaaguaagccaccgaucagcuccucuucgaugaccucaaggauucuguugcggcaacaguuaaugcgcgaacagaugcaggagcaagaacgacgugagcagcagcagaaacugcaagccgcgcaguucaugcagcagagaguccccguuagccaaacuccugcuauaaacgugaguguaccaacaacgcuacccuccgccacccaggugccuauggagguccucaaggugcagacacaucuggaaaauccaacuaaauaucacauccaacaggcacagaggcagcaaguuaagcaguaccuuucuaccacacuggccaacaaacaugcuaaucagguguugagccuccccuguccuaaccagccaggggaccacgucaugccgcccgugccuggauccucagcaccaaauagucccauggccaugcugacccugaacagcaauugcgagaaggaagguuuuuauaaguucgaggagcaaaaccgggcugaaucugaguguccuggcaugaauacucauucccgcgccucaugcaugcagauggaugacguaauugaugacaucauuagccucgaaaguucuuacaacgaggaaaucuuagggcugauggauccagcgcuucagauggcaaauacauugcccguuuccggaaaccugauagaccuauauggcaaucagggucucccgccucccgggcugaccaucagcaacucguguccagccaaucuuccuaacauuaaaagagagcugacggagucugaagcuagggccuuggcaaaggagcggcagaaaaaggauaaccacaaucucaucgaacgccgaagaagguuuaacauuaaugaccggaucaaagagcugggaacuuuaauacccaaguccaacgauccagacaugcguuggaauaagggcaccauucugaaggcuucaguggauuacauccgcaagcuccaaagagaacagcagagggccaaagagcuugagaaccggcaaaagaaacuggaacacgcgaaucgacauuugcuacugcgcauucaggagcucgaaaugcaggccagagcacacggccugagucuuauccccagcacagggcugugcuccccugacuuggucaacaggaucauuaagcaagagccagugcucgaaaauuguucucaggaucuguuacagcaucacgcugaccugacuugcaccacaacccuagaccucacggauggaacuauaacauucaacaauaaccuggguaccggcacugaggccaaucaggcuuauagcgugccgacaaaaauggggucaaaacuugaggacaucuugauggaugacacccugagucccgucggaguuacggauccucuccuguccagcgugucuccaggcgccucaaagaccaguagccggcgcuccucuaugucgauggaagagacagaacacacuuguuga

SEQ ID NO: 2741 - RNA, 1515 nt, Artificial Sequence
  derived and/or modified sequence opt4 from MITF__Homo_sapiens__CCDS46865.1
auggaggcccugagagugcagauguucaugcccugcagcuucgagagccuguaccugagcagcgccgagcaccccggcgccagcaagccccccaucagcagcagcagcaugaccagcagaauccugcugagacagcagcugaugagagagcagaugcaggagcaggagagaagagagcagcagcagaagcugcaggccgcccaguucaugcagcagagagugcccgugagccagacccccgccaucaacgugagcgugcccaccacccugcccagcgccacccaggugcccauggaggugcugaaggugcagacccaccuggagaaccccaccaaguaccacauccagcaggcccagagacagcaggugaagcaguaccugagcaccacccuggccaacaagcacgccaaccaggugcugagccugcccugccccaaccagcccggcgaccacgugaugccccccgugcccggcagcagcgcccccaacagccccauggccaugcugacccugaacagcaacugcgagaaggagggcuucuacaaguucgaggagcagaacagagccgagagcgagugccccggcaugaacacccacagcagagccagcugcaugcagauggacgacgugaucgacgacaucaucagccuggagagcagcuacaacgaggagauccugggccugauggaccccgcccugcagauggccaacacccugcccgugagcggcaaccugaucgaccuguacggcaaccagggccugcccccccccggccugaccaucagcaacagcugccccgccaaccugcccaacaucaagagagagcugaccgagagcgaggccagagcccuggccaaggagagacagaagaaggacaaccacaaccugaucgagagaagaagaagauucaacaucaacgacagaaucaaggagcugggcacccugauccccaagagcaacgaccccgacaugagauggaacaagggcaccauccugaaggccagcguggacuacaucagaaagcugcagagagagcagcagagagccaaggagcuggagaacagacagaagaagcuggagcacgccaacagacaccugcugcugagaauccaggagcuggagaugcaggccagagcccacggccugagccugauccccagcaccggccugugcagccccgaccuggugaacagaaucaucaagcaggagcccgugcuggagaacugcagccaggaccugcugcagcaccacgccgaccugaccugcaccaccacccuggaccugaccgacggcaccaucaccuucaacaacaaccugggcaccggcaccgaggccaaccaggccuacagcgugcccaccaagaugggcagcaagcuggaggacauccugauggacgacacccugagccccgugggcgugaccgacccccugcugagcagcgugagccccggcgccagcaagaccagcagcagaagaagcagcaugagcauggaggagaccgagcacaccugcuga

SEQ ID NO: 2742 - RNA, 1515 nt, Artificial Sequence
  derived and/or modified sequence opt5 from MITF__Homo_sapiens__CCDS46865.1
auggaggcccugagagugcagauguucaugcccugcagcuuugaaucccucuaccugucuagcgcugagcacccuggcgccuccaagccgcccaucucuagcuccucuaugaccagccggauucuucugcgccaacagcucaugagagaacagaugcaggagcaagaacggcgcgagcagcagcagaaacugcaagcggcucaguucaugcagcagagagucccuguuucccaaacacccgccaucaacgugagcgugccuacgacccuucccucugccacacaggucccuauggaggugcugaagguucagacccaucucgaaaauccgacaaaauaucacauucaacaggcucagcggcagcaagugaagcaguaccuguccaccacacuggccaacaaacaugcuaaucagguccucagccugcccuguccuaaccagcccggggaccacgugaugccucccguuccgggaucuuccgccccuaauagccccauggcgaugcuuacccugaacucuaauugcgagaaggaaggcuuuuauaaguucgaggagcaaaaccgcgccgaauccgaguguccugggaugaauacgcauagcagagcuuccugcaugcagauggaugacgugaucgaugacauuaucucucucgaaagcuccuacaacgaggaaauccugggacuuauggaucccgcccugcagauggcuaauacccuccccgucagcggcaaccugauugaccuguaugggaaucagggacucccuccgcccggccugacaaucucuaacuccuguccugccaaucuucccaacauuaaacgggagcugaccgagagcgaagcgcgcgcccucgcuaaggagagacagaaaaaggauaaccacaaucugaucgaacggcgcagacgguuuaacauuaaugaccgcaucaaagagcuuggcacacugauuccuaagucuaacgaucccgacaugagauggaauaaggggaccauccucaaagccagcguggauuacauccggaagcugcaaagagaacagcagcgcgcuaaagagcuggagaaccggcaaaagaaacucgaacacgccaauagacaucugcuucugcgcauucaggagcucgaaaugcaggcccgggcucacggacugucccuuaucccgucuacgggccugugcagcccugaccucgugaacagaauuaucaagcaagagcccguccuggaaaauuguucccaggaucugcuccagcaucacgcggaccugacaugcaccacaacccuugaccugaccgaugggacaauuacguucaacaauaaccucggaaccggcacagaggccaaucaggcuuauagcguuccuaccaaaauggggucuaagcuggaggacauccugauggaugacacacuuucccccgugggagugaccgauccucuccugagcucugucucccccggcgccagcaagacguccucucgccggagcuccaugucuauggaagagacagaacacaccuguuga

SEQ ID NO: 2743 - protein, 419 aa, Artificial Sequence
  MITF__Homo_sapiens__O75030-9
MLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 2744 - RNA, 1260 nt, Artificial Sequence
  MITF__Homo_sapiens__CCDS2913.1
augcuggaaaugcuagaauauaaucacuaucaggugcagacccaccucgaaaaccccaccaaguaccacauacagcaagcccaacggcagcagguaaagcaguaccuuucuaccacuuuagcaaauaaacaugccaaccaaguccugagcuugccauguccaaaccagccuggcgaucaugucaugccaccggugccggggagcagcgcacccaacagccccauggcuaugcuuacgcuuaacuccaacugugaaaaagagggauuuuauaaguuugaagagcaaaacagggcagagagcgagugcccaggcaugaacacacauucacgagcguccuguaugcagauggaugauguaaucgaugacaucauuagccuagaaucaaguuauaaugaggaaaucuugggcuugauggauccugcuuugcaaauggcaaauacguugccugucucgggaaacuugauugaucuuuauggaaaccaaggucugcccccaccaggccucaccaucagcaacuccuguccagccaaccuucccaacauaaaaagggagcucacagcguguauuuuucccacagagucugaagcaagagcacuggccaaagagaggcagaaaaaggacaaucacaaccugauugaacgaagaagaagauuuaacauaaaugaccgcauuaaagaacuagguacuuugauucccaagucaaaugauccagacaugcgcuggaacaagggaaccaucuuaaaagcauccguggacuauauccgaaaguugcaacgagaacagcaacgcgcaaaagaacuugaaaaccgacagaagaaacuggagcacgccaaccggcauuuguugcucagaauacaggaacuugaaaugcaggcucgagcucauggacuuucccuuauuccauccacgggucucugcucuccagauuuggugaaucggaucaucaagcaagaacccguucuugagaacugcagccaagaccuccuucagcaucaugcagaccuaaccuguacaacaacucucgaucucacggauggcaccaucaccuucaacaacaaccucggaacugggacugaggccaaccaagccuauaguguccccacaaaaaugggauccaaacuggaagacauccugauggacgacacccuuucucccgucggugucacugauccacuccuuuccucagugucccccggagcuuccaaaacaagcagccggaggagcaguaugagcauggaagagacggagcacacuuguuag

SEQ ID NO: 2745 - RNA, 1260 nt, Artificial Sequence
  derived and/or modified sequence opt1 from MITF__Homo_sapiens__CCDS2913.1
augcuggagaugcucgaguacaaccacuaccaggugcagacccaccuggagaaccccaccaaguaccacauccagcaggcccagcgccagcaggucaagcaguaccugagcaccacccucgccaacaagcacgcgaaccaggugcugucccugccgugccccaaccagcccggcgaccacgugaugcccccgguccccgggagcuccgcccccaacagccccauggccaugcucacccugaacuccaacugcgagaaggagggcuucuacaaguucgaggagcagaaccgggccgagagcgagugcccggggaugaacacccacucccgcgccagcugcaugcagauggacgacgugaucgacgacaucaucucccuggagagcuccuacaacgaggagauccucggccugauggaccccgcgcugcagauggccaacacgcuccccgugagcgggaaccugaucgaccuguacggcaaccagggccugcccccgcccgggcucaccaucuccaacagcugccccgccaaccugcccaacaucaagcgggagcucaccgccugcaucuucccgaccgaguccgaggcgcgcgcccuggccaaggagcggcagaagaaggacaaccacaaccugaucgagcgccggcgccgguucaacaucaacgaccgcaucaaggagcucggcacgcugauccccaagagcaacgaccccgacaugcgguggaacaaggggaccauccugaaggccuccgucgacuacauccgcaagcuccagcgggagcagcagcgcgccaaggagcuggagaaccggcagaagaagcuggagcacgcgaaccgccaccuccugcugcggauccaggagcucgagaugcaggcccgcgcccacggccugagccugauccccuccaccgggcucugcagcccggaccuggugaaccggaucaucaagcaggagcccgugcuggagaacugcagccaggaccuccugcagcaccacgccgaccugaccugcacgaccacccucgaccugaccgacggcacgaucaccuucaacaacaaccugggcaccgggaccgaggccaaccaggcguacuccguccccacgaagaugggcagcaagcucgaggacauccugauggacgacacccugucccccgugggggugaccgacccgcuccugagcuccgucagccccggcgccuccaagaccagcucccgccggagcuccaugagcauggaggagacggagcacacgugcuga

SEQ ID NO: 2746 - RNA, 1260 nt, Artificial Sequence
  derived and/or modified sequence opt2 from MITF__Homo_sapiens__CCDS2913.1
augcucgagaugcucgaguacaaccacuaccagguccagacccaccucgagaaccccaccaaguaccacauccagcaggcccagcgccagcaggucaagcaguaccucuccaccacccucgccaacaagcacgccaaccagguccucucccuccccugccccaaccagcccggcgaccacgucaugccccccguccccggcuccuccgcccccaacucccccauggccaugcucacccucaacuccaacugcgagaaggagggcuucuacaaguucgaggagcagaaccgcgccgaguccgagugccccggcaugaacacccacucccgcgccuccugcaugcagauggacgacgucaucgacgacaucaucucccucgaguccuccuacaacgaggagauccucggccucauggaccccgcccuccagauggccaacacccuccccgucuccggcaaccucaucgaccucuacggcaaccagggccuccccccccccggccucaccaucuccaacuccugccccgccaaccuccccaacaucaagcgcgagcucaccgccugcaucuuccccaccgaguccgaggcccgcgcccucgccaaggagcgccagaagaaggacaaccacaaccucaucgagcgccgccgccgcuucaacaucaacgaccgcaucaaggagcucggcacccucauccccaaguccaacgaccccgacaugcgcuggaacaagggcaccauccucaaggccuccgucgacuacauccgcaagcuccagcgcgagcagcagcgcgccaaggagcucgagaaccgccagaagaagcucgagcacgccaaccgccaccuccuccuccgcauccaggagcucgagaugcaggcccgcgcccacggccucucccucauccccuccaccggccucugcucccccgaccucgucaaccgcaucaucaagcaggagcccguccucgagaacugcucccaggaccuccuccagcaccacgccgaccucaccugcaccaccacccucgaccucaccgacggcaccaucaccuucaacaacaaccucggcaccggcaccgaggccaaccaggccuacuccguccccaccaagaugggcuccaagcucgaggacauccucauggacgacacccucucccccgucggcgucaccgacccccuccucuccuccgucucccccggcgccuccaagaccuccucccgccgcuccuccauguccauggaggagaccgagcacaccugcuga

SEQ ID NO: 2747 - RNA, 1260 nt, Artificial Sequence
  derived and/or modified sequence opt3 from MITF__Homo_sapiens__CCDS2913.1
augcuggagaugcucgaauacaaccacuaucaggugcaaacccaucuugagaaucccacaaaguaccacauccagcaggcccagagacaacaggucaaacaguaucugagcacuacguuggcuaacaagcaugcaaaucagguuuuaucccugccuugcccaaaccaaccgggcgaccacgugaugcccccuguaccagggucuucagcccccaauaguccuauggcgaugcuaacccucaacagcaauugugaaaaagagggauucuacaaguuugaggaacagaacagggcugaguccgaaugcccagguaugaauacacauucucgggccucguguaugcagauggaugacgugauugaugacauaaucucacuggagagcaguuauaacgaagagauucuuggccugauggaucccgcauugcagauggccaauacucucccugucuccgggaaccugaucgaccuguacggaaaucaaggccucccaccgcccgguuuaaccauuucuaacagcugcccugcuaaucugccaaacaucaaacgcgagcuuacagcauguauauuccccaccgaauccgaggcccgagcuuuggccaaggaacgucagaagaaagauaaccacaaucugaucgagagaaggcggcgcuuuaacauuaaugacagaaucaaggaacuagggacucucauuccuaaaucaaacgauccagacaugagguggaauaagggaacaauccugaaagcgaguguggauuauauacggaaacuucagcgcgagcaacagcgagcaaaggagcuggaaaacagacagaagaaguuggagcacgccaauaggcaucuccuguuacggauucaggaacuggagaugcaagcucgugcccacggccucagccuuauccccucuaccggccugugcuccccggacuugguuaaccgcauuaucaaacaggaaccugugcuagagaauuguucacaggaucugcuccagcaucacgcagaccugacgugcacuaccacacuugaccugacugaugggaccaucacauucaacaauaacuugggaaccgguacggaggcuaaucaagccuacagcguccccacuaagaugggcaguaaacucgaagacauucugauggaugacacauuaucuccaguggggguaaccgauccucugcuauccagcguuucgcccggagcgucuaagacuuccucaagaaggaguagcauguccauggaggaaacagagcacaccuguuga

SEQ ID NO: 2748 - RNA, 1260 nt, Artificial Sequence
  derived and/or modified sequence opt4 from MITF__Homo_sapiens__CCDS2913.1
augcuggagaugcuggaguacaaccacuaccaggugcagacccaccuggagaaccccaccaaguaccacauccagcaggcccagagacagcaggugaagcaguaccugagcaccacccuggccaacaagcacgccaaccaggugcugagccugcccugccccaaccagcccggcgaccacgugaugccccccgugcccggcagcagcgcccccaacagccccauggccaugcugacccugaacagcaacugcgagaaggagggcuucuacaaguucgaggagcagaacagagccgagagcgagugccccggcaugaacacccacagcagagccagcugcaugcagauggacgacgugaucgacgacaucaucagccuggagagcagcuacaacgaggagauccugggccugauggaccccgcccugcagauggccaacacccugcccgugagcggcaaccugaucgaccuguacggcaaccagggccugcccccccccggccugaccaucagcaacagcugccccgccaaccugcccaacaucaagagagagcugaccgccugcaucuuccccaccgagagcgaggccagagcccuggccaaggagagacagaagaaggacaaccacaaccugaucgagagaagaagaagauucaacaucaacgacagaaucaaggagcugggcacccugauccccaagagcaacgaccccgacaugagauggaacaagggcaccauccugaaggccagcguggacuacaucagaaagcugcagagagagcagcagagagccaaggagcuggagaacagacagaagaagcuggagcacgccaacagacaccugcugcugagaauccaggagcuggagaugcaggccagagcccacggccugagccugauccccagcaccggccugugcagccccgaccuggugaacagaaucaucaagcaggagcccgugcuggagaacugcagccaggaccugcugcagcaccacgccgaccugaccugcaccaccacccuggaccugaccgacggcaccaucaccuucaacaacaaccugggcaccggcaccgaggccaaccaggccuacagcgugcccaccaagaugggcagcaagcuggaggacauccugauggacgacacccugagccccgugggcgugaccgacccccugcugagcagcgugagccccggcgccagcaagaccagcagcagaagaagcagcaugagcauggaggagaccgagcacaccugcuga

SEQ ID NO: 2749 - RNA, 1260 nt, Artificial Sequence
  derived and/or modified sequence opt5 from MITF__Homo_sapiens__CCDS2913.1
augcuggagaugcucgaauacaaccacuaucaagugcaaacccaucuggagaaucccacaaaguaccacauccagcaggcccagagacaacaggucaaacaguaucuuagcacgacccuggcuaacaagcaugccaaucagguucucucccugccuugcccgaaccaacccggcgaccacgugaugccucccgugccugggucuagcgcgcccaauuccccuauggcuaugcuuacacugaacucuaauugugaaaaagagggauucuacaaguuugaggaacagaaccgggccgagagcgaaugcccgggcaugaauacccauucccgcgccucuuguaugcagauggaugacgucauugaugacaucauuagccucgaguccagcuauaacgaagagauccuggggcugauggaucccgcucuccagauggccaauacacugccugugucuggaaaccuuauugaccuguacggcaaucaagggcuucccccucccggacugaccaucuccaacagcugcccggcuaaucuuccuaacaucaaaagagagcugacagccuguauuuuccccaccgaaucugaggcgcgggcccucgcuaaggaacgccagaagaaagauaaccacaaucugaucgagagacggcgcagauuuaacauuaaugaccggaucaaggaacugggcacgcucauuccuaaauccaacgaucccgacaugcgcuggaauaagggcaccauccugaaagccagcguugauuauauuagaaagcuccagcgggagcaacagcgcgcuaaggagcuggaaaacagacagaaaaagcucgagcacgccaaucggcaucugcuucugcgcauccaggaacucgagaugcaagcgagagcccacgggcugucucugauccccuccacaggacucugcagcccugaccuggugaaccggauuaucaaacaggaaccgguccuugagaauuguucccaggaucugcuccagcaucacgcugaccugaccugcacaaccacgcuugaccugacagauggcaccauuacauucaacaauaaccucgggaccggaaccgaggccaaucaggcuuacucugugcccacaaagaugggcagcaaacuggaagacauccugauggaugacacgcucuccccuguuggggugaccgauccccugcuuagcucugucuccccuggagccagcaagacaucuagcagacgcuccucuaugagcauggaggaaaccgagcacacauguuga

SEQ ID NO: 2750 - protein, 526 aa, Artificial Sequence
  MITF__Homo_sapiens__O75030
MQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 2751 - RNA, 1581 nt, Artificial Sequence
  MITF__Homo_sapiens__XM_005264754
augcaguccgaaucggggaucgugccggauuucgaagucggggaggaguuucaugaagagcccaaaaccuauuacgaacucaaaagucaaccgcugaagagcagcaguuccgccgagcauccuggggccuccaagccuccgauaagcuccuccaguaugacaucacgcaucuugcuacgccagcaacucaugcgugagcagaugcaggagcaggagcgcagggagcagcagcagaagcugcaggcggcccaguucaugcaacagagagugcccgugagucagacaccagccauaaacgucagugugcccaccacccuucccucugccacgcaggugccgauggaaguccuuaaggugcagacccaccucgaaaaccccaccaaguaccacauacagcaagcccaacggcagcagguaaagcaguaccuuucuaccacuuuagcaaauaaacaugccaaccaaguccugagcuugccauguccaaaccagccuggcgaucaugucaugccaccggugccggggagcagcgcacccaacagccccauggcuaugcuuacgcuuaacuccaacugugaaaaagagggauuuuauaaguuugaagagcaaaacagggcagagagcgagugcccaggcaugaacacacauucacgagcguccuguaugcagauggaugauguaaucgaugacaucauuagccuagaaucaaguuauaaugaggaaaucuugggcuugauggauccugcuuugcaaauggcaaauacguugccugucucgggaaacuugauugaucuuuauggaaaccaaggucugcccccaccaggccucaccaucagcaacuccuguccagccaaccuucccaacauaaaaagggagcucacagcguguauuuuucccacagagucugaagcaagagcacuggccaaagagaggcagaaaaaggacaaucacaaccugauugaacgaagaagaagauuuaacauaaaugaccgcauuaaagaacuagguacuuugauucccaagucaaaugauccagacaugcgcuggaacaagggaaccaucuuaaaagcauccguggacuauauccgaaaguugcaacgagaacagcaacgcgcaaaagaacuugaaaaccgacagaagaaacuggagcacgccaaccggcauuuguugcucagaauacaggaacuugaaaugcaggcucgagcucauggacuuucccuuauuccauccacgggucucugcucuccagauuuggugaaucggaucaucaagcaagaacccguucuugagaacugcagccaagaccuccuucagcaucaugcagaccuaaccuguacaacaacucucgaucucacggauggcaccaucaccuucaacaacaaccucggaacugggacugaggccaaccaagccuauaguguccccacaaaaaugggauccaaacuggaagacauccugauggacgacacccuuucucccgucggugucacugauccacuccuuuccucagugucccccggagcuuccaaaacaagcagccggaggagcaguaugagcauggaagagacggagcacacuuguuag

SEQ ID NO: 2752 - RNA, 1581 nt, Artificial Sequence
  derived and/or modified sequence opt1 from MITF__Homo_sapiens__XM_005264754
augcagagcgaguccggcaucgugcccgacuucgaggucggggaggaguuccacgaggagccgaagaccuacuacgagcucaagagccagccccucaaguccagcuccagcgccgagcaccccggcgccuccaagcccccgaucagcuccagcuccaugaccagccgcauccugcugcggcagcagcucaugcgcgagcagaugcaggagcaggagcggcgcgagcagcagcagaagcugcaggcggcccaguucaugcagcagcgggugcccgugucccagacccccgccaucaacgucagcgugcccaccacccugccguccgccacccaggugcccauggagguccucaaggugcagacgcaccuggagaaccccaccaaguaccacauccagcaggcccagcgccagcaggucaagcaguaccugagcaccacccucgcgaacaagcacgccaaccaggugcugucccugcccugcccgaaccagcccggggaccacgugaugccgcccgugcccggcagcuccgcccccaacagccccauggccaugcucacgcugaacagcaacugcgagaaggagggguucuacaaguucgaggagcagaaccgggcggaguccgagugccccggcaugaacacccacagccgcgccuccugcaugcagauggacgacgucaucgacgacaucaucagccuggaguccagcuacaacgaggagauccucggccugauggacccggcccugcagauggccaacacccuccccguguccgggaaccugaucgaccuguacggcaaccaggggcugcccccgcccggccugaccaucagcaacuccugccccgccaaccugcccaacaucaagcgggagcucacggcgugcaucuuccccaccgagagcgaggcccgcgcccuggccaaggagcggcagaagaaggacaaccacaaccugaucgagcgccggcgccgguucaacaucaacgaccgcaucaaggagcucgggacccugaucccgaaguccaacgaccccgacaugcgguggaacaagggcaccauccugaaggccagcguggacuacauccgcaagcuccagcgggagcagcagcgcgcgaaggagcuggagaaccggcagaagaagcuggagcacgccaaccgccaccuccugcugcgcauccaggagcucgagaugcaggcccgggcccacggccugucccugauccccagcacggggcucugcuccccggaccuggucaaccgcaucaucaagcaggagcccgugcuggagaacugcagccaggaccuccugcagcaccacgccgaccugaccugcaccaccacgcucgaccugaccgacggcaccaucaccuucaacaacaaccuggggacgggcaccgaggcgaaccaggccuacuccgugcccaccaagaugggcagcaagcucgaggacauccugauggacgacacccugucccccgucggggugacggacccgcugcucagcagcgugucccccggcgccagcaagaccuccagccggcgcuccagcauguccauggaggagaccgagcacacgugcuga

SEQ ID NO: 2753 - RNA, 1581 nt, Artificial Sequence
  derived and/or modified sequence opt2 from MITF__Homo_sapiens__XM_005264754
augcaguccgaguccggcaucguccccgacuucgaggucggcgaggaguuccacgaggagcccaagaccuacuacgagcucaagucccagccccucaaguccuccuccuccgccgagcaccccggcgccuccaagccccccaucuccuccuccuccaugaccucccgcauccuccuccgccagcagcucaugcgcgagcagaugcaggagcaggagcgccgcgagcagcagcagaagcuccaggccgcccaguucaugcagcagcgcguccccgucucccagacccccgccaucaacgucuccguccccaccacccuccccuccgccacccagguccccauggagguccucaagguccagacccaccucgagaaccccaccaaguaccacauccagcaggcccagcgccagcaggucaagcaguaccucuccaccacccucgccaacaagcacgccaaccagguccucucccuccccugccccaaccagcccggcgaccacgucaugccccccguccccggcuccuccgcccccaacucccccauggccaugcucacccucaacuccaacugcgagaaggagggcuucuacaaguucgaggagcagaaccgcgccgaguccgagugccccggcaugaacacccacucccgcgccuccugcaugcagauggacgacgucaucgacgacaucaucucccucgaguccuccuacaacgaggagauccucggccucauggaccccgcccuccagauggccaacacccuccccgucuccggcaaccucaucgaccucuacggcaaccagggccuccccccccccggccucaccaucuccaacuccugccccgccaaccuccccaacaucaagcgcgagcucaccgccugcaucuuccccaccgaguccgaggcccgcgcccucgccaaggagcgccagaagaaggacaaccacaaccucaucgagcgccgccgccgcuucaacaucaacgaccgcaucaaggagcucggcacccucauccccaaguccaacgaccccgacaugcgcuggaacaagggcaccauccucaaggccuccgucgacuacauccgcaagcuccagcgcgagcagcagcgcgccaaggagcucgagaaccgccagaagaagcucgagcacgccaaccgccaccuccuccuccgcauccaggagcucgagaugcaggcccgcgcccacggccucucccucauccccuccaccggccucugcucccccgaccucgucaaccgcaucaucaagcaggagcccguccucgagaacugcucccaggaccuccuccagcaccacgccgaccucaccugcaccaccacccucgaccucaccgacggcaccaucaccuucaacaacaaccucggcaccggcaccgaggccaaccaggccuacuccguccccaccaagaugggcuccaagcucgaggacauccucauggacgacacccucucccccgucggcgucaccgacccccuccucuccuccgucucccccggcgccuccaagaccuccucccgccgcuccuccauguccauggaggagaccgagcacaccugcuga

SEQ ID NO: 2754 - RNA, 1581 nt, Artificial Sequence
  derived and/or modified sequence opt3 from MITF__Homo_sapiens__XM_005264754
augcaaagcgaguccggcaucgugcccgacuucgaagucggggaggaauuucacgaggaaccuaagaccuacuaugagcugaaaucucaaccacucaagucaaguagcuccgccgagcauccgggagcuucuaaacccccuauuucgucaagcaguaugacauccagaauacuucugaggcagcaguugaugcgggaacagaugcaagagcaggaacgccgagagcagcagcaaaaguuacaggcagcccaguucaugcagcaacguguuccagugucucagacucccgcgaucaacguaagcgugccuacgacccugccauccgcuacacagguccccauggaggugcuaaaaguucaaacucaccucgaaaauccuaccaaguaccauauucagcaggcccagagacaacaggugaagcaguaucugucaacaacccuugcaaacaaacacgccaaucagguccugaguuugccaugcccgaaccaacccggugaucaugugaugccuccaguacccggcagcucugcuccuaauuccccaauggcaaugcucacucugaacucaaauugugagaaggaaggguuuuacaaauucgaggaacagaacagggccgagagcgagugccccggaaugaauacacacagucgggcuucuuguaugcagauggacgauguuaucgacgauauuaucucccuggaaagcucguauaacgaggaaauacucggcuuaauggacccggcccugcagauggcgaauacccuuccugugucugguaacuugaucgaucuguacgggaaucaaggacuacccccaccuggccucacgauuuccaacucaugccccgcaaaucugccaaacaucaagcgcgagcuuacugccuguauuuuucccaccgaaagugaggcuagagcccuggcaaaagagaggcagaagaaggacaaccacaauuugaucgaacggcgccgaagauucaacauaaaugauaggauuaaagagcucggcacacugaucccuaagagcaacgacccagauaugcgguggaauaaagggacuauuuuaaaggcuuccgucgacuauauccguaaacugcagcgcgaacagcaaagagccaaggagcucgaaaacaggcagaaaaagcuggagcaugcgaaucggcaccuuuugcuacgaauccaggagcuggaaaugcaagcccgcgcacauggacucucucugauuccgagcaccggucuuugcucacccgaucuggugaacagaauaaucaagcaggagccuguguuggaaaauuguagucaggaccuccugcagcaccacgcugacuuaacaugcaccacgacucuggaucuaacagacggcaccauuacuuuuaacaauaaccucgggacaggaaccgaggccaaucaggcuuacuccgucccaacgaaaaugggcagcaagcuggaggauauccuuauggacgauaccuugucucccguuggugugacagacccucugcucucaaguguaagcccaggggccuccaaaacuucuucgaggcggagcuccaugucaauggaagagaccgaacauacauguuga

SEQ ID NO: 2755 - RNA, 1581 nt, Artificial Sequence
  derived and/or modified sequence opt4 from MITF__Homo_sapiens__XM_005264754
augcagagcgagagcggcaucgugcccgacuucgaggugggcgaggaguuccacgaggagcccaagaccuacuacgagcugaagagccagccccugaagagcagcagcagcgccgagcaccccggcgccagcaagccccccaucagcagcagcagcaugaccagcagaauccugcugagacagcagcugaugagagagcagaugcaggagcaggagagaagagagcagcagcagaagcugcaggccgcccaguucaugcagcagagagugcccgugagccagacccccgccaucaacgugagcgugcccaccacccugcccagcgccacccaggugcccauggaggugcugaaggugcagacccaccuggagaaccccaccaaguaccacauccagcaggcccagagacagcaggugaagcaguaccugagcaccacccuggccaacaagcacgccaaccaggugcugagccugcccugccccaaccagcccggcgaccacgugaugccccccgugcccggcagcagcgcccccaacagccccauggccaugcugacccugaacagcaacugcgagaaggagggcuucuacaaguucgaggagcagaacagagccgagagcgagugccccggcaugaacacccacagcagagccagcugcaugcagauggacgacgugaucgacgacaucaucagccuggagagcagcuacaacgaggagauccugggccugauggaccccgcccugcagauggccaacacccugcccgugagcggcaaccugaucgaccuguacggcaaccagggccugcccccccccggccugaccaucagcaacagcugccccgccaaccugcccaacaucaagagagagcugaccgccugcaucuuccccaccgagagcgaggccagagcccuggccaaggagagacagaagaaggacaaccacaaccugaucgagagaagaagaagauucaacaucaacgacagaaucaaggagcugggcacccugauccccaagagcaacgaccccgacaugagauggaacaagggcaccauccugaaggccagcguggacuacaucagaaagcugcagagagagcagcagagagccaaggagcuggagaacagacagaagaagcuggagcacgccaacagacaccugcugcugagaauccaggagcuggagaugcaggccagagcccacggccugagccugauccccagcaccggccugugcagccccgaccuggugaacagaaucaucaagcaggagcccgugcuggagaacugcagccaggaccugcugcagcaccacgccgaccugaccugcaccaccacccuggaccugaccgacggcaccaucaccuucaacaacaaccugggcaccggcaccgaggccaaccaggccuacagcgugcccaccaagaugggcagcaagcuggaggacauccugauggacgacacccugagccccgugggcgugaccgacccccugcugagcagcgugagccccggcgccagcaagaccagcagcagaagaagcagcaugagcauggaggagaccgagcacaccugcuga

SEQ ID NO: 2756 - RNA, 1581 nt, Artificial Sequence
  derived and/or modified sequence opt5 from MITF__Homo_sapiens__XM_005264754
augcaaagcgaguccggcaucgugcccgacuucgaagucggggaggaauuucacgaggaaccuaagaccuacuaugagcugaaaucucaaccgcucaagagcuccucuagcgccgagcaucccggagcuuccaaaccucccauuucuagcuccagcaugacaucuagaauccugcuucggcagcagcugaugcgcgaacagaugcaagagcaggaaagacgggagcagcagcaaaagcuccaggccgcgcaguucaugcagcaacgcguuccugugucccagacgcccgcuauuaacgugagcgucccuaccacacugccgucugccacccaggugcccauggagguucuuaaagugcaaacacaccuggaaaauccuaccaaguaccauauccagcaggcccagagacaacaggucaagcaguaucucuccacaacccuggcuaacaaacacgccaaucaggugcugagccuccccugcccuaaccaacccggcgaucauguuaugccgccugugcccgggucuuccgcuccuaauagccccauggccaugcugacgcuuaacuccaauugugagaaggaaggauuuuacaaauucgaggaacagaaccgggcggagucugagugccccggcaugaauacccacagccgcgccuccuguaugcagauggacgaugucauugacgauaucaucagccuggaaucuuccuauaacgaggaaauucucgggcugauggacccugcccuucagauggcuaauacacugccggugagcggaaaccucaucgaucuguacggcaaucaaggccugcccccucccgggcucaccauuucuaacagcugcccugcuaaucugcccaacaucaagagagagcuuacagccuguauuuuuccgaccgaauccgaggcgcgggcccuggcuaaagagcgccagaagaaggacaaccacaaucucaucgaaagacggcgcagauucaacauuaaugaucggaucaaagagcugggaacgcuuaucccuaagucuaacgaccccgauaugcgcuggaauaaaggcacaauucugaaggccagcguggacuauaucagaaaacuccagcgggaacagcaaagagcuaaggagcuggaaaaccgccagaaaaagcuggagcaugccaaucggcaccuccugcuucgcauucaggagcuggaaaugcaagccagagcucaugggcucucccugaucccuagcaccggacuuugcucucccgaucuggucaaccggauuaucaagcaggagccuguucucgaaaauuguucccaggaccugcugcagcaccacgcggaccucacaugcaccaccacacuggaucuuacggacggcaccaucacauuuaacaauaaccuggggaccggaacagaggccaaucaggcuuacagcgugcccaccaaaaugggcucuaagcucgaggauauucugauggacgauacgcuguccccggugggcgucacagacccucuucucagcuccgugucucccggggccagcaaaaccuccucuagacgcagcuccaugagcauggaagagaccgaacauacauguuga

SEQ ID NO: 2757 - protein, 354 aa, Artificial Sequence [sequence omitted]

SEQ ID NO: 2758 - RNA, 1065 nt, Artificial Sequence
  MMP1_1__Homo_sapiens__BAG52140
auggcuccggccgccuggcuccgcagcgcggccgcgcgcgcccuccugcccccgaugcugcugcugcugcuccagccgccgccgcugcuggcccgggcucugccgccggacguccaccaccuccaugccgagaggagggggccacagcccuggcaugcagcccugcccaguagcccggcaccugccccugccacgcaggaagccccccggccugccagcagccucaggccuccccgcuguggcgugcccgacccaucugaugggcugagugcccgcaaccgacagaagaggauccuucgguucccauggcaguuggugcaggagcaggugcggcagacgauggcagaggcccuaaagguauggagcgaugugacgccacucaccuuuacugaggugcacgagggccgugcugacaucaugaucgacuucgccagguacuggcauggggacgaccugccguuugaugggccugggggcauccuggcccaugccuucuuccccaagacucaccgagaaggggauguccacuucgacuaugaugagaccuggacuaucggggaugaccagggcacagaccugcugcagguggcagcccaugaauuuggccacgugcuggggcugcagcacacaacagcagccaaggcccugauguccgccuucuacaccuuucgcuacccacugagucucagcccagaugacugcaggggcguucaacaccuauauggccagcccuggcccacugucaccuccaggaccccagcccugggcccccaggcugggauagacaccaaugagauugcaccgcuggagccagacgccccgccagaugccugugaggccuccuuugacgcggucuccaccauccgaggcgagcucuuuuucuucaaagcgggcuuuguguggcgccuccgugggggccagcugcagcccggcuacccagcauuggccucucgccacuggcagggacugcccagcccuguggacgcugccuucgaggaugcccagggccacauuugguucuuccaagggacuacuggcguuuccaccccagcacccggcguguag

SEQ ID NO: 2759 - RNA, 1065 nt, Artificial Sequence
  derived and/or modified sequence opt1 from MMP1_1__Homo_sapiens__BAG52140
auggcccccgccgcguggcugcgcagcgccgccgcccgggcccuccugccgcccaugcugcuccugcugcuccagccccccccgcugcuggcgcgcgcccucccccccgacgugcaccaccugcacgccgagcggcgcggcccccagccguggcacgccgcgcugcccuccagccccgcccccgccccggccacccaggaggccccccggcccgcguccagccuccgccccccgcggugcgggguccccgaccccuccgacggccugagcgcccgcaaccggcagaagcgcauccugcgguuccccuggcagcucgugcaggagcaggugcgccagaccauggccgaggcccugaaggucugguccgacgugacgccgcugaccuucaccgaggugcacgaggggcgggccgacaucaugaucgacuucgcgcgcuacuggcacggcgacgaccuccccuucgacgggcccggcggcauccuggcccacgccuucuuccccaagacccaccgggagggggacguccacuucgacuacgacgagacguggaccaucggcgacgaccaggggaccgaccugcuccagguggccgcccacgaguucggccacgugcuggggcugcagcacaccacggcggccaaggcccucaugagcgccuucuacaccuuccgcuacccgcugucccugagccccgacgacugccggggcguccagcaccucuacggccagcccuggcccaccgugaccucccgcacgccggcccuggggccccaggcgggcaucgacaccaacgagaucgccccccuggagccggacgccccccccgacgccugcgaggcgagcuucgacgccguguccaccauccggggggagcucuucuucuucaaggccggcuucgucuggcgccugcggggcgggcagcugcagcccggcuacccggcccucgccagccgccacuggcaggggcugcccucccccguggacgcggccuucgaggacgcccagggccacaucugguucuuccaggggaccacgggcgugagcacccccgccccgggcgucuga

SEQ ID NO: 2760 - RNA, 1065 nt, Artificial Sequence
  derived and/or modified sequence opt2 from MMP1_1__Homo_sapiens__BAG52140
auggcccccgccgccuggcuccgcuccgccgccgcccgcgcccuccucccccccaugcuccuccuccuccuccagccccccccccuccucgcccgcgcccucccccccgacguccaccaccuccacgccgagcgccgcggcccccagcccuggcacgccgcccuccccuccucccccgcccccgcccccgccacccaggaggccccccgccccgccuccucccuccgccccccccgcugcggcguccccgaccccuccgacggccucuccgcccgcaaccgccagaagcgcauccuccgcuuccccuggcagcucguccaggagcagguccgccagaccauggccgaggcccucaaggucugguccgacgucaccccccucaccuucaccgagguccacgagggccgcgccgacaucaugaucgacuucgcccgcuacuggcacggcgacgaccuccccuucgacggccccggcggcauccucgcccacgccuucuuccccaagacccaccgcgagggcgacguccacuucgacuacgacgagaccuggaccaucggcgacgaccagggcaccgaccuccuccaggucgccgcccacgaguucggccacguccucggccuccagcacaccaccgccgccaaggcccucauguccgccuucuacaccuuccgcuacccccucucccucucccccgacgacugccgcggcguccagcaccucuacggccagcccuggcccaccgucaccucccgcacccccgcccucggcccccaggccggcaucgacaccaacgagaucgccccccucgagcccgacgccccccccgacgccugcgaggccuccuucgacgccgucuccaccauccgcggcgagcucuucuucuucaaggccggcuucgucuggcgccuccgcggcggccagcuccagcccggcuaccccgcccucgccucccgccacuggcagggccuccccucccccgucgacgccgccuucgaggacgcccagggccacaucugguucuuccagggcaccaccggcgucuccacccccgcccccggcgucuga

SEQ ID NO: 2761 - RNA, 1065 nt, Artificial Sequence
  derived and/or modified sequence opt3 from MMP1_1__Homo_sapiens__BAG52140
auggcccccgcugcauggcugagaagcgccgcggcuagggcccuccuuccuccaaugcuguuguuacugcuacagccgcccccucuccuggcacgggcccuuccacccgacgugcaccaucugcacgcugagcgccgaggcccucaaccauggcaugcagccuugcccuccucuccugcuccagccccggcgacccaggaagcaccccguccugccucaagucucagaccacccaggugcggggucccugauccaagcgacggacuguccgcucggaaccgccagaagagaauccugagguuccccuggcagcucguucaagaacaggugcggcagacaauggccgaggcauuaaaaguauggucugaugugacuccgcugacguuuaccgagguccacgaaggucgcgcugacauuaugauagauuucgcccgauacuggcauggcgacgaucuuccuuuugacgggcccggaggcaucuuggcgcacgccuucuuuccaaagacacacagagagggugaugugcauuucgacuaugaugagacuuggaccauuggggacgaucagggaacagaccugcuacaaguugcagcucacgaauuuggccaugugcucggccugcagcacaccacugccgcuaaagcccuuaugucggcauucuacacauuuagguauccucugucauugagccccgacgauugucgugggguccagcaccucuacggacagccauggcccaccgugacgagucggacuccugcccuggguccacaagcuggcaucgacaccaaugagauugcgccguuagaacccgaugcaccuccagacgccugcgaggcuuccuucgaugccguaucuacaauccgcggggagcuguuuuucuuuaaggcaggauucguuuggagacucaggggcggucagcuucagcccggguauccugcccuggcuagccggcauuggcaaggauugccaucccccguggacgccgcauucgaagaugcgcagggccacauaugguuuuuccagggcacuaccggggucucaacaccggcuccuggaguguga

SEQ ID NO: 2762 - RNA, 1065 nt, Artificial Sequence
  derived and/or modified sequence opt4 from MMP1_1__Homo_sapiens__BAG52140
auggcccccgccgccuggcugagaagcgccgccgccagagcccugcugccccccaugcugcugcugcugcugcagccccccccccugcuggccagagcccugccccccgacgugcaccaccugcacgccgagagaagaggcccccagcccuggcacgccgcccugcccagcagccccgcccccgcccccgccacccaggaggcccccagacccgccagcagccugagaccccccagaugcggcgugcccgaccccagcgacggccugagcgccagaaacagacagaagagaauccugagauuccccuggcagcuggugcaggagcaggugagacagaccauggccgaggcccugaagguguggagcgacgugaccccccugaccuucaccgaggugcacgagggcagagccgacaucaugaucgacuucgccagauacuggcacggcgacgaccugcccuucgacggccccggcggcauccuggcccacgccuucuuccccaagacccacagagagggcgacgugcacuucgacuacgacgagaccuggaccaucggcgacgaccagggcaccgaccugcugcagguggccgcccacgaguucggccacgugcugggccugcagcacaccaccgccgccaaggcccugaugagcgccuucuacaccuucagauacccccugagccugagccccgacgacugcagaggcgugcagcaccuguacggccagcccuggcccaccgugaccagcagaacccccgcccugggcccccaggccggcaucgacaccaacgagaucgccccccuggagcccgacgccccccccgacgccugcgaggccagcuucgacgccgugagcaccaucagaggcgagcuguucuucuucaaggccggcuucguguggagacugagaggcggccagcugcagcccggcuaccccgcccuggccagcagacacuggcagggccugcccagccccguggacgccgccuucgaggacgcccagggccacaucugguucuuccagggcaccaccggcgugagcacccccgcccccggcguguga

SEQ ID NO: 2763 - RNA, 1065 nt, Artificial Sequence
  derived and/or modified sequence opt5 from MMP1_1__Homo_sapiens__BAG52140
auggcccccgcugccuggcugagaagcgcggcugcccgggcccuccugccuccgaugcuucugcuccugcuucagcccccuccccugcucgcucgcgcccugccucccgacgugcaccaucugcacgcugagagacggggcccucaaccguggcaugccgcgcuccccuccucuccugcccccgcuccugccacacaggaagcuccccgcccggccagcucccugagaccuccccggugcggggucccugaucccucugacggacuuagcgcgcgcaacagacagaagcggauccugcgcuuccccuggcagcucguucaagaacaggugagacagacaauggccgaggcucugaaagugugguccgaugucacgccucuuaccuuuacagaggugcacgaaggccgggccgacauuaugaucgauuucgcucgcuacuggcauggggacgaucugccguuugacggacccggcgggauucucgcccacgccuucuuuccuaagacccacagagagggagauguucauuucgacuaugaugagacauggaccaucggcgacgaucagggcacagaccugcugcaaguggcugcgcacgaauuugggcauguccucggacugcagcacaccacggccgcuaaagcccuuaugucugccuucuacaccuuucgguauccccugagccucuccccugacgauugucgcggcgugcagcaccuguacgggcagcccuggccgacaguuaccagcagaaccccugcucuuggaccccaagccggcauugacacaaaugagaucgcgccucuggaacccgaugcuccucccgacgccugcgaggccucuuucgaugcuguguccacgaucagaggggagcucuuuuucuuuaaggccggauucgucuggcggcugcgcggcggccagcugcagccgggguauccugcucucgccagccggcauuggcaaggacugcccucucccguggacgcggccuucgaagaugcucagggccacauuugguuuuuccaggggacaaccggaguguccaccccugccccgggcgucuga

SEQ ID NO: 2764 - protein, 267 aa, Artificial Sequence
  MMP7__Homo_sapiens__P09237
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 2765 - RNA, 804 nt, Artificial Sequence
  MMP7__Homo_sapiens__AAV40839
augcgacucaccgugcugugugcugugugccugcugccuggcagccuggcccugccgcugccucaggaggcgggaggcaugagugagcuacagugggaacaggcucaggacuaucucaagagauuuuaucucuaugacucagaaacaaaaaaugccaacaguuuagaagccaaacucaaggagaugcaaaaauucuuuggccuaccuauaacuggaauguuaaacucccgcgucauagaaauaaugcagaagcccagauguggagugccagauguugcagaauacucacuauuuccaaauagcccaaaauggacuuccaaaguggucaccuacaggaucguaucauauacucgagacuuaccgcauauuacaguggaucgauuagugucaaaggcuuuaaacauguggggcaaagagaucccccugcauuucaggaaaguuguauggggaacugcugacaucaugauuggcuuugcgcgaggagcucauggggacuccuacccauuugaugggccaggaaacacgcuggcucaugccuuugcgccugggacaggucucggaggagaugcucacuucgaugaggaugaacgcuggacggaugguagcagucuagggauuaacuuccuguaugcugcaacucaugaacuuggccauucuuuggguaugggacauuccucugauccuaaugcagugauguauccaaccuauggaaauggagauccccaaaauuuuaaacuuucccaggaugauauuaaaggcauucagaaacuauauggaaagagaaguaauucaagaaagaaauag

SEQ ID NO: 2766 - RNA, 804 nt, Artificial Sequence
  derived and/or modified sequence opt1 from MMP7__Homo_sapiens__AAV40839
augcgccugaccgugcucugcgccgucugccugcugcccggcagccucgcccugccgcugccccaggaggccgggggcauguccgagcuccagugggagcaggcgcaggacuaccugaagcgguucuaccuguacgacagcgagaccaagaacgccaacucccucgaggccaagcugaaggagaugcagaaguucuucgggcugcccaucacgggcaugcucaacagccgcgugaucgagaucaugcagaagccccggugcggggugccggacgucgccgaguacucccuguuccccaacagccccaaguggaccuccaagguggugaccuaccgcaucgucagcuacacccgggaccugccccacaucacgguggaccgccucguguccaaggcgcugaacauguggggcaaggagaucccgcugcacuuccggaaggucguguggggcaccgccgacaucaugaucggguucgcccgcggcgcccacggggacagcuaccccuucgacggccccgggaacacccucgcgcacgccuucgcccccggcaccggccucgggggcgacgcccacuucgacgaggacgagcgguggacggacggguccagccugggcaucaacuuccuguacgccgcgacccacgagcugggccacucccuggggaugggccacagcuccgacccgaacgccgugauguaccccaccuacgggaacggcgacccccagaacuucaagcucagccaggacgacaucaaggggauccagaagcuguacggcaagcgcuccaacagccggaagaaguga

SEQ ID NO: 2767 - RNA, 804 nt, Artificial Sequence
  derived and/or modified sequence opt2 from MMP7__Homo_sapiens__AAV40839
augcgccucaccguccucugcgccgucugccuccuccccggcucccucgcccucccccucccccaggaggccggcggcauguccgagcuccagugggagcaggcccaggacuaccucaagcgcuucuaccucuacgacuccgagaccaagaacgccaacucccucgaggccaagcucaaggagaugcagaaguucuucggccuccccaucaccggcaugcucaacucccgcgucaucgagaucaugcagaagccccgcugcggcguccccgacgucgccgaguacucccucuuccccaacucccccaaguggaccuccaaggucgucaccuaccgcaucgucuccuacacccgcgaccucccccacaucaccgucgaccgccucgucuccaaggcccucaacauguggggcaaggagaucccccuccacuuccgcaaggucgucuggggcaccgccgacaucaugaucggcuucgcccgcggcgcccacggcgacuccuaccccuucgacggccccggcaacacccucgcccacgccuucgcccccggcaccggccucggcggcgacgcccacuucgacgaggacgagcgcuggaccgacggcuccucccucggcaucaacuuccucuacgccgccacccacgagcucggccacucccucggcaugggccacuccuccgaccccaacgccgucauguaccccaccuacggcaacggcgacccccagaacuucaagcucucccaggacgacaucaagggcauccagaagcucuacggcaagcgcuccaacucccgcaagaaguga

SEQ ID NO: 2768 - RNA, 804 nt, Artificial Sequence
  derived and/or modified sequence opt3 from MMP7__Homo_sapiens__AAV40839
augagacugaccgugcucugcgccgucugucuucugcccggcagcuuggcuuuaccucugccacaggaggcagggggaauguccgaacuacaaugggagcaggcccaggacuaccucaagagguucuaucuguacgauucugaaacaaagaacgcuaauucacuugaggcgaagcugaaagaaaugcagaaguuuuucgguuugccgaucacuggcaugcucaacagucggguuauugagauaaugcaaaaaccccgcugcggggugccugacguagccgaguauagccuguuuccaaauucccccaaguggacgucuaagguggucaccuaccgaaucgugucguauacacgugaucugccucacauuacuguugacagacucgugucaaaagcauuaaacauguggggaaaggaaaucccacugcauuucaggaaagucguguggggcaccgccgauauuaugaucgguuuugcucgcggggcacacggagacagcuaccccuucgauggcccuggcaauacacuugcccaugcuuuugccccagggaccggauuggguggcgacgcgcacuucgaugaggacgaacgguggacugaugggaguucccugggaauaaacuuucuauaugcagccacacaugagcucggccacucucuggguauggggcacagcuccgacccgaaugcuguaauguaccccaccuacggaaacggcgauccucagaauuucaaacuuucacaggacgacaucaaaggcauucagaagcuguaugggaagagaaguaacagcaggaaaaaguga

SEQ ID NO: 2769 - RNA, 804 nt, Artificial Sequence
  derived and/or modified sequence opt4 from MMP7__Homo_sapiens__AAV40839
augagacugaccgugcugugcgccgugugccugcugcccggcagccuggcccugccccugccccaggaggccggcggcaugagcgagcugcagugggagcaggcccaggacuaccugaagagauucuaccuguacgacagcgagaccaagaacgccaacagccuggaggccaagcugaaggagaugcagaaguucuucggccugcccaucaccggcaugcugaacagcagagugaucgagaucaugcagaagcccagaugcggcgugcccgacguggccgaguacagccuguuccccaacagccccaaguggaccagcaagguggugaccuacagaaucgugagcuacaccagagaccugccccacaucaccguggacagacuggugagcaaggcccugaacauguggggcaaggagaucccccugcacuucagaaaggugguguggggcaccgccgacaucaugaucggcuucgccagaggcgcccacggcgacagcuaccccuucgacggccccggcaacacccuggcccacgccuucgcccccggcaccggccugggcggcgacgcccacuucgacgaggacgagagauggaccgacggcagcagccugggcaucaacuuccuguacgccgccacccacgagcugggccacagccugggcaugggccacagcagcgaccccaacgccgugauguaccccaccuacggcaacggcgacccccagaacuucaagcugagccaggacgacaucaagggcauccagaagcuguacggcaagagaagcaacagcagaaagaaguga

SEQ ID NO: 2770 - RNA, 804 nt, Artificial Sequence
  derived and/or modified sequence opt5 from MMP7__Homo_sapiens__AAV40839
augagacugaccgugcucugcgccgucugucugcuucccggcagccuggcucucccucugccgcaggaggccgggggaauguccgaacuucaaugggagcaggcgcaggacuaccugaagcgguucuaucucuacgauucugaaacaaagaacgcuaauagccuggaggccaagcugaaagaaaugcagaaguuuuucggccuccccaucacggggaugcugaacucccgcguuauugagaucaugcaaaaaccuagaugcggagugcccgacguggccgaguauucucuuuuuccuaauagccccaaguggaccuccaaggucgugacauaccggauuguuucuuauacccgcgaucugccucacaucacaguggacagacucgucagcaaagcucugaacauguggggcaaggaaauuccgcuucauuuccggaaagugguuugggggaccgccgauaucaugaucggauuugcucgcggcgcccacggcgacuccuaccccuucgaugggccuggaaauacacuggcgcaugccuuugcucccggcaccgggcucggaggcgacgcccacuucgaugaggacgaaagauggacggaugggagcucucugggaauuaacuuucuguaugcugccacccaugagcucggccacucccugggcauggggcacagcucugacccuaaugcggugauguaccccacauacggaaacggcgauccgcagaauuucaaacuuucccaggacgacaucaaagggauucagaagcuguauggaaagcggagcaacucucgcaaaaaguga

SEQ ID NO: 2771 - protein, 1255 aa, Artificial Sequence
  MUC-1__Homo_sapiens__AAA60019
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 2772 - RNA, 3768 nt, Artificial Sequence
  MUC-1__Homo_sapiens__J05582.1
augacaccgggcacccagucuccuuucuuccugcugcugcuccucacagugcuuacaguuguuacagguucuggucaugcaagcucuaccccagguggagaaaaggagacuucggcuacccagagaaguucagugcccagcucuacugagaagaaugcugugaguaugaccagcagcguacucuccagccacagccccgguucaggcuccuccaccacucagggacaggaugucacucuggccccggccacggaaccagcuucagguucagcugccaccuggggacaggaugucaccucggucccagucaccaggccagcccugggcuccaccaccccgccagcccacgaugucaccucagccccggacaacaagccagccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccacggugucaccucggccccggacaccaggccggccccgggcuccaccgcccccccagcccauggugucaccucggccccggacaacaggcccgccuugggcuccaccgccccuccaguccacaaugucaccucggccucaggcucugcaucaggcucagcuucuacucuggugcacaacggcaccucugccagggcuaccacaaccccagccagcaagagcacuccauucucaauucccagccaccacucugauacuccuaccacccuugccagccauagcaccaagacugaugccaguagcacucaccauagcucgguaccuccucucaccuccuccaaucacagcacuucuccccaguugucuacuggggucucuuucuuuuuccugucuuuucacauuucaaaccuccaguuuaauuccucucuggaagaucccagcaccgacuacuaccaagagcugcagagagacauuucugaaauguuuuugcagauuuauaaacaaggggguuuucugggccucuccaauauuaaguucaggccaggaucuguggugguacaauugacucuggccuuccgagaagguaccaucaauguccacgacguggagacacaguucaaucaguauaaaacggaagcagccucucgauauaaccugacgaucucagacgucagcgugagugaugugccauuuccuuucucugcccagucuggggcuggggugccaggcuggggcaucgcgcugcuggugcuggucuguguucugguugcgcuggccauugucuaucucauugccuuggcugucugucagugccgccgaaagaacuacgggcagcuggacaucuuuccagcccgggauaccuaccauccuaugagcgaguaccccaccuaccacacccaugggcgcuaugugcccccuagcaguaccgaucguagccccuaugagaagguuucugcagguaacgguggcagcagccucucuuacacaaacccagcaguggcagccgcuucugccaacuuguag

SEQ ID NO: 2773 - RNA, 3768 nt, Artificial Sequence
  derived and/or modified sequence opt1 from MUC-1__Homo_sapiens__J05582.1
augacccccggcacccagagcccguucuuccugcuccugcugcucacggugcugaccgucgugaccggguccggccacgccagcuccacccccgggggcgagaaggagacgagcgccacccagcgcuccagcgugcccuccagcaccgagaagaacgcggucuccaugaccagcuccgugcugagcucccacagccccggguccggcagcuccacgacccagggccaggacgugacccucgccccggccaccgagcccgccagcggguccgccgcgacguggggccaggacgucaccagcgugcccgugacccggcccgcccuggggagcaccacgccgcccgcccacgacgucaccuccgcccccgacaacaagcccgcgccgggcagcaccgccccgcccgcccacggggugaccuccgcccccgacacgcgccccgcccccggcagcaccgcgccgcccgcccacggcgugaccuccgcccccgacacccggcccgcccccgggagcacggcgcccccggcccacggcgucaccuccgcccccgacacccgccccgcccccgggagcaccgccccgcccgcccacggcgugacguccgcgcccgacacccggccggcccccggcagcaccgccccgcccgcccacggggugaccuccgcccccgacacgcgccccgcgcccggcagcaccgcgcccccggcccacggggucaccuccgcccccgacacccggcccgcccccggcagcacggccccgcccgcccacggggugaccuccgcccccgacacccgccccgccccgggcagcaccgcgccgcccgcccacggcgugaccuccgcccccgacacgcggcccgcccccgggagcaccgccccgcccgcgcacggcgucaccuccgcccccgacacccgccccgcccccgggagcacggccccgcccgcccacggcgugaccagcgcgcccgacacccggcccgccccgggguccaccgccccgcccgcccacggcgugacgagcgcgcccgacacccgccccgcccccggcuccaccgccccgcccgcccacggggucaccagcgcccccgacacgcggcccgcgcccggcuccaccgcgcccccggcccacggggugaccagcgcccccgacacccgccccgcccccggcuccacggccccgcccgcccacggggugaccagcgcccccgacacccggcccgccccgggcuccaccgccccgcccgcgcacggcgucacgagcgcccccgacacccgccccgcccccggguccaccgcgcccccggcccacggcgugaccagcgcccccgacacgcggcccgcccccggguccaccgccccgcccgcccacggcgucaccagcgcgcccgacacccgccccgccccgggcuccacggccccgcccgcccacggggugaccagcgcccccgacacccggcccgcgcccggcuccaccgccccgcccgcccacggggugacgagcgcccccgacacccgccccgcccccggcagcaccgcgcccccggcccacggggucaccuccgcccccgacacgcggcccgcccccggcagcaccgccccgcccgcgcacggcgugaccuccgcccccgacacccgccccgccccggggagcaccgccccgcccgcgcacggcgugacguccgcccccgacacccgccccgcccccgggagcaccgcgcccccggcccacggcgucaccuccgcccccgacacgcggcccgcccccgggagcaccgccccgcccgcccacggcgugaccuccgcccccgacacccgccccgcgccgggcagcacggccccgcccgcccacggggugaccuccgcccccgacacccggcccgcccccggcagcaccgcgccgcccgcccacggggucacguccgcccccgacacccgccccgcccccggcagcaccgcgcccccggcccacggggugaccuccgcccccgacacgcggcccgccccgggcagcaccgccccgcccgcgcacggcgugaccuccgcccccgacacccgccccgcccccgggagcacggccccgcccgcccacggcgucaccuccgcgcccgacacccggcccgcccccgggagcaccgcgcccccggcccacggcgugacgagcgcccccgacacccgccccgcccccggguccaccgccccgcccgcccacggcgugaccagcgcccccgacacgcggcccgcgccgggcuccaccgccccgcccgcccacggggucaccagcgcccccgacacccgccccgcccccggcuccacggcgccgcccgcccacggggugaccagcgcccccgacacccggcccgcccccggcuccaccgccccgcccgcgcacggcgugacgagcgcccccgacacccgccccgccccgggguccaccgccccgcccgcccacggcgucaccagcgcgcccgacacccggcccgcccccggguccacggccccgcccgcccacggcgugaccagcgcccccgacacccgccccgcgcccggguccaccgcgcccccggcccacggcgugacgagcgcccccgacacccggcccgcccccggcuccaccgccccgcccgcccacggggucaccagcgcccccgacacgcgccccgccccgggcuccaccgcgccgcccgcccacggggugaccagcgcccccgacacccggcccgcccccggcuccacggcgcccccggcccacggggugaccagcgcccccgacacccgccccgcccccggcagcaccgccccgcccgcccacggcgucacguccgcgcccgacaaccggcccgcccuggggagcaccgccccgcccgugcacaacgugaccuccgccagcggcuccgcgagcggguccgccagcacccucguccacaacggcacguccgcccgcgccaccaccacccccgccagcaaguccacgcccuucagcaucccgucccaccacagcgacacccccaccacccuggcgucccacagcacgaagaccgacgccuccagcacccaccacuccagcgugccgccccugaccagcuccaaccacagcacgagcccccagcucuccaccgggguguccuucuucuuccugagcuuccacaucuccaaccugcaguucaacagcucccucgaggaccccagcaccgacuacuaccaggagcugcagcgcgacaucuccgagauguuccugcagaucuacaagcagggcggcuuccucgggcugagcaacaucaaguuccggcccggcuccgucguggugcagcugacccucgccuuccgcgaggggacgaucaacguccacgacguggagacccaguucaaccaguacaagaccgaggccgccagccgguacaaccugaccaucuccgacgugagcgucuccgacgugcccuucccguucagcgcgcaguccggcgccggcgugcccggguggggcaucgcccugcucguccuggugugcgugcuggucgcccucgccaucguguaccugaucgcgcuggccgugugccagugccgccggaagaacuacgggcagcucgacaucuuccccgcccgcgacacguaccaccccaugagcgaguacccgaccuaccacacccacggccgguacgucccgcccagcuccaccgaccgcagccccuacgagaagguguccgccgggaacggcggcagcucccugagcuacaccaaccccgcgguggccgccgccuccgccaaccuguga

SEQ ID NO: 2774 - RNA, 3768 nt, Artificial Sequence
  derived and/or modified sequence opt2 from MUC-1__Homo_sapiens__J05582.1
augacccccggcacccagucccccuucuuccuccuccuccuccucaccguccucaccgucgucaccggcuccggccacgccuccuccacccccggcggcgagaaggagaccuccgccacccagcgcuccuccguccccuccuccaccgagaagaacgccgucuccaugaccuccuccguccucuccucccacucccccggcuccggcuccuccaccacccagggccaggacgucacccucgcccccgccaccgagcccgccuccggcuccgccgccaccuggggccaggacgucaccuccguccccgucacccgccccgcccucggcuccaccaccccccccgcccacgacgucaccuccgcccccgacaacaagcccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacacccgccccgcccccggcuccaccgccccccccgcccacggcgucaccuccgcccccgacaaccgccccgcccucggcuccaccgccccccccguccacaacgucaccuccgccuccggcuccgccuccggcuccgccuccacccucguccacaacggcaccuccgcccgcgccaccaccacccccgccuccaaguccacccccuucuccauccccucccaccacuccgacacccccaccacccucgccucccacuccaccaagaccgacgccuccuccacccaccacuccuccguccccccccucaccuccuccaaccacuccaccuccccccagcucuccaccggcgucuccuucuucuuccucuccuuccacaucuccaaccuccaguucaacuccucccucgaggaccccuccaccgacuacuaccaggagcuccagcgcgacaucuccgagauguuccuccagaucuacaagcagggcggcuuccucggccucuccaacaucaaguuccgccccggcuccgucgucguccagcucacccucgccuuccgcgagggcaccaucaacguccacgacgucgagacccaguucaaccaguacaagaccgaggccgccucccgcuacaaccucaccaucuccgacgucuccgucuccgacguccccuuccccuucuccgcccaguccggcgccggcguccccggcuggggcaucgcccuccucguccucgucugcguccucgucgcccucgccaucgucuaccucaucgcccucgccgucugccagugccgccgcaagaacuacggccagcucgacaucuuccccgcccgcgacaccuaccaccccauguccgaguaccccaccuaccacacccacggccgcuacgucccccccuccuccaccgaccgcucccccuacgagaaggucuccgccggcaacggcggcuccucccucuccuacaccaaccccgccgucgccgccgccuccgccaaccucuga

SEQ ID NO: 2775 - RNA, 3768 nt, Artificial Sequence
  derived and/or modified sequence opt3 from MUC-1__Homo_sapiens__J05582.1
augacccccggcacacagagcccuuucuuucugcuccuucuguugacuguguuaacggucguuaccggguccggacacgccucuucaacaccagguggcgagaaggaaaccagugcuacucaaagaagcuccgugccgucuucgacagagaaaaacgcaguaucaaugaccagcagugugcuguccucucauagccccggguccggaucaaguacuacacagggccaggacgucacccuagccccugcgacggaaccagcuagcgguucugccgcaacuugggggcaggaugugaccuccguucccgugacaaggccugcccucggaucaacuaccccacccgcucacgacgucacaagcgcaccugauaauaagccagccccgggcaguaccgcucccccugcccauggcgugacgucugcgccagacacucggcccgcaccuggguccacagccccacccgcucacggaguaaccagcgccccggauacucgcccugcacccgguucgacagcuccaccagcccauggcguuaccucugcgcccgacacgcgaccagcccccggguccaccgcaccuccagcucacggagugacaucagccccggauacucgucccgcuccuggcaguaccgccccacccgcacacggugucacaagcgccccugacacuagaccagcucccggguccaccgcgccgccugcacauggagugacaucugccccagauaccaggcccgcuccuggcagcacugccccaccagcacacggcgugacgucagccccugacacacggcccgcuccagggaguaccgccccgccugcacauggagucacuuccgcgcccgauacccgcccagcucccgguagcacagccccuccagcacacggcguuaccucugcccccgacacuagaccugcuccggggucaacagccccacccgcacacggagugacgagugcuccugauaccaggccagcccccggcagcacugcgccuccggcccaugguguaacauccgcucccgacacccggccagcaccugggucuacagcucccccagcccacggcgugacuucggccccugacacccgccccgcaccaggaagcacggcgccgccugcccauggcgucaccuccgcucccgauacacgaccagcccccgggucaacugcaccuccagcucacggagugaccagugcccccgacacaagaccugcaccggguucuacugccccacccgcucauggcguuaccagcgcgccugauacgaggcccgccccaggguccacagcaccucccgcucacggagugaccucagccccagacacucggccugccccgggcagcacagcucccccagcacacggugucaccucugccccugauacucgucccgcgccaggguccaccgcuccucccgcccauggcgugacaagugcaccggacacgcgcccagccccuggaagcaccgcucccccagcacacggcguaacuucugcccccgauacaagaccugcgccgggguccaccgcucccccagcccauggaguuacaucagcaccugacacuaggcccgccccugguaguaccgcuccacccgcccacggcgugacgagcgcaccugauacacggccagcucccgggucgaccgccccgccugcgcacggagucacuuccgccccagacacccgacccgcaccuggcucuacagcuccacccgcccauggugugacuagcgcuccggauacccgcccugcacccgggucaacagccccuccugcccacggcgucacgagugcucccgacaccagaccagcgcccggauccacugcaccuccagcccauggcgugacaucugcuccggacaccaggcccgccccugggagcacugcaccacccgcccacggaguuacauccgcuccugauacccggccagcgcccggcucaacggccccuccggcacauggugugacuagcgcuccagacacccgccccgccccugggaguacagcacccccagcccacggaguaaccucugcuccugauacuagacccgccccaggcuccacagcgccgccugcacacggugucaccagcgcccccgacacaaggccagcucccggcucgacugccccuccagcucauggggugaccucagcacccgauacgcguccugccccgggaucuacagcuccacccgcccacggcguuaccagugcaccugacacucggccagcgcccggguccaccgccccucccgcucauggagugacaagcgccccagauacucgaccggcaccuggcucuaccgcucccccagcccacggugucacgagcgcaccugacacaagacccgccccaggguccaccgcuccucccgcgcauggagugacuucagccccggauacaaggccagcaccuggcaguaccgcucccccagcccacgguguaacuagcgcccccgacacacgcccugcaccgggcucuaccgcuccacccgcccacggggugacguccgcgccugauacucggcccgcuccaggaucaaccgccccucccgcacauggcguuacaagugccccagacaccagaccugcuccggggagcacagcacccccagcccacggagucacuuccgcgccugauaccaggcccgcuccaggcucuacggccccucccgcacauggugugacaucggccccggacacucgcccagcuccugggagcaccgcacccccagcccacggagugacaucagcucccgacacccgaccugcccccggcuccacugcgcccccugcccacggugucaccagugcaccggauaaccggcccgcucugggcucuacagccccaccuguucauaaugugacgagcgcauccgggucagcuucuggaagcgccaguacucuugugcacaacggcaccuccgcccgugcgacaaccacucccgcuagcaaaucuacaccauucucaaucccuucccaucacagugacacccccacgacucuggcaagccauucgacaaagaccgaugccucuuccacccaccacagcucaguaccgccuuugacaaguucuaaucauuccacuagcccacaacucucaaccggggucagcuuuuucuuucugaguuuccacauuuccaaccugcaguuuaauucuagccucgaggaccccuccacagauuacuaucaggaauuacagagagacauaucagagauguuccugcaaaucuacaaacagggaggcuuucuugguuugucuaacauuaaguucaggccugggagugugguugugcagcugacucuagcuuuucgcgagggaacgaucaauguccaugauguggaaacccaguucaaccaauauaagacagaggccgcaucgcgguacaaucucacuauuagcgacguuuccgugucugauguaccauuucccuucucagcccagagcggcgcuggcgucccuggguggggaaucgcgcugcuugugcuggugugcgucuugguugcccucgcaauaguguaucugaucgcuuuagccguaugucagugcagaaggaaaaacuacggucaacuggacauuuucccagcacgagauaccuaucaccccauguccgaauacccgacauaccacacccauggccgcuaugugccucccaguucuacugaccggagcccauacgagaaggucucagccgggaauggaggcuccagucucagcuauacgaaccccgcuguggccgcggcaucugccaaucuuuga

SEQ ID NO: 2776 - RNA, 3768 nt, Artificial Sequence
  derived and/or modified sequence opt4 from MUC-1__Homo_sapiens__J05582.1
augacccccggcacccagagccccuucuuccugcugcugcugcugaccgugcugaccguggugaccggcagcggccacgccagcagcacccccggcggcgagaaggagaccagcgccacccagagaagcagcgugcccagcagcaccgagaagaacgccgugagcaugaccagcagcgugcugagcagccacagccccggcagcggcagcagcaccacccagggccaggacgugacccuggcccccgccaccgagcccgccagcggcagcgccgccaccuggggccaggacgugaccagcgugcccgugaccagacccgcccugggcagcaccaccccccccgcccacgacgugaccagcgcccccgacaacaagcccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaccagacccgcccccggcagcaccgccccccccgcccacggcgugaccagcgcccccgacaacagacccgcccugggcagcaccgccccccccgugcacaacgugaccagcgccagcggcagcgccagcggcagcgccagcacccuggugcacaacggcaccagcgccagagccaccaccacccccgccagcaagagcacccccuucagcauccccagccaccacagcgacacccccaccacccuggccagccacagcaccaagaccgacgccagcagcacccaccacagcagcgugcccccccugaccagcagcaaccacagcaccagcccccagcugagcaccggcgugagcuucuucuuccugagcuuccacaucagcaaccugcaguucaacagcagccuggaggaccccagcaccgacuacuaccaggagcugcagagagacaucagcgagauguuccugcagaucuacaagcagggcggcuuccugggccugagcaacaucaaguucagacccggcagcgugguggugcagcugacccuggccuucagagagggcaccaucaacgugcacgacguggagacccaguucaaccaguacaagaccgaggccgccagcagauacaaccugaccaucagcgacgugagcgugagcgacgugcccuuccccuucagcgcccagagcggcgccggcgugcccggcuggggcaucgcccugcuggugcuggugugcgugcugguggcccuggccaucguguaccugaucgcccuggccgugugccagugcagaagaaagaacuacggccagcuggacaucuuccccgccagagacaccuaccaccccaugagcgaguaccccaccuaccacacccacggcagauacgugccccccagcagcaccgacagaagccccuacgagaaggugagcgccggcaacggcggcagcagccugagcuacaccaaccccgccguggccgccgccagcgccaaccuguga

SEQ ID NO: 2777 - RNA, 3768 nt, Artificial Sequence
  derived and/or modified sequence opt5 from MUC-1__Homo_sapiens__J05582.1
augacccccggcacacagagcccuuucuuucugcuccugcuucugacggugcucaccgucguuacaggguccggacacgccucuagcaccccgggcggggagaaggaaacauccgcuacccaaagaucuagcgugcccuccucuacagagaaaaacgccgugagcaugaccuccagcguccugucuucccauagcccuggaucuggcuccagcacgacccaggggcaggacgugacacuugcgcccgcuaccgaaccugccucuggauccgccgcuacauggggccaggauguuaccagcgugcccgucacgcggccugcccugggcuccacaaccccgcccgcucacgacgugacaucugccccugauaauaagcccgcgccugggagcaccgcucccccggcccauggaguuaccuccgccccugacacacgccccgcuccuggcagcacggccccucccgcgcacggggugaccucugcccccgauacaagaccggcucccggauccaccgccccucccgcucauggcgucacaagcgccccugacacccggcccgccccggggucuacggcuccucccgcgcacggagugacaagcgccccugauacccgccccgcuccuggcuccaccgcucccccggcccacggcgugacaucugccccugacaccagacccgcccccgggagcacagcgccuccggcucauggagucacguccgcccccgauacccggccugcccccggcagcacagcuccucccgcccacgggguuaccucugcuccugacacacgccccgccccgggauccaccgcgccucccgcccauggcgugacgagcgcuccugauaccagacccgccccggggucuacagcuccucccgcccacggagugaccuccgcgccugacacacggcccgcccccggcagcaccgcuccuccggcccacggcgucacguccgcucccgauacacgcccugcccccgggucuaccgccccucccgcucauggagugacaagcgcgccugacaccagaccggcccccggcuccaccgcuccucccgcccacgggguuacaucugccccugacacgcggcccgcuccgggaagcaccgccccucccgcgcauggcgugacauccgcucccgauacccgcccugcccccgggagcacagccccuccggcucacggcgucaccucugcccccgacacgagaccugcgcccggauccacagcuccucccgcccauggcgugaccagcgccccggauacccggccugcucccgggucuacagccccucccgcucacggaguuaccuccgccccugacacacgccccgcgccgggcagcacggccccucccgcucacggggugaccucugcccccgauacaagaccugcuccgggaagcaccgcucccccugcccauggcgucacauccgcccccgacacccggccugcgcccgggagcacggccccuccggcucacggcgugaccucugcccccgauacaagaccugcccccggauccaccgcuccucccgcccauggcgucacaagcgcgccggacacccgcccugcucccggguccacagcucccccugcccacggagugaccucugcccccgauacgcggccugccccgggcagcacagcgcccccugcucacgggguuaccuccgcccccgacaccagaccugcccccggaucuacagcuccgccugcccauggcgugaccagcgcucccgauacgcgcccugcccccggguccacagcgccucccgcccacggcgucaccucugcuccggacacacggccugcccccggaagcaccgcucccccugcccauggcgugacauccgccccggacaccagacccgcuccugggagcacggcgcccccugcccacggaguuaccucugcucccgauacacgcccugcccccggcuccaccgccccgccugcucauggggugacaagcgcccccgacacccggccugcgcccggaucuacggcuccgccugcccacggcgucacauccgcccccgauaccagacccgcuccugggagcacagcgcccccugcccacggcgugaccucugccccggacacccgccccgcuccuggauccacagcucccccugcccauggcgugacgagcgcccccgauacccggccugcuccgggguccacagcgcccccugcccacggaguuaccagcgcccccgacacaagaccugcucccggcucuaccgccccgccugcucauggggucacgagcgcccccgauacacgccccgccccuggauccaccgcucccccugcgcacggcgugaccucugccccggacacacggcccgcuccuggcagcaccgcucccccugcccauggggugacauccgcccccgauacgagaccggccccuggaucuaccgcgcccccugcccacggcgucacaagcgcucccgacacccggccggccccuggguccacagcuccucccgcccacggagugaccucugcgcccgauacgcgccccgccccuggcagcaccgcuccgcccgcccaugggguuacauccgcuccugacaccagacccgccccuggaagcacagcucccccugcccacggcgugaccucugcgccggauacacggcccgccccuggcuccacggcucccccugcccauggggucaccagcgcucccgacacaagaccggccccuggaucuaccgccccucccgcgcacggcgugaccuccgcucccgacacacgccccgccccugggagcacggcuccgcccgcccacggaguuaccuccgccccugauaaccggcccgcucucggcucuacagccccucccgugcauaaugucaccagcgcguccgggagcgccucuggauccgcuagcacacuggugcacaacggcaccucugccagagcuacgacaaccccggccagcaaauccaccccuuucucuauccccagccaucacuccgacacaccuaccacacuggcgucucauagcaccaagacggaugccuccagcacacaccacucuuccguucccccucucaccagcuccaaucauucuacaagcccccaacuguccaccggcgugagcuuuuucuuucuuucuuuccacauuuccaaccugcaguuuaauagcucucucgaggacccguccacggauuacuaucaggaacugcagcgcgacaucagcgagauguuccuucaaauuuacaaacaagggggauuucugggccucucuaacaucaaguucagacccggguccgucguggugcagcugacccuggcuuuucgggagggaacaauuaauguccaugauguugaaacccaguucaaccaguauaagacagaggccgcuagccgcuacaaucucaccaucucugacgugagcguguccgaugucccuuuucccuucucugcccagagcggcgcuggggugccuggauggggcaucgcccugcuuguucuggugugcguccucguggcgcuggccauuguuuaucuuaucgcucuggccgugugucagugcagacggaaaaacuacggccaacucgacauuuucccggcucgcgauacauaucaccccauguccgaauacccuaccuaccacacgcaugggagauaugugcccccuagcuccacagaccggucucccuacgagaaggucagcgccggaaauggcggguccucucugagcuauaccaacccugccguugcggcugccuccgccaaucuguga

SEQ ID NO: 2778 - protein, 711 aa, Artificial Sequence
  MUM-1/m__Homo_sapiens__NP_116242
MMADAKYVLCRWEKRLWPAKVLARTATSTKNKRRKEYFLAVQILSLEEKIKVKSTEVEILEKSQIEAIASSLASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPEAIICAISAVDEVDYKTAEEKYIKGPSLSYREKEIFDNQLLEERNRRRR

SEQ ID NO: 2779 - RNA, 2136 nt, Artificial Sequence
  MUM-1/m__Homo_sapiens__NM_032853
augauggcggaugccaaguauguccucugccgaugggaaaagcgauuauggccugcgaagguuuuggcccgaaccgcgacuucaacaaaaaauaagagaagaaaggaauauuuucuagcugugcaaauccucucucuagaggaaaaaauuaaggugaaaagcacugaaguugagauccuagagaagucucaaauugaagccauugcuuccucguuagccucacagaaugagguuccugcggcaccccuggaagaacuggccuacagacggucgcuucgcguggcucuggacguucugagcgagggcucgauuuggagucaagaaagcucugcagggacagguagagcugaccggucucugcgagggaagcccauggagcaugucuccucgcccugugauucgaacuccucaucucuuccccgcggagacguguugggcaguuccagaccucacaggaggaggccaugugugcaacaaagccugucaaguucguucacuugugaaaaggaccccgagugcaaaguggaccacaagaaggggcucaggaaaagugaaaacccaagaggcccguugguccucccagcuggagguggugcccaagaugagaguggguccagaauccaccacaaaaauuggacucuugcaaguaagaggggaggaaacucagcgcagaaggcuagcuugugccugaauggaucuucccuuucagaggacgacacggagagagacauggggagcaaaggaggcagcugggcagccccguccuugcccuccggggucagggaggacgaucccugugccaacgcugagggacacgaccccggucugccguugggcagccucacugcgcccccagccccugagcccucggccugcucagagccuggagaaugcccugcgaaaaagaggccgcgccuggauggcagccaaaggccgccugccgugcagcuggagcccauggcagcaggggccgcaccaucccccgggccggggccagggcccagagagucugugaccccgcgcagcaccgccaggcugggcccgccucccucccacgccucugcggaugcaaccagaugucuuccuugcccggauucccagaagcuggagaaagagugccagucuuccgaagaguccauggggucuaauuccaugcguucuauccuggaggaagacgaggaagacgaggagccaccaagaguccuuuuauaccacgaaccacguucguuugaaguaggaaugcuagucuggcauaaacauaaaaaauaccccuucuggccagcaguggucaaaagcgucaggcagagagauaagaaagcaagugugcuauacaucgaaggacacaugaacccgaaaaugaaagguuucacagugucucuuaaaaguuuaaagcacuuugauuguaaagagaaacagacgcuucugaaucaagccagggaggacuucaaccaggacaucggcuggugugucucccucaucaccgacuacaggguccgguuaggcugcgggucuuuugcuggcucuuuccuggaauauuacgcggcugauauaagcuauccuguccgaaaauccauccagcaggacgucuuggggaccaagcuuccucaacugagcaaggggagccccgaggagcccgugguggggugcccccuggggcagaggcagcccugccggaaaaugcuccccgaccgcucgcgggccgcccgggaccgggccaaccagaagcugguggaguacauugugaaggccaagggcgcggagagccaccugcgggccauccuaaagagcaggaagccaucucgcuggcugcagaccuuccugagcuccagccaguacgugaccuguguggagaccuaccuggaggaugaggggcagcuggaccugguggugaaguaccugcagggcgucuaccaggaggugggggccaaggugcuccagcgcaccaacggcgaccggauccgguucauucuggacgugcuucugcccgaggccaucaucugugcgaucucugcgguggacgagguggacuacaagacggcugaggagaaguacaucaaggggccuucgcugagcuaccgggaaaaagaaauauuugacaaccagcuccuugaagagcggaaccggcgccgucgguga

SEQ ID NO: 2780 - RNA, 2136 nt, Artificial Sequence
  derived and/or modified sequence opt1 from MUM-1/m__Homo_sapiens__NM_032853
augauggccgacgccaaguacgugcugugccgcugggagaagcggcucuggcccgcgaagguccuggcccgcaccgccaccagcacgaagaacaagcggcgcaaggaguacuuccuggccgugcagauccucucccuggaggagaagaucaaggucaagagcaccgagguggagauccuggagaagucccagaucgaggccaucgcgagcucccucgccagccagaacgaggugccggccgcgccccuggaggagcuggccuaccggcgcucccuccggguggcccuggacguccugagcgagggcuccaucuggagccaggaguccagcgccgggaccggccgcgccgaccggucccuccgcgggaagcccauggagcacgugagcucccccugcgacagcaacuccagcucccugccgcggggcgacgugcuggggagcagccgcccccaccggcgccggcccugcguccagcagucccucagcuccagcuucacgugcgagaaggaccccgagugcaagguggaccacaagaagggccugcgcaaguccgagaacccgcggggcccccuggugcuccccgccgggggcggggcgcaggacgagagcggcucccgcauccaccacaagaacuggacccuggccagcaagcggggcggcaacuccgcccagaaggccagccugugccucaacggcuccagccuguccgaggacgacaccgagcgcgacauggggagcaagggcggguccugggccgcgcccagccugccguccggcguccgggaggacgaccccugcgccaacgccgagggccacgaccccgggcucccccugggcagccugaccgccccgcccgcccccgagcccuccgcgugcagcgagccgggggagugccccgccaagaagcgcccccgccucgacggcagccagcggcccccggccgugcagcuggagcccauggccgccggggcggcccccucccccggcccgggccccgggccccgcgagagcgugaccccgcgguccacggcccgccuggggcccccgcccagccacgccuccgcggacgccacccggugccuccccugccccgacagccagaagcuggagaaggagugccaguccagcgaggaguccauggggagcaacuccaugcgcagcauccuggaggaggacgaggaggacgaggagccgccccggguccuccuguaccacgagccccgcuccuucgaggugggcaugcugguguggcacaagcacaagaaguaccccuucuggcccgccgucgucaagagcgugcggcagcgcgacaagaaggccuccgugcucuacaucgaggggcacaugaaccccaagaugaagggcuucaccgugagccugaagucccugaagcacuucgacugcaaggagaagcagacccuccugaaccaggcccgggaggacuucaaccaggacaucggcuggugcgugagccugaucacggacuaccgcguccggcucgggugcggcagcuucgcgggguccuuccuggaguacuacgccgccgacaucagcuacccggugcgcaaguccauccagcaggacguccugggcaccaagcucccccagcugagcaaggggucccccgaggagcccguggugggcugcccgcugggccagcggcagcccugccgcaagaugcuccccgaccggagccgcgccgcccgggaccgcgcgaaccagaagcuggucgaguacaucgugaaggccaagggggccgagucccaccuccgcgccauccucaagagccggaagcccucccgcuggcugcagaccuuccugagcuccagccaguacgugaccugcgucgagacguaccuggaggacgagggccagcuggaccugguggugaaguaccugcagggggucuaccaggaggugggcgccaaggugcuccagcggaccaacggcgaccgcauccgguucauccuggacguccugcucccggaggcgaucaucugcgccaucuccgccguggacgagguggacuacaagaccgccgaggagaaguacaucaaggggcccagccuguccuaccgcgagaaggagaucuucgacaaccagcugcucgaggagcggaaccgccggcgccgguga

SEQ ID NO: 2781 - RNA, 2136 nt, Artificial Sequence
  derived and/or modified sequence opt2 from MUM-1/m__Homo_sapiens__NM_032853
augauggccgacgccaaguacguccucugccgcugggagaagcgccucuggcccgccaagguccucgcccgcaccgccaccuccaccaagaacaagcgccgcaaggaguacuuccucgccguccagauccucucccucgaggagaagaucaaggucaaguccaccgaggucgagauccucgagaagucccagaucgaggccaucgccuccucccucgccucccagaacgagguccccgccgccccccucgaggagcucgccuaccgccgcucccuccgcgucgcccucgacguccucuccgagggcuccaucuggucccaggaguccuccgccggcaccggccgcgccgaccgcucccuccgcggcaagcccauggagcacgucuccucccccugcgacuccaacuccuccucccucccccgcggcgacguccucggcuccucccgcccccaccgccgccgccccugcguccagcagucccucuccuccuccuucaccugcgagaaggaccccgagugcaaggucgaccacaagaagggccuccgcaaguccgagaacccccgcggcccccucguccuccccgccggcggcggcgcccaggacgaguccggcucccgcauccaccacaagaacuggacccucgccuccaagcgcggcggcaacuccgcccagaaggccucccucugccucaacggcuccucccucuccgaggacgacaccgagcgcgacaugggcuccaagggcggcuccugggccgcccccucccuccccuccggcguccgcgaggacgaccccugcgccaacgccgagggccacgaccccggccucccccucggcucccucaccgccccccccgcccccgagcccuccgccugcuccgagcccggcgagugccccgccaagaagcgcccccgccucgacggcucccagcgcccccccgccguccagcucgagcccauggccgccggcgccgcccccucccccggccccggccccggcccccgcgaguccgucaccccccgcuccaccgcccgccucggccccccccccucccacgccuccgccgacgccacccgcugccuccccugccccgacucccagaagcucgagaaggagugccaguccuccgaggaguccaugggcuccaacuccaugcgcuccauccucgaggaggacgaggaggacgaggagcccccccgcguccuccucuaccacgagccccgcuccuucgaggucggcaugcucgucuggcacaagcacaagaaguaccccuucuggcccgccgucgucaaguccguccgccagcgcgacaagaaggccuccguccucuacaucgagggccacaugaaccccaagaugaagggcuucaccgucucccucaagucccucaagcacuucgacugcaaggagaagcagacccuccucaaccaggcccgcgaggacuucaaccaggacaucggcuggugcgucucccucaucaccgacuaccgcguccgccucggcugcggcuccuucgccggcuccuuccucgaguacuacgccgccgacaucuccuaccccguccgcaaguccauccagcaggacguccucggcaccaagcucccccagcucuccaagggcucccccgaggagcccgucgucggcugcccccucggccagcgccagcccugccgcaagaugcuccccgaccgcucccgcgccgcccgcgaccgcgccaaccagaagcucgucgaguacaucgucaaggccaagggcgccgagucccaccuccgcgccauccucaagucccgcaagcccucccgcuggcuccagaccuuccucuccuccucccaguacgucaccugcgucgagaccuaccucgaggacgagggccagcucgaccucgucgucaaguaccuccagggcgucuaccaggaggucggcgccaagguccuccagcgcaccaacggcgaccgcauccgcuucauccucgacguccuccuccccgaggccaucaucugcgccaucuccgccgucgacgaggucgacuacaagaccgccgaggagaaguacaucaagggccccucccucuccuaccgcgagaaggagaucuucgacaaccagcuccucgaggagcgcaaccgccgccgccgcuga

SEQ ID NO: 2782 - RNA, 2136 nt, Artificial Sequence
  derived and/or modified sequence opt3 from MUM-1/m__Homo_sapiens__NM_032853
augauggccgacgcuaaguacgugcugugcagaugggagaaaaggcucuggcccgcaaagguccuugcccggaccgcgacaagcacuaaaaacaagcgccgaaaagaauauuuccuggcuguucagaucuuguccuuagaggaaaagauuaaggugaaaucuacggagguagaaauacuggagaagucacaaaucgaggccauugcaaguagccuagccucccagaaugaagugccugcugcaccacucgaggaacuggccuaccguagaucucuuagggucgcucuggauguguugucggagggcucaaucuggagccaggagaguuccgccgggaccggacgggcggaccgcucucucagagguaaaccgauggaacacguuagcucccccugugauucaaacaguagcucucugccuaggggcgacgugcugggguccucacggccacaucgccgaagacccugcguccagcaaagccucaguucuuccuuuacaugugagaaggauccugaaugcaaaguggaccacaagaagggauuaaggaaaagcgagaauccacggggcccccugguacuuccugccggugggggagcacaggaugaaucgggcucucguauucaucacaagaacuggacuuuggcuuccaaacgcggcgggaauagcgcccagaaggcaagucugugucuaaacggaagcucccucucugaggacgauaccgagagagacauggguagcaaaggcgggucaugggcugccccaagucugccguccggaguuagggaagaugaccccugcgcgaaugccgagggccaugauccuggucuuccacuggggagcuugacagcacccccugcuccagaacccucugccuguucagagccgggagaaugcccugcuaagaaacggccccgacucgacggcagucagcgcccuccagccgugcaacuggagcccauggcagccggcgcugcgccaagccccgggccuggaccagguccgagagaguccgucacccccaggucuacugcacgguuaggcccuccacccucgcacgccagcgcugacgccacacgcugucugccuugcccagauucccagaagcucgaaaaggagugucagucaagugaagagucuauggggagcaacuccaugagaucaauccuugaagaggacgaggaagaugaggaacccccgagggugcuguuguaucacgagccucguagcuucgaggugggaaugcuagucuggcauaaacacaagaaauacccauuuuggcccgcaguugugaagucuguacggcagcgagacaaaaaggccuccgugcuguauauagaaggccauaugaauccuaagaugaaagguuucaccgucagucucaagagccugaaacacuuugauugcaaggagaaacaaacgcuucugaaccaggcuagagaagacuucaaucaggauaucggguggugcgugucuuugauuacugacuacaggguucgccucggcuguggauccuuugccggcucauuccuggaguauuacgcagcggauaucaguuaccccgugcggaagucaauucaacaggacgucuuagggaccaagcugccacagcuaucgaaaggauccccugaagaacccgugguagguugcccacucggccagagacaaccguguaggaagaugcugccugaucgcucucgagcugcccgggaccgugcaaaccagaaacuuguugaguauaucgugaaggccaaaggggcugaaagccacuugagagccauacugaagucaaggaagcccagucgcuggcuccagacauuucuguccucuagccaguacgucacuugcguggagaccuaucuugaagacgagggacaacuggauuuggucgugaaauaccuccagggcguuuaucaggaagugggugcaaagguacugcagcggacaaauggggacagaauuagguucaucuuagauguccugcuaccagaggcuauuaucugugccaucuccgcgguggacgagguugauuacaaaaccgccgaagagaaguauauuaaaggccccucacucagcuaccgagaaaaggagauauuugacaaccaacugcuugaggagcgcaaucggagaaggcguuga

SEQ ID NO: 2783 - RNA, 2136 nt, Artificial Sequence
  derived and/or modified sequence opt4 from MUM-1/m__Homo_sapiens__NM_032853
augauggccgacgccaaguacgugcugugcagaugggagaagagacuguggcccgccaaggugcuggccagaaccgccaccagcaccaagaacaagagaagaaaggaguacuuccuggccgugcagauccugagccuggaggagaagaucaaggugaagagcaccgagguggagauccuggagaagagccagaucgaggccaucgccagcagccuggccagccagaacgaggugcccgccgccccccuggaggagcuggccuacagaagaagccugagaguggcccuggacgugcugagcgagggcagcaucuggagccaggagagcagcgccggcaccggcagagccgacagaagccugagaggcaagcccauggagcacgugagcagccccugcgacagcaacagcagcagccugcccagaggcgacgugcugggcagcagcagaccccacagaagaagacccugcgugcagcagagccugagcagcagcuucaccugcgagaaggaccccgagugcaagguggaccacaagaagggccugagaaagagcgagaaccccagaggcccccuggugcugcccgccggcggcggcgcccaggacgagagcggcagcagaauccaccacaagaacuggacccuggccagcaagagaggcggcaacagcgcccagaaggccagccugugccugaacggcagcagccugagcgaggacgacaccgagagagacaugggcagcaagggcggcagcugggccgcccccagccugcccagcggcgugagagaggacgaccccugcgccaacgccgagggccacgaccccggccugccccugggcagccugaccgccccccccgcccccgagcccagcgccugcagcgagcccggcgagugccccgccaagaagagacccagacuggacggcagccagagaccccccgccgugcagcuggagcccauggccgccggcgccgcccccagccccggccccggccccggccccagagagagcgugacccccagaagcaccgccagacugggccccccccccagccacgccagcgccgacgccaccagaugccugcccugccccgacagccagaagcuggagaaggagugccagagcagcgaggagagcaugggcagcaacagcaugagaagcauccuggaggaggacgaggaggacgaggagccccccagagugcugcuguaccacgagcccagaagcuucgaggugggcaugcugguguggcacaagcacaagaaguaccccuucuggcccgccguggugaagagcgugagacagagagacaagaaggccagcgugcuguacaucgagggccacaugaaccccaagaugaagggcuucaccgugagccugaagagccugaagcacuucgacugcaaggagaagcagacccugcugaaccaggccagagaggacuucaaccaggacaucggcuggugcgugagccugaucaccgacuacagagugagacugggcugcggcagcuucgccggcagcuuccuggaguacuacgccgccgacaucagcuaccccgugagaaagagcauccagcaggacgugcugggcaccaagcugccccagcugagcaagggcagccccgaggagcccguggugggcugcccccugggccagagacagcccugcagaaagaugcugcccgacagaagcagagccgccagagacagagccaaccagaagcugguggaguacaucgugaaggccaagggcgccgagagccaccugagagccauccugaagagcagaaagcccagcagauggcugcagaccuuccugagcagcagccaguacgugaccugcguggagaccuaccuggaggacgagggccagcuggaccugguggugaaguaccugcagggcguguaccaggaggugggcgccaaggugcugcagagaaccaacggcgacagaaucagauucauccuggacgugcugcugcccgaggccaucaucugcgccaucagcgccguggacgagguggacuacaagaccgccgaggagaaguacaucaagggccccagccugagcuacagagagaaggagaucuucgacaaccagcugcuggaggagagaaacagaagaagaagauga

SEQ ID NO: 2784 - RNA, 2136 nt, Artificial Sequence
  derived and/or modified sequence opt5 from MUM-1/m__Homo_sapiens__NM_032853
augauggccgacgcuaaguacgugcugugcagaugggagaaacggcucuggcccgccaagguccuggcgcgcaccgcuacaagcacgaaaaacaagagacggaaagaauauuuccuugccguucagauccugucccucgaggaaaagauuaaggugaaaucuaccgagguggaaauccuggaaaagagccaaauugaggccaucgcuuccucucuugccagccagaaugaagucccugcugccccgcuggaggaacucgcguaccgcagaucccugcggguggcccuggauguucucucugagggcagcauuuggucccaggagagcucugcugggacaggacgcgccgacagaucccugcggggcaaacccauggaacacgugagcucuccuugugauuccaacucuagcucccuuccccgcggggacguccugggaagcuccagaccucaccggcgcagacccugcgugcagcaaucucucagcuccagcuuuaccugugagaaggauccugaaugcaaaguugaccacaagaagggccugcggaaaucugagaauccgcgcgggccccuugugcugccugcuggaggcggcgcccaggaugaauccgggagcagaauccaucacaagaacuggacacucgcgucuaaacggggaggcaauagcgcccagaaggcuucccugugucugaacgggucuagccucuccgaggacgauaccgagagagacaugggaagcaaaggcgggucuugggccgcucccucccugccuagcggaguccgcgaagaugaccccugcgccaaugccgagggccaugauccgggccuuccucuggggucucucacagcucccccugcgcccgaacccuccgccuguagcgagccuggagaaugcccggcuaagaaacggcccagacuggacggcucccagcgcccucccgccgugcaacuugagccuauggccgcuggggccgcgcccucuccgggaccuggccccgggccucgggagagcgugacccccagauccacggcucgccugggaccucccccgucucacgccagcgccgacgcuacccggugucucccuugccccgauucccagaagcuggaaaaggagugucagagcucugaagaguccaugggcagcaacucuaugagauccauccuggaagaggacgaggaagaugaggaacccccucgcguccuccuguaucacgagccgcggagcuucgagguuggcaugcuuguguggcauaaacacaagaaauaccccuuuuggccugccguggucaagucugugagacagcgcgacaaaaaggcuagcguucuguauauugaagggcauaugaaucccaagaugaaaggauucacagugucccucaagagccugaaacacuuugauugcaaggagaaacaaacccuucugaaccaggcccgggaagacuucaaucaggauaucggcuggugcgucucucucauuacagacuacagagugcggcugggguguggauccuuugcgggcagcuuccuggaguauuacgccgcugauaucuccuacccuguucgcaagucuauucaacaggacgugcucgggaccaagcugccccagcuuagcaaaggcuccccugaggagcccgucgugggaugcccgcugggccagagacaaccuugucggaagaugcuccccgauagaucucgcgccgcucgggacagagccaaccagaaacuggucgaguauaucgugaaggcgaaaggggccgaaagccaucugcgcgcuauucuuaaguccagaaagccuucucgguggcuccagacguuucugagcuccagccaguacguuacaugcguggagaccuaucuggaagacgagggacaacucgaucuggucgugaaauaccuucagggcguuuaucaggaagugggggccaagguccugcagcgcacaaauggagacagaauccgguucauccucgaugugcugcugcccgaggcuauuaucugugccauuucugccguggacgagguugauuacaaaaccgcugaagagaaguauaucaaaggcccgucccuuagcuaccgcgaaaaggagauuuuugacaaccaacuccuggaagagagaaaucggcgcagacgguga

SEQ ID NO: 2785 - protein, 145 aa, Artificial Sequence
  MUM-2/m__Homo_sapiens__Q9Y5R8
MTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 2786 - RNA, 438 nt, Artificial Sequence
  MUM-2/m__Homo_sapiens__AAD44697
augacuguccacaaccuguaccuguuugaccggaauggagugugucugcacuacagcgaauggcaccgcaagaagcaagcagggauucccaaggaggaggaguauaagcugauguacgggaugcucuucucuauccgcucguuugucagcaagauguccccgcuagacaugaaggauggcuuccuggccuuccaaacuagccguuacaaacuccauuacuacgagacgcccacugggaucaaaguugucaugaauacugacuugggcgugggacccauccgagaugugcugcaccacaucuacagugcgcuguauguggagcugguggugaagaauccccugugcccgcugggccaaacugugcaaagugagcucuuucgcucccgacuggacuccuauguucgcucucugcccuucuucuccgcccgggcuggcuga

SEQ ID NO: 2787 - RNA, 438 nt, Artificial Sequence
  derived and/or modified sequence opt1 from MUM-2/m__Homo_sapiens__AAD44697
augaccgugcacaaccuguaccucuucgaccgcaacggcgucugccugcacuacagcgaguggcaccggaagaagcaggccgggauccccaaggaggaggaguacaagcugauguacggcaugcuguucuccauccgcagcuucguguccaagaugagcccgcucgacaugaaggacggguuccuggccuuccagaccucccgguacaagcuccacuacuacgagacgcccaccggcaucaagguggucaugaacaccgaccugggggugggccccauccgcgacgugcugcaccacaucuacagcgcgcucuacgucgagcugguggugaagaacccccugugcccgcucggccagaccguccaguccgagcuguuccggagccgccuggacuccuacgugcggagccuccccuucuucuccgcccgcgccggguga

SEQ ID NO: 2788 - RNA, 438 nt, Artificial Sequence
  derived and/or modified sequence opt2 from MUM-2/m__Homo_sapiens__AAD44697
augaccguccacaaccucuaccucuucgaccgcaacggcgucugccuccacuacuccgaguggcaccgcaagaagcaggccggcauccccaaggaggaggaguacaagcucauguacggcaugcucuucuccauccgcuccuucgucuccaagauguccccccucgacaugaaggacggcuuccucgccuuccagaccucccgcuacaagcuccacuacuacgagacccccaccggcaucaaggucgucaugaacaccgaccucggcgucggccccauccgcgacguccuccaccacaucuacuccgcccucuacgucgagcucgucgucaagaacccccucugcccccucggccagaccguccaguccgagcucuuccgcucccgccucgacuccuacguccgcucccuccccuucuucuccgcccgcgccggcuga

SEQ ID NO: 2789 - RNA, 438 nt, Artificial Sequence
  derived and/or modified sequence opt3 from MUM-2/m__Homo_sapiens__AAD44697
augaccgugcacaaccuguaccucuucgacagaaauggcgucugccuucauuauagcgaguggcacaggaagaaacaggccgggauccccaaggaagaggaauacaaacugauguauggaauguuguuuuccauucggucuuucguuucaaagaugaguccuuuagauaugaaagacgguuuucuggcuuuccaaacaagccgcuacaagcuacauuauuacgagacuccaacgggcauaaaggugguaaugaacaccgaucucggggugggaccgauccgagacguccugcaccauauuuauuccgcacuuuacguggaacugguugugaaaaaucccuuguguccucucggccagacaguccagucugagcuguuucguucgagacuggauucauacgugaggagccucccauucuuuagugcccgggcggguuga

SEQ ID NO: 2790 - RNA, 438 nt, Artificial Sequence
  derived and/or modified sequence opt4 from MUM-2/m__Homo_sapiens__AAD44697
augaccgugcacaaccuguaccuguucgacagaaacggcgugugccugcacuacagcgaguggcacagaaagaagcaggccggcauccccaaggaggaggaguacaagcugauguacggcaugcuguucagcaucagaagcuucgugagcaagaugagcccccuggacaugaaggacggcuuccuggccuuccagaccagcagauacaagcugcacuacuacgagacccccaccggcaucaagguggugaugaacaccgaccugggcgugggccccaucagagacgugcugcaccacaucuacagcgcccuguacguggagcugguggugaagaacccccugugcccccugggccagaccgugcagagcgagcuguucagaagcagacuggacagcuacgugagaagccugcccuucuucagcgccagagccggcuga

SEQ ID NO: 2791 - RNA, 438 nt, Artificial Sequence
  derived and/or modified sequence opt5 from MUM-2/m__Homo_sapiens__AAD44697
augaccgugcacaaccuguaccucuucgacagaaauggcgucugccugcauuauagcgaguggcaccggaagaaacaggccgggauccccaaggaagaggaauacaaacuuauguauggaaugcuguuuuccauucgcucuuucguuagcaagauguccccucucgauaugaaagacggcuuucuggcuuuccaaacaucuagauacaaacuucauuauuacgagacgccgaccgggaucaagguggugaugaacacagaucugggagucggccccauucgggacgugcuccaccauaucuauagcgcccuguacguugaacugguggucaagaauccucucuguccccuggggcagaccgugcaguccgagcuuuuucgcucuagacuggauagcuacguucggucccucccuuucuuuagcgcgcgcgcuggauga

SEQ ID NO: 2792 - protein, 1043 aa, Artificial Sequence
  MYO1A__Homo_sapiens__Q9UBC5
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQCILITGESGSGKTEASKLVMSYVAAVCGKGEQVNSVKEQLLQSNPVLEAFGNAKTIRNNNSSRFGKYMDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKCKRFRDQLSPKQVEILREKLCASELFKGKKASYPQSVPIPFCGDYIGLQGNPKLQKLKGGEEGPVLMAEAVKKVNRGNGKTSSRILLLTKGHVILTDTKKSQAKIVIGLDNVAGVSVTSLKDGLFSLHLSEMSSVGSKGDFLLVSEHVIELLTKMYRAVLDATQRQLTVTVTEKFSVRFKENSVAVKVVQGPAGGDNSKLRYKKKGSHCLEVTVQ

SEQ ID NO: 2793 - RNA, 3132 nt, Artificial Sequence
  MYO1A__Homo_sapiens__AAC78645
augccucuccuggaagguucuguggggguggaggaucuuguccuccuggaacccuugguggaggagucacugcucaagaaucuucagcuucgcuaugaaaacaaggagauuuauaccuacauugggaauguggugaucucagugaaucccuaucaacagcuucccaucuaugggccagaguucauugccaaauaucaagacuauacuuucuaugagcugaagccccauaucuacgcauuggcaaauguggcguaccagucacugagggacagggaccgagaccaguguauccucaucacaggcgagaguggaucagggaagacugaggccagcaagcuggugaugucuuauguggcugccgucugugggaaaggagagcaggugaacucugugaaggagcagcugcuacagucuaacccagugcuggaggcuuuuggcaaugccaagaccauucgcaacaacaauuccucccgauuuggaaaauacauggauauugaauuugacuucaagggauccccccucgguggugucaucacaaacuaucugcuugagaaaucccgauuagugaagcagcucaaaggagaaaggaacuuccacaucuucuaucagcugcuggcuggagcagaugaacagcugcugaaggcccugaagcuugagcgggauacaacuggcuaugccuaucugaaucaugaaguauccagaguggauggcauggacgacgccuccagcuucagggcuguacagagugcaauggcagugauuggguucucggaggaggagauucgacaagugcuagaggugacauccauggugcuaaagcuggggaacguguugguggcugaugaguuccaggccagugggauaccagcaaguggcauccgugaugggagagguguucgggagauuggggagauggugggcuugaauucagaagaaguagagagagcuuugugcucgaggaccauggaaacagccaaggaaaagguggucacugcacugaauguuaugcaggcucaguaugcucgggacgcccuggcuaagaacaucuacagccgccucuuugacuggauagugaaucgaaucaaugagagcaucaaggugggcaucggggaaaagaagaagguaaugggaguccuugauaucuacgguuuugagauauuagaggauaauagcuuugagcaauuugugaucaacuacugcaaugagaagcugcagcagguguucauagagaugacccugaaagaagagcaagaggaauauaagagagaaggcauaccguggacaaagguggacuacuuugauaauggcaucauuuguaagcucauugagcauaaucagcgagguauccuggccauguuggaugaggagugccugcggccugggguggucagugacuccacuuuccuagcaaagcugaaccagcucuucuccaagcauggccacuacgagagcaaagucacccagaaugcccagcgucaguaugaccacaccaugggccucagcugcuuccgcaucugccacuaugcgggcaaggugacauacaacgugaccagcuuuauugacaagaauaaugaccuacucuuccgagaccuguugcaggccauguggaaggcccagcacccccuccuucgguccuuguuuccugagggcaauccuaagcaggcaucucucaaacgccccccgacugcuggggcccaguucaagaguucuguggccauccucaugaagaaucuguauuccaagagccccaacuacaucaggugcauaaagcccaaugagcaucagcagcgaggucaguucucuucagaccugguggcaacccaggcucgguaccugggacugcuggagaacguacgggugcgacgggcaggcuaugcccaccgccaggguuaugggcccuuccuggaaagguaccgauugcugagccggagcaccuggccucacuggaaugggggagaccgggaagguguugagaagguccugggggagcugagcauguccucgggggagcuggccuuuggcaagacaaagaucuucauuagaagccccaagacucuuuucuaccucgaagaacagaggcgccugagacuccagcagcuggccacacucauacagaagauuuaccgaggcuggcgcugccgcacccacuaccaacugaugcgaaagagucagauccucaucuccucuugguuucggggaaacaugcaaaagaaaugcuaugggaagauaaaggcauccguguuauugauccaggcuuuugugagaggguggaaggcccgaaagaauuaucgcaaauauuuccggucagaggcugcccucaccuuggcagauuucaucuacaagagcaugguacagaaauuccuacuggggcugaagaacaauuugccauccacaaacgucuuagacaagacauggccagccgcccccuacaagugccucagcacagcaaaucaggagcugcagcagcucuucuaccaguggaagugcaagagguuccgggaucagcuguccccgaagcagguagagauccugagggaaaagcucugugccagugaacuguucaagggcaagaaggcuucauauccccagaguguccccauuccauucuguggugacuacauugggcugcaagggaaccccaagcugcagaagcugaaaggcggggaggaggggccuguucugauggcagaggccgugaagaaggucaaucguggcaauggcaagacuucuucucggauucuccuccugaccaagggccaugugauucucacagacaccaagaagucccaggccaaaauugucauugggcuagacaauguggcuggggugucagucaccagccucaaggaugggcucuuuagcuugcaucugagugagaugucaucggugggcuccaagggggacuuccugcuggucagcgagcaugugauugaacugcugaccaaaauguaccgggcugugcuggaugccacgcagaggcagcuuacagucaccgugacugagaaguucucagugagguucaaggagaacaguguggcugucaaggucguccagggcccugcagguggugacaacagcaagcuacgcuacaaaaaaaaggggagucauugcuuggaggugacugugcaguga

SEQ ID NO: 2794 - RNA, 3132 nt, Artificial Sequence
  derived and/or modified sequence opt1 from MYO1A__Homo_sapiens__AAC78645
augccccugcucgagggcagcgugggggucgaggaccuggugcugcucgagccgcugguggaggagucccugcucaagaaccugcagcugcgcuacgagaacaaggagaucuacaccuacaucggcaacgucgugaucagcgugaaccccuaccagcagcuccccaucuacgggcccgaguucaucgccaaguaccaggacuacaccuucuacgagcugaagccgcacaucuacgcccuggcgaacgucgccuaccagucccuccgggaccgcgaccgggaccagugcauccugaucacgggcgagagcggguccggcaagaccgaggccagcaagcuggugauguccuacguggccgccgucugcggcaagggggagcaggucaacagcgugaaggagcagcuccugcaguccaaccccgugcuggaggcguucggcaacgccaagaccauccgcaacaacaacagcucccgguucgggaaguacauggacaucgaguucgacuucaagggcagcccccucgggggcgugaucaccaacuaccugcuggagaagucccgccucgugaagcagcugaagggcgagcggaacuuccacaucuucuaccagcugcucgccggggccgacgagcagcugcugaaggcgcucaagcuggagcgcgacacgaccggcuacgccuaccugaaccacgaggucagccggguggacgggauggacgacgccuccagcuuccgcgccgugcaguccgccauggcggucaucggcuucagcgaggaggagauccgccaggugcucgaggugaccuccaugguccugaagcugggcaacgugcucguggccgacgaguuccaggccagcgggauccccgccagcggcauccgggacgggcggggcguccgcgagaucggggagauggugggccugaacuccgaggaggucgagcgggcccugugcagccgcaccauggagacggcgaaggagaagguggugaccgcccucaacgucaugcaggcccaguacgcccgggacgcccuggcgaagaacaucuacucccgccuguucgacuggaucgugaaccggaucaacgagagcaucaaggugggcaucggggagaagaagaaggucaugggcgugcucgacaucuacggguucgagauccuggaggacaacuccuucgagcaguucgugaucaacuacugcaacgagaagcugcagcaggucuucaucgagaugacccucaaggaggagcaggaggaguacaagcgcgagggcaucccguggaccaagguggacuacuucgacaacgggaucaucugcaagcugaucgagcacaaccagcggggcauccuggccaugcucgacgaggagugccugcgccccggcguggucagcgacuccacguuccuggccaagcucaaccagcuguucagcaagcacgggcacuacgaguccaaggugacccagaacgcccagcgccaguacgaccacaccaugggccugagcugcuuccggaucugccacuacgccgggaaggugaccuacaacgucacguccuucaucgacaagaacaacgaccuccucuuccgcgaccugcugcaggcgauguggaaggcccagcacccccuccugcggagccuguuccccgagggcaacccgaagcaggccucccucaagcgcccgcccaccgccggggcgcaguucaagagcuccguggccauccugaugaagaaccuguacagcaagucccccaacuacauccggugcaucaagcccaacgagcaccagcagcgcggccaguucagcuccgaccucguggccacccaggcccgguaccugggccugcucgagaacguccgcgugcggcgcgccggguacgcgcaccggcagggcuacgggcccuuccuggagcgcuaccggcugcucagccgcagcaccuggccccacuggaacggcggcgaccgggaggggguggagaagguccugggcgagcuguccaugagcuccggggagcucgccuucggcaagacgaagaucuucauccgcagccccaagacccuguucuaccuggaggagcagcggcgccuccggcugcagcagcuggccacccucauccagaagaucuaccgcggguggcgcugccggacccacuaccagcugaugcgcaagucccagauccugaucagcuccugguuccggggcaacaugcagaagaagugcuacggcaagaucaaggccagcgugcuccugauccaggccuucgugcgcggguggaaggcgcggaagaacuaccgcaaguacuuccgguccgaggccgcccugacgcucgccgacuucaucuacaagagcaugguccagaaguuccugcugggccucaagaacaaccugccguccaccaacgugcuggacaagaccuggcccgccgcgcccuacaagugccucagcaccgccaaccaggagcugcagcagcuguucuaccaguggaagugcaagcgcuuccgggaccagcucucccccaagcaggucgagauccugcgcgagaagcugugcgccagcgagcuguucaaggggaagaaggccuccuacccgcagagcgugcccauccccuucugcggcgacuacaucgggcugcagggcaaccccaagcugcagaagcucaagggcggggaggagggcccggugcugauggcggaggccgugaagaaggucaaccgggggaacggcaagacguccagccgcauccugcuccugaccaaggggcacgugauccugaccgacaccaagaagucccaggccaagaucgugaucggccucgacaacgucgccggcgugagcgugacgagccugaaggacgggcuguucucccuccaccugagcgagauguccagcgucggcuccaagggggacuuccugcucgugagcgagcacgugaucgagcugcugaccaagauguaccgggccguccucgacgcgacccagcgccagcugaccgugacggugaccgagaaguucuccguccgguucaaggagaacagcguggccgugaaggucgugcagggccccgccgggggcgacaacuccaagcugcgcuacaagaagaagggcagccacugccucgaggugaccguccaguga

SEQ ID NO: 2795 - RNA, 3132 nt, Artificial Sequence
  derived and/or modified sequence opt2 from MYO1A__Homo_sapiens__AAC78645
augccccuccucgagggcuccgucggcgucgaggaccucguccuccucgagccccucgucgaggagucccuccucaagaaccuccagcuccgcuacgagaacaaggagaucuacaccuacaucggcaacgucgucaucuccgucaaccccuaccagcagcuccccaucuacggccccgaguucaucgccaaguaccaggacuacaccuucuacgagcucaagccccacaucuacgcccucgccaacgucgccuaccagucccuccgcgaccgcgaccgcgaccagugcauccucaucaccggcgaguccggcuccggcaagaccgaggccuccaagcucgucauguccuacgucgccgccgucugcggcaagggcgagcaggucaacuccgucaaggagcagcuccuccaguccaaccccguccucgaggccuucggcaacgccaagaccauccgcaacaacaacuccucccgcuucggcaaguacauggacaucgaguucgacuucaagggcuccccccucggcggcgucaucaccaacuaccuccucgagaagucccgccucgucaagcagcucaagggcgagcgcaacuuccacaucuucuaccagcuccucgccggcgccgacgagcagcuccucaaggcccucaagcucgagcgcgacaccaccggcuacgccuaccucaaccacgaggucucccgcgucgacggcauggacgacgccuccuccuuccgcgccguccaguccgccauggccgucaucggcuucuccgaggaggagauccgccagguccucgaggucaccuccaugguccucaagcucggcaacguccucgucgccgacgaguuccaggccuccggcauccccgccuccggcauccgcgacggccgcggcguccgcgagaucggcgagauggucggccucaacuccgaggaggucgagcgcgcccucugcucccgcaccauggagaccgccaaggagaaggucgucaccgcccucaacgucaugcaggcccaguacgcccgcgacgcccucgccaagaacaucuacucccgccucuucgacuggaucgucaaccgcaucaacgaguccaucaaggucggcaucggcgagaagaagaaggucaugggcguccucgacaucuacggcuucgagauccucgaggacaacuccuucgagcaguucgucaucaacuacugcaacgagaagcuccagcaggucuucaucgagaugacccucaaggaggagcaggaggaguacaagcgcgagggcauccccuggaccaaggucgacuacuucgacaacggcaucaucugcaagcucaucgagcacaaccagcgcggcauccucgccaugcucgacgaggagugccuccgccccggcgucgucuccgacuccaccuuccucgccaagcucaaccagcucuucuccaagcacggccacuacgaguccaaggucacccagaacgcccagcgccaguacgaccacaccaugggccucuccugcuuccgcaucugccacuacgccggcaaggucaccuacaacgucaccuccuucaucgacaagaacaacgaccuccucuuccgcgaccuccuccaggccauguggaaggcccagcacccccuccuccgcucccucuuccccgagggcaaccccaagcaggccucccucaagcgcccccccaccgccggcgcccaguucaaguccuccgucgccauccucaugaagaaccucuacuccaagucccccaacuacauccgcugcaucaagcccaacgagcaccagcagcgcggccaguucuccuccgaccucgucgccacccaggcccgcuaccucggccuccucgagaacguccgcguccgccgcgccggcuacgcccaccgccagggcuacggccccuuccucgagcgcuaccgccuccucucccgcuccaccuggccccacuggaacggcggcgaccgcgagggcgucgagaagguccucggcgagcucuccauguccuccggcgagcucgccuucggcaagaccaagaucuucauccgcucccccaagacccucuucuaccucgaggagcagcgccgccuccgccuccagcagcucgccacccucauccagaagaucuaccgcggcuggcgcugccgcacccacuaccagcucaugcgcaagucccagauccucaucuccuccugguuccgcggcaacaugcagaagaagugcuacggcaagaucaaggccuccguccuccucauccaggccuucguccgcggcuggaaggcccgcaagaacuaccgcaaguacuuccgcuccgaggccgcccucacccucgccgacuucaucuacaaguccaugguccagaaguuccuccucggccucaagaacaaccuccccuccaccaacguccucgacaagaccuggcccgccgcccccuacaagugccucuccaccgccaaccaggagcuccagcagcucuucuaccaguggaagugcaagcgcuuccgcgaccagcucucccccaagcaggucgagauccuccgcgagaagcucugcgccuccgagcucuucaagggcaagaaggccuccuacccccaguccguccccauccccuucugcggcgacuacaucggccuccagggcaaccccaagcuccagaagcucaagggcggcgaggagggccccguccucauggccgaggccgucaagaaggucaaccgcggcaacggcaagaccuccucccgcauccuccuccucaccaagggccacgucauccucaccgacaccaagaagucccaggccaagaucgucaucggccucgacaacgucgccggcgucuccgucaccucccucaaggacggccucuucucccuccaccucuccgagauguccuccgucggcuccaagggcgacuuccuccucgucuccgagcacgucaucgagcuccucaccaagauguaccgcgccguccucgacgccacccagcgccagcucaccgucaccgucaccgagaaguucuccguccgcuucaaggagaacuccgucgccgucaaggucguccagggccccgccggcggcgacaacuccaagcuccgcuacaagaagaagggcucccacugccucgaggucaccguccaguga

SEQ ID NO: 2796 - RNA, 3132 nt, Artificial Sequence
  derived and/or modified sequence opt3 from MYO1A__Homo_sapiens__AAC78645
augccccugcucgagggcagcgugggggucgaagaccuuguucuguuggagccuuuaguggaagagucccugcuaaagaaccuccagcugagauacgaaaauaaagagaucuauaccuacauuggaaacguagugauaucugucaauccauaucaacagcuuccgaucuacggucccgaguucauugccaaguaucaggauuacacauuuuaugaacugaaaccucacaucuacgcuuuggcaaacguggccuaccagucacucagggaccgggaucgcgaccaaugcauucugaucacuggcgagagugggagcggaaagacggaagcguccaaacugguuaugucuuauguggcugccgucuguggcaagggugagcagguaaauucggugaaggagcagcucuuacagucaaacccaguucuggaagcauucgggaaugccaaaaccauacgaaacaauaacagcagucguuuuggaaaguacauggauaucgaguucgacuuuaaaggcaguccccuuggcggggugauuacaaauuauuugcuggaaaagucuaggcuagucaaacaacucaagggagagagaaacuuccauaucuuuuaccagcugcuugcuggugcagaugaacagcuguugaaggcccucaaacuggagcgggacacuaccggcuaugcuuacuuaaaucacgaggugagccgcguggaugggauggacgaugccuccucauucagagcgguccagagugcaauggccguuauuggauuuagcgaagaggaaaucaggcaagugcuggagguaacaucuauggugcucaaacuuggcaacguccugguggcugacgaguuccaggccuccgguauaccugcaucagggauucgggauggacgcggcguucgagaaaucggcgagauggugggguugaauagcgaagaggucgaaagagcucuaugcaguaggaccauggagacugccaaggaaaaggugguaacagcgcugaacguuaugcaggcccaauaugcacgggacgcucucgccaaaaacauuuacucucgucuguuugacuggaucgugaaucgcaucaacgaguccauuaaggucggaauaggugagaaaaagaaggugaugggcguccuugauaucuacggguucgaaauucuggaggacaauagcuuugaacaguucgugaucaacuauuguaaugagaaauugcagcagguuuucauagagaugacccucaaggaggaacaagaagaguacaaaagagaaggcauuccauggacgaagguggauuauuuugacaacggaaucaucugcaaacugauugagcauaaucagagggguaucuuagcuaugcuggaugaggaaugucuacggcccgggguagucucggacucuacuuuccucgccaagcugaaccagcuguuuuccaagcacggccauuacgagucaaaagugacccagaaugcacaacgacaguaugaucacacaaugggauugaguugcuuccgcauuugucacuacgccggcaagguuacuuauaacgugaccagcuuuauagacaaaaauaacgaucuucucuucagagaccugcuucaggcuauguggaaggcgcagcauccucuguugaggucccucuuuccagaagggaauccgaaacaagcaucucugaagcggcccccuacagccggagcucaguucaagagcucagucgccaucuuaaugaaaaaccuguacaguaaguccccaaauuacauucgcugcaucaaacccaacgagcaccagcagagaggucaauuuagcucugaucuaguggcaacccaggccagguaucucggccugcuugaaaacguacgugugcggcgagcuggguacgcccauagacagggauauggcccuuucuuggagagguaccgccugcucucacggaguacguggccacacuggaaugguggggacagagagggcguugaaaagguccugggagaguuaagcauguccucuggcgaacuggcauuugggaaaacuaagaucuucauuaggucgcccaagacauuguuuuaucuugaggaacaacgccgacuccggcugcagcagcuagcgacccugauacagaaaaucuaccguggauggagauguaggacucacuaucaacucaugcgcaagagccagauucugaucuccucaugguuccgggguaacaugcagaaaaagugcuacggcaaaauuaaggcuagugugcuuuugauccaggccuucgugagaggguggaaagcaaggaagaauuaccgaaaguauuuucgcucugaggccgcucugacauuagccgacuucauauacaaaagcaugguccaaaaguuucuccugggacuuaaaaacaaucugccguccaccaacguuuuggauaagacguggccugcagcucccuauaaaugucucucaaccgccaaucaggagcugcagcagcuauucuaccaauggaagugcaagcgguuuagagaccagcugagcccaaaacagguggaaauccucagggagaagcugugcgcgucugaacuuuucaaaggcaagaaagccuccuauccucaaagugugcccauuccauuuuguggugauuacaucggguugcagggcaaccccaagcugcagaaguuaaaaggaggcgaggaggggccuguacucauggcugaagcagucaagaaagugaaucguggaaacggcaagacaagcucucgcauucugcuucugacuaaaggucauguuauccuaaccgacacaaagaagucccaggccaaaauagugauugggcucgauaaugucgcuggagugucaguuacuucccugaaggacggcuuguucagccugcacuuaucggagauguccucuguggguagcaaaggcgauuuucuccugguaucagaacaugucaucgagcuucugaccaagauguaucgggccguguuggacgcaacacaaagacagcucaccgugacugucacggaaaaauucaguguuagguuuaaggagaacuccguggcgguaaaagugguccaggggccagccggaggcgauaauucuaagcugcgauacaagaaaaaggggagccacugccuagaggugacaguucaguga

SEQ ID NO: 2797 - RNA, 3132 nt, Artificial Sequence
  derived and/or modified sequence opt4 from MYO1A__Homo_sapiens__AAC78645
augccccugcuggagggcagcgugggcguggaggaccuggugcugcuggagccccugguggaggagagccugcugaagaaccugcagcugagauacgagaacaaggagaucuacaccuacaucggcaacguggugaucagcgugaaccccuaccagcagcugcccaucuacggccccgaguucaucgccaaguaccaggacuacaccuucuacgagcugaagccccacaucuacgcccuggccaacguggccuaccagagccugagagacagagacagagaccagugcauccugaucaccggcgagagcggcagcggcaagaccgaggccagcaagcuggugaugagcuacguggccgccgugugcggcaagggcgagcaggugaacagcgugaaggagcagcugcugcagagcaaccccgugcuggaggccuucggcaacgccaagaccaucagaaacaacaacagcagcagauucggcaaguacauggacaucgaguucgacuucaagggcagcccccugggcggcgugaucaccaacuaccugcuggagaagagcagacuggugaagcagcugaagggcgagagaaacuuccacaucuucuaccagcugcuggccggcgccgacgagcagcugcugaaggcccugaagcuggagagagacaccaccggcuacgccuaccugaaccacgaggugagcagaguggacggcauggacgacgccagcagcuucagagccgugcagagcgccauggccgugaucggcuucagcgaggaggagaucagacaggugcuggaggugaccagcauggugcugaagcugggcaacgugcugguggccgacgaguuccaggccagcggcauccccgccagcggcaucagagacggcagaggcgugagagagaucggcgagauggugggccugaacagcgaggagguggagagagcccugugcagcagaaccauggagaccgccaaggagaagguggugaccgcccugaacgugaugcaggcccaguacgccagagacgcccuggccaagaacaucuacagcagacuguucgacuggaucgugaacagaaucaacgagagcaucaaggugggcaucggcgagaagaagaaggugaugggcgugcuggacaucuacggcuucgagauccuggaggacaacagcuucgagcaguucgugaucaacuacugcaacgagaagcugcagcagguguucaucgagaugacccugaaggaggagcaggaggaguacaagagagagggcauccccuggaccaagguggacuacuucgacaacggcaucaucugcaagcugaucgagcacaaccagagaggcauccuggccaugcuggacgaggagugccugagacccggcguggugagcgacagcaccuuccuggccaagcugaaccagcuguucagcaagcacggccacuacgagagcaaggugacccagaacgcccagagacaguacgaccacaccaugggccugagcugcuucagaaucugccacuacgccggcaaggugaccuacaacgugaccagcuucaucgacaagaacaacgaccugcuguucagagaccugcugcaggccauguggaaggcccagcacccccugcugagaagccuguuccccgagggcaaccccaagcaggccagccugaagagaccccccaccgccggcgcccaguucaagagcagcguggccauccugaugaagaaccuguacagcaagagccccaacuacaucagaugcaucaagcccaacgagcaccagcagagaggccaguucagcagcgaccugguggccacccaggccagauaccugggccugcuggagaacgugagagugagaagagccggcuacgcccacagacagggcuacggccccuuccuggagagauacagacugcugagcagaagcaccuggccccacuggaacggcggcgacagagagggcguggagaaggugcugggcgagcugagcaugagcagcggcgagcuggccuucggcaagaccaagaucuucaucagaagccccaagacccuguucuaccuggaggagcagagaagacugagacugcagcagcuggccacccugauccagaagaucuacagaggcuggagaugcagaacccacuaccagcugaugagaaagagccagauccugaucagcagcugguucagaggcaacaugcagaagaagugcuacggcaagaucaaggccagcgugcugcugauccaggccuucgugagaggcuggaaggccagaaagaacuacagaaaguacuucagaagcgaggccgcccugacccuggccgacuucaucuacaagagcauggugcagaaguuccugcugggccugaagaacaaccugcccagcaccaacgugcuggacaagaccuggcccgccgcccccuacaagugccugagcaccgccaaccaggagcugcagcagcuguucuaccaguggaagugcaagagauucagagaccagcugagccccaagcagguggagauccugagagagaagcugugcgccagcgagcuguucaagggcaagaaggccagcuacccccagagcgugcccauccccuucugcggcgacuacaucggccugcagggcaaccccaagcugcagaagcugaagggcggcgaggagggccccgugcugauggccgaggccgugaagaaggugaacagaggcaacggcaagaccagcagcagaauccugcugcugaccaagggccacgugauccugaccgacaccaagaagagccaggccaagaucgugaucggccuggacaacguggccggcgugagcgugaccagccugaaggacggccuguucagccugcaccugagcgagaugagcagcgugggcagcaagggcgacuuccugcuggugagcgagcacgugaucgagcugcugaccaagauguacagagccgugcuggacgccacccagagacagcugaccgugaccgugaccgagaaguucagcgugagauucaaggagaacagcguggccgugaagguggugcagggccccgccggcggcgacaacagcaagcugagauacaagaagaagggcagccacugccuggaggugaccgugcaguga

SEQ ID NO: 2798 - RNA, 3132 nt, Artificial Sequence
  derived and/or modified sequence opt5 from MYO1A__Homo_sapiens__AAC78645
augccccugcucgagggcagcgugggggucgaagaccugguucuucuggagccucucguggaagagucccugcuuaagaaccugcagcucagauacgaaaauaaagagaucuauaccuacauuggaaacguggucaucucugugaauccguaucaacagcugcccauuuacggcccugaguucaucgccaaguaucaggauuacacauuuuaugaacugaaaccccacauuuacgcucucgccaacguugcguaccagagccugcgggaccgcgauagagaccaaugcauccuuaucacgggggaguccggaucuggcaagaccgaagcuagcaaacuggugauguccuaugucgccgccgugugugggaagggagagcagguuaauucugugaaggagcagcuccugcagagcaacccuguccuugaagcguucggcaaugccaaaacaauucggaacaauaacuccagccgcuuuggcaaguacauggauaucgaguucgacuuuaaagggucuccccugggaggcgugauuaccaauuaucuccuggaaaaguccagacuggugaaacaacucaagggggagcggaacuuccauaucuuuuaccagcugcuugcuggagccgaugaacagcugcucaaggcgcugaaacuugagcgcgacacaaccggcuaugccuaccugaaucacgaggucagcagaguugaugggauggacgaugcuucuuccuuccgggccgugcagagcgcuauggccgugauuggauuuucugaagaggaaauccgccaaguccucgaggugacauccaugguucugaagcugggcaacgugcucgucgcggacgaguuccaggccagcggcauuccugcuuccgggaucagagauggacggggcgugcgcgagaucggggagaugguuggacuuaauucugaagagguggaaagagcccugugcagccggaccauggagacggcuaaagaaaaggucgugaccgcccugaacgucaugcaggcccaauaugcucgcgacgcgcucgccaaaaacauuuacuccagacuguuugacuggaucgugaaucggauuaacgagagcaucaagguuggcauuggggagaaaaagaaggugaugggaguccuugauaucuacggcuucgaaauccuggaggacaauucuuuugaacaguucgugauuaacuauuguaaugagaaacuccagcagguuuucaucgagaugacacugaaggaagaacaagaagaguacaaaagagaaggcauuccguggaccaagguggauuauuuugacaacgggaucauuugcaaacugaucgagcauaaucagcgcggaauccucgcuaugcuggaugaggaaugucuucggcccggcgucguguccgacagcacauuccuggccaagcucaaccagcuguuuucuaagcacgggcauuacgagagcaaagugacccagaaugcccaaagacaguaugaucacacgaugggacuguccugcuuccgcauuugucacuacgcuggcaagguuacauauaacgucaccucuuuuaucgacaaaaauaacgaucuucucuuccgggaccugcugcaggccauguggaaggcgcagcauccucuccugagaagccuuuuucccgaagggaauccuaaacaggcuucccugaagcggcccccgacagccggcgcccaauucaagagcucuguggcuauucucaugaaaaaccuguacuccaagagcccuaauuacauccggugcauuaaacccaacgagcaccagcagagaggacaauuuucuuccgaucugguggccacccaggcucgcuaucuuggccuccuggaaaacguccgggugagacgcgccggguacgcgcaucggcagggauauggcccuuuccuggagagauaccggcuccugagccgcuccaccuggccccacuggaaugggggagacagagagggcguugaaaaggugcuuggggagcugucuaugagcuccggcgaacucgccuuuggaaaaacaaagaucuucauucggucucccaagacgcuguuuuaucuggaggaacaaagacgccuucggcuccagcagcuggcuacccugauccagaaaaucuacagaggcuggcgcuguagaacacacuaucaacucaugcgcaagagccagauucugaucuccagcugguuccgcgggaacaugcagaaaaagugcuacggaaaaauuaaggccucuguccuucugauccaggcuuucgugagaggcuggaaagcccggaagaauuaccgcaaguauuuuagauccgaggcggcccucacccuggcugacuucauuuacaaaagcaugguucaaaaguuucugcuugggcucaaaaacaaucugccuucuacaaacgugcuggauaagaccuggccggccgcucccuauaaaugucucuccacggccaaucaggagcugcagcagcuuuucuaccaauggaagugcaagcgguuucgcgaccagcugagcccuaaacaggucgaaauccucagagagaagcugugcgccucugaacuguucaaaggaaagaaagcuagcuauccccaauccgugccuauccccuuuuguggcgauuacauugggcuucagggcaacccgaagcugcagaagcucaaaggaggcgaggaggggccuguucugauggcggaagccgugaagaaagucaaucggggaaacggcaagacaagcucucgcauccuccugcuuaccaaagggcaugugauucugaccgacacaaagaagucccaggcuaaaaucgugauuggacucgauaaugucgccggcguuagcgugaccucccugaaggacgggcuguucucucuucaccugagcgagauguccucugugggcagcaaaggagauuuucuccuggucuccgaacaugugaucgagcuccugacaaagauguauagagccguucuugacgcuacgcaacggcagcugaccgugacagucaccgaaaaauucucugugagauuuaaggagaacagcguugccgugaaagucgugcagggccccgcugggggagauaauuccaagcuccgcuacaagaaaaagggcagccacugccuggagguuacagugcaguga

SEQ ID NO: 2799 - protein, 1136 aa, Artificial Sequence
  MYO1B__Homo_sapiens__O43795
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQARRELRRLKEEARNKHAIAVIWAYWLGSKARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 2800 - RNA, 3411 nt, Artificial Sequence
  MYO1B__Homo_sapiens__AAH53558
auggccaaaauggaggugaaaaccucacuucuggacaauaugauuggaguuggggauaugguucuuuuagaaccucucaaugaggagaccuucaucaacaaccucaagaagcgcuuugaccacagugaaauauacacuuacauuggaagugugguuauaucuguuaacccauaucggucuuuacccauuuauucaccagagaaaguggaagaauacaggaacagaaauuuuuaugaacugagcccucacaucuuugcccuuucggaugaagcauacagaucccuacgagaucaagauaaggaccaauguauucucauuacuggggaaaguggagcaggaaaaacagaggccaguaagcuugucauguccuauguggcagcuguuuguggaaaaggagcagaaguuaaucaaguuaaagaacagcuuuuacaguccaacccgguccuggaagcuuuuggaaaugccaaaacuguaaggaaugacaacuccucuagauuuggcaaauauauggauauugaauuugacuuuaaaggcgauccacuaggaggaguaauaaguaacuaucuuuuagagaaaucucggguuguuaaacagccaagaggugaaagaaacuuccauguguucuaucagcugcucucuggugccucugaagagcuccucaauaaacuuaagcuugagagggauuucagcagguauaacuaccugagucuggauucggccaaagugaauggaguggaugaugcagcaaauuuuagaaccgugcggaaugccaugcagauugugggcuuuauggaucaugaagcugagucugucuuggcggugguggcagcaguguugaaacuggggaacauugaguucaagcccgaaucucgagugaauggucuagaugaaagcaaaaucaaagauaaaaaugaguuaaaagaaauuugugaauugaccggcauugaucaaucaguucuagaacgagcauucaguuuccgaacaguugaggccaaacaggagaaaguuucaacuacacugaauguggcucaggcuuauuaugcccgugaugcucuggcuaaaaaccucuacagcagguuguuuucaugguugguaaaucgaaucaaugaaagcauuaaggcacaaacaaaagugagaaagaaggucauggguguucuggacauuuauggcuuugagauuuucgaggacaacagcuuugagcaguucauuauuaauuauuguaacgaaaagcugcaacaaaucuucauugaacuuacucuuaaagaagagcaggaggaguauauacgggaggauauagaauggacucacauugacuacuucaauaaugcuaucauuugugaccuaauagaaaauaacacaaauggaauccuggccaugcuggaugaagagugccucagaccuggcacagucacugaugagaccuucuuagaaaagcugaaccaaguaugugccacccaccagcauuuugaaagcaggaugagcaagugcucucgguuccucaaugacacgucucugccucacagcugcuucaggauccagcauuaugcuggaaaggugcuguaccagguggaaggauucguugacaaaaacaaugaccuucucuaucgagaccugucccaagccauguggaaggccagccaugcccucaucaagucuuuguuccccgaagggaaucccgccaagaucaaccugaaaaggccuccuacagcaggcucacaguucaaggcauccguggccacucugaugaaaaaccuacagaccaagaacccaaacuauauuagguguaucaaaccgaaugauaaaaaagcagcacacaucuucaacgaggcucuagugugucaucagaucagguaccuggggcuuuuggagaacguccgagugcggagggcaggcuacgccuucaggcaggccuaugaaccuugccuagaaagauacaaaaugcuuuguaaacaaacauggccucauuggaaaggaccagccaggucugguguggagguccuauuuaaugaauuagaaauucccguggaagaauacuccuuugguagaucaaagauauucauccgaaacccaagaacauuauucaaauuagaagaccugaggaagcaacgccuggaggacuuggccacucucauucagaagauauaucggggguggaaaugccgcacacacuuccugcuaaugaaaaaaagccaaauugugauugccgccugguacaggagauaugcgcaacaaaagagguaccagcagacaaagaguuccgccuuaguaauucagucuuauauccgggguuggaaggcucgaaaaauucugcgggaacugaagcaucaaaagcgcuguaaggaagcagucacgaccauugcugcauauuggcaugggacccaggcacgaagggaacugagacggcugaaggaggaggcuaggaauaaacaugcuauugcaguuauuugggcuuacuggcuuggaucuaaggcucgaagggaauugaaacgcuugaaggaggaggcuaggcguaagcaugcaguugcugucauuugggcuuacuggcuuggacugaagguacguagagaauacaggaaauucuucagagccaaugcuggaaagaaaaucuaugaguuuacgcuucagagaauugugcaaaaauacuucuuggaaaugaaaaauaagaugccuuccuuaucuccaauagacaagaauuggcccucaagaccuuacuuauucuuggauucuacucacaaggagcuaaaaaggauuuuccacuuguggagguguaaaaaauacagggaccaauucacagaccagcagaaacuuauuuaugaagagaaacuagaagccagugaacucuucaaagacaagaaggcuuuauacccaucuaguguugggcaaccauuccaaggggcuuaccuggaaaucaacaagaaccccaaguauaagaaacucaaagaugccauugaagaaaagaucaucauugcugaagucgugaacaaaauuaaccgugcuaaugggaagaguacaucucggauuuuccucuuaacaaacaauaaucuccuucuugcugaccaaaagucuggacaaaucaagucagagguuccacugguggaugugaccaagguaucaaugagcucacaaaaugauggcuucuucgccguccaccucaaagagggcucagaagcagcuaguaaaggagacuuucucuucagcagugaucaccugauugaaauggccaccaagcucuaucgcacaacucucagccaaaccaaacagaagcucaauauugagauuuccgaugaguuccugguacaguucagacaggacaaaguaugugugaaguuuauucagggaaaccagaaaaaugggagugucccaacauguaaacgaaaaaacaaccgucuccuugaaguugcugucccuuaa

SEQ ID NO: 2801 - RNA, 3411 nt, Artificial Sequence
  derived and/or modified sequence opt1 from MYO1B__Homo_sapiens__AAH53558
auggccaagauggaggugaagaccagccugcucgacaacaugaucggcgucggggacauggugcugcuggagccccucaacgaggagaccuucaucaacaaccugaagaagcgcuucgaccacuccgagaucuacacguacaucggcagcguggucaucuccgugaaccccuaccggagccugcccaucuacucccccgagaagguggaggaguaccgcaaccggaacuucuacgagcucagcccccacaucuucgcccuguccgacgaggcguaccgcagccugcgggaccaggacaaggaccagugcauccucaucaccggggaguccggcgccgggaagaccgaggccagcaagcuggucauguccuacguggccgccgugugcggcaagggcgcggaggucaaccaggugaaggagcagcugcuccagagcaacccggugcuggaggccuucgggaacgccaagaccguccgcaacgacaacuccagccgguucggcaaguacauggacaucgaguucgacuucaagggggacccccugggcggggugaucuccaacuaccuccuggagaagucccgcguggucaagcagccccggggcgagcgcaacuuccacguguucuaccagcugcucagcggcgccagcgaggagcugcugaacaagcucaagcuggagcgggacuucucccgcuacaacuaccugagccucgacagcgcgaaggugaacggggucgacgacgccgccaacuuccggacggugcgcaacgccaugcagaucgugggcuucauggaccacgaggccgaguccguccuggcggugguggccgccguccugaagcucgggaacaucgaguucaagcccgagagccgggugaacggccuggacgaguccaagaucaaggacaagaacgagcugaaggagaucugcgagcucaccggcaucgaccagagcguccuggagcgcgccuucuccuuccggaccguggaggccaagcaggagaaggugagcaccacgcugaacgucgcgcaggccuacuacgcccgcgacgcccucgccaagaaccuguacucccggcuguucagcuggcucgugaaccgcaucaacgaguccaucaaggcgcagaccaaggugcggaagaaggucaugggggugcuggacaucuacggcuucgagaucuucgaggacaacagcuucgagcaguucaucaucaacuacugcaacgagaagcugcagcagaucuucaucgagcucacccugaaggaggagcaggaggaguacauccgcgaggacaucgaguggacccacaucgacuacuucaacaacgccaucaucugcgaccugaucgagaacaacacgaacgggauccucgccaugcuggacgaggagugccugcgcccgggcaccgugaccgacgagaccuuccucgagaagcugaaccaggucugcgccacgcaccagcacuucgagucccggaugagcaagugcucccgcuuccugaacgacaccagccucccccacuccugcuuccggauccagcacuacgccgggaaggugcuguaccagguggagggcuucgucgacaagaacaacgaccugcuguaccgcgaccucagccaggcgauguggaaggccucccacgcccugaucaagagccuguuccccgagggcaaccccgccaagaucaaccucaagcggccgcccaccgcggggucccaguucaaggccagcguggccacccugaugaagaaccugcagacgaagaaccccaacuacauccgcugcaucaagcccaacgacaagaaggccgcccacaucuucaacgaggcgcucgugugccaccagauccgguaccugggccugcucgagaacguccgcgugcggcgcgccggguacgccuuccggcaggccuacgagccgugccuggagcgcuacaagaugcugugcaagcagaccuggccccacuggaagggccccgcccggagcgggguggagguccucuucaacgagcuggagauccccguggaggaguacuccuucggccgcagcaagaucuucauccggaacccgcgcacccuguucaagcucgaggaccugcggaagcagcgccuggaggaccucgcgacccugauccagaagaucuaccggggcuggaagugccgcacgcacuuccugcucaugaagaagucccagaucgugaucgccgccugguaccgccgguacgcccagcagaagcgcuaccagcagaccaagagcuccgcccuggucauccagagcuacauccggggguggaaggcgcgcaagauccugcgggagcucaagcaccagaagcgcugcaaggaggccgugaccaccaucgccgccuacuggcacggcacgcaggcgcggcgcgagcugcggcgccugaaggaggaggcccggaacaagcacgccaucgccgugaucugggccuacuggcucggguccaaggcgcgccgggagcugaagcgccugaaggaggaggcccggcgcaagcacgccgucgccgugaucugggccuacuggcucggccugaaggugcggcgcgaguaccggaaguucuuccgcgcgaacgccgggaagaagaucuacgaguucacccugcagcggaucguccagaaguacuuccucgagaugaagaacaagaugcccagccugucccccaucgacaagaacuggcccagccgcccguaccuguuccucgacuccacccacaaggagcugaagcgcaucuuccaccuguggcggugcaagaaguaccgcgaccaguucaccgaccagcagaagcucaucuacgaggagaagcuggaggccagcgagcuguucaaggacaagaaggcccucuaccccuccagcgugggccagcccuuccagggcgccuaccuggagaucaacaagaaccccaaguacaagaagcugaaggacgcgaucgaggagaagaucaucaucgccgagguggucaacaagaucaaccgggccaacgggaaguccacgagccgcaucuuccuccugaccaacaacaaccugcuccuggccgaccagaaguccggccagaucaagagcgaggugccgcugguggacgucaccaaggugagcauguccagccagaacgacggguucuucgcggugcaccucaaggagggcuccgaggccgccagcaagggcgacuuccuguucuccagcgaccaccugaucgagauggccaccaagcucuaccggacgacccugucccagaccaagcagaagcugaacaucgagaucagcgacgaguuccucguccaguuccgccaggacaaggugugcgugaaguucauccaggggaaccagaagaacggcuccgucccgaccugcaagcggaagaacaaccgccugcuggagguggccgugcccuga

SEQ ID NO: 2802 - RNA, 3411 nt, Artificial Sequence
  derived and/or modified sequence opt2 from MYO1B__Homo_sapiens__AAH53558
auggccaagauggaggucaagaccucccuccucgacaacaugaucggcgucggcgacaugguccuccucgagccccucaacgaggagaccuucaucaacaaccucaagaagcgcuucgaccacuccgagaucuacaccuacaucggcuccgucgucaucuccgucaaccccuaccgcucccuccccaucuacucccccgagaaggucgaggaguaccgcaaccgcaacuucuacgagcucuccccccacaucuucgcccucuccgacgaggccuaccgcucccuccgcgaccaggacaaggaccagugcauccucaucaccggcgaguccggcgccggcaagaccgaggccuccaagcucgucauguccuacgucgccgccgucugcggcaagggcgccgaggucaaccaggucaaggagcagcuccuccaguccaaccccguccucgaggccuucggcaacgccaagaccguccgcaacgacaacuccucccgcuucggcaaguacauggacaucgaguucgacuucaagggcgacccccucggcggcgucaucuccaacuaccuccucgagaagucccgcgucgucaagcagccccgcggcgagcgcaacuuccacgucuucuaccagcuccucuccggcgccuccgaggagcuccucaacaagcucaagcucgagcgcgacuucucccgcuacaacuaccucucccucgacuccgccaaggucaacggcgucgacgacgccgccaacuuccgcaccguccgcaacgccaugcagaucgucggcuucauggaccacgaggccgaguccguccucgccgucgucgccgccguccucaagcucggcaacaucgaguucaagcccgagucccgcgucaacggccucgacgaguccaagaucaaggacaagaacgagcucaaggagaucugcgagcucaccggcaucgaccaguccguccucgagcgcgccuucuccuuccgcaccgucgaggccaagcaggagaaggucuccaccacccucaacgucgcccaggccuacuacgcccgcgacgcccucgccaagaaccucuacucccgccucuucuccuggcucgucaaccgcaucaacgaguccaucaaggcccagaccaagguccgcaagaaggucaugggcguccucgacaucuacggcuucgagaucuucgaggacaacuccuucgagcaguucaucaucaacuacugcaacgagaagcuccagcagaucuucaucgagcucacccucaaggaggagcaggaggaguacauccgcgaggacaucgaguggacccacaucgacuacuucaacaacgccaucaucugcgaccucaucgagaacaacaccaacggcauccucgccaugcucgacgaggagugccuccgccccggcaccgucaccgacgagaccuuccucgagaagcucaaccaggucugcgccacccaccagcacuucgagucccgcauguccaagugcucccgcuuccucaacgacaccucccucccccacuccugcuuccgcauccagcacuacgccggcaagguccucuaccaggucgagggcuucgucgacaagaacaacgaccuccucuaccgcgaccucucccaggccauguggaaggccucccacgcccucaucaagucccucuuccccgagggcaaccccgccaagaucaaccucaagcgcccccccaccgccggcucccaguucaaggccuccgucgccacccucaugaagaaccuccagaccaagaaccccaacuacauccgcugcaucaagcccaacgacaagaaggccgcccacaucuucaacgaggcccucgucugccaccagauccgcuaccucggccuccucgagaacguccgcguccgccgcgccggcuacgccuuccgccaggccuacgagcccugccucgagcgcuacaagaugcucugcaagcagaccuggccccacuggaagggccccgcccgcuccggcgucgagguccucuucaacgagcucgagauccccgucgaggaguacuccuucggccgcuccaagaucuucauccgcaacccccgcacccucuucaagcucgaggaccuccgcaagcagcgccucgaggaccucgccacccucauccagaagaucuaccgcggcuggaagugccgcacccacuuccuccucaugaagaagucccagaucgucaucgccgccugguaccgccgcuacgcccagcagaagcgcuaccagcagaccaaguccuccgcccucgucauccaguccuacauccgcggcuggaaggcccgcaagauccuccgcgagcucaagcaccagaagcgcugcaaggaggccgucaccaccaucgccgccuacuggcacggcacccaggcccgccgcgagcuccgccgccucaaggaggaggcccgcaacaagcacgccaucgccgucaucugggccuacuggcucggcuccaaggcccgccgcgagcucaagcgccucaaggaggaggcccgccgcaagcacgccgucgccgucaucugggccuacuggcucggccucaagguccgccgcgaguaccgcaaguucuuccgcgccaacgccggcaagaagaucuacgaguucacccuccagcgcaucguccagaaguacuuccucgagaugaagaacaagaugcccucccucucccccaucgacaagaacuggcccucccgccccuaccucuuccucgacuccacccacaaggagcucaagcgcaucuuccaccucuggcgcugcaagaaguaccgcgaccaguucaccgaccagcagaagcucaucuacgaggagaagcucgaggccuccgagcucuucaaggacaagaaggcccucuaccccuccuccgucggccagcccuuccagggcgccuaccucgagaucaacaagaaccccaaguacaagaagcucaaggacgccaucgaggagaagaucaucaucgccgaggucgucaacaagaucaaccgcgccaacggcaaguccaccucccgcaucuuccuccucaccaacaacaaccuccuccucgccgaccagaaguccggccagaucaaguccgaggucccccucgucgacgucaccaaggucuccauguccucccagaacgacggcuucuucgccguccaccucaaggagggcuccgaggccgccuccaagggcgacuuccucuucuccuccgaccaccucaucgagauggccaccaagcucuaccgcaccacccucucccagaccaagcagaagcucaacaucgagaucuccgacgaguuccucguccaguuccgccaggacaaggucugcgucaaguucauccagggcaaccagaagaacggcuccguccccaccugcaagcgcaagaacaaccgccuccucgaggucgccguccccuga

SEQ ID NO: 2803 - RNA, 3411 nt, Artificial Sequence
  derived and/or modified sequence opt3 from MYO1B__Homo_sapiens__AAH53558
auggccaagauggaggugaaaaccagccugcucgacaacaugaucggcgucggggauaugguucuucuggaacccuugaaugaggaaacauucauuaacaauuuaaagaaaagauuugaccacuccgagauauacacuuauaucggaucugugguaauuucagugaacccuuacaggagucugccaaucuauagcccggaaaaggucgaggaguaccggaaucgcaacuucuaugaacuaaguccccauauuuuugcucucucugaugaggcauaccgaucgcugcgugaccaggauaaagaccaaugcauccuuauaacgggugaaucaggcgccgggaagaccgaggcgagcaagcuggugaugaguuauguugcugccguguguggaaaaggcgcagaggucaaucaggugaaggaacaguugcuccaguccaacccuguacuggaggccuucgguaaugcuaaaacaguuagaaacgauaauucuagcagguuugggaaguacauggacaucgaguucgauuuuaaaggagacccacugggcggcgugauuuccaacuaccucuuagaaaagucacgggucgugaagcaaccccgcggggaaagaaauuuccacguguuuuaucagcugcuuaguggagcaagcgaggaguugcugaacaaacuaaagcucgaaagggauuucucucgguacaauuaucugucccuugacucagccaaagucaacgguguugaugacgcugccaacuuucgcacugugcgaaaugcgaugcagaucguaggcuucauggaccaugaggcagaaagcgugcuggccgucguggcugccguuuugaagcucgggaacauugaguuuaaaccugaaaguagagugaauggacuggaugagucuaagaucaaagacaagaacgaguuaaaggaaauaugcgagcugaccggcauugaucaguccguccucgaaagggcauucagcuuccggacaguggaggcuaaacaagaaaagguaucgaccacucuuaauguugcccaggcguacuaugcccgugacgcacuggcuaaaaacuuguacucucgccuauuuuccuggcuggugaauagaaucaacgagucaauuaaggcccagacaaaagucaggaagaaggugauggguguccucgauaucuauggguucgagaucuuugaagacaauaguuucgagcaguuuauuauaaacuacuguaaugaaaaacugcaacagaucuucauugagcuuacccugaaggaggaacaggaggaauacauccgggaggauauagaauggacgcacauugacuauuuuaacaaugcuaucaucugcgauuugauugagaacaauacuaacggaauccucgccaugcuggacgaggaauguuuacgaccaggcaccgugacagaugagacuuuccuggaaaaacuaaaccaaguuugcgcaacccaucagcacuuugagagccgcauguccaaguguucuagauuccucaaugacacaagccugccccacucaugcuuuaggauucagcauuacgccggcaaagugcuuuaucagguagaaggguucgucgacaagaacaaugauuugcuguaccgggaccucagucaagcuauguggaaggcgucccacgcacugauaaaaagccuuuuuccugagggaaacccagccaagaucaaucugaaacgcccgcccaccgcugguucucaguucaaggccucaguggcaacguugaugaaaaaccuccagacuaagaauccuaacuauauuagauguaucaagccaaaugauaaaaaggccgcucauaucuucaacgaggcccugguuugccaccagauuagguacuuaggccugcuagaaaaugugcguguccggcgagcaggguaugcguuuagacaggcuuacgagcccugucucgaaagguacaaaaugcugugcaagcaaacauggccucacuggaaaggaccagcccgcaguggcguggagguacuuuucaacgaauuggagauacccguggaggaauauagcuuuggucgguccaagaucuucauuagaaauccgaggacccuguuuaaacucgaggaccugcgcaagcagcgauuagaagaucuggcaacucuuauccagaagauuuaccggggguggaaaugccguacacauuucuugcucaugaagaaaucucaaaucguuauagccgcuugguauagaagguacgcccagcagaagcgcuaucagcaaaccaaaucgagcgcacuggucauccaguccuacauucggggcuggaaggcuagaaagauccuaagggagcugaaacaccagaagcgauguaaagaggccgugacgaccauugcggccuauuggcauggaacacaagcucgccgggaacucagaaggcugaaggaggaagcacguaacaaacacgccaucgcugugauaugggccuacuggcuuggcucaaaggcacgccgggaguugaagagacugaaagaagaggcgaggcgaaagcaugccgucgcuguuauuugggccuacugguuagggcucaaagugcggcgcgaguauagaaaguuuuucagggcaaaugcugguaaaaagaucuacgaauuuacucugcagcggauugugcagaaguauuuccuugagaugaaaaacaagaugccuagucugucucccaucgacaaaaacuggccaagccgaccuuacuuguuucucgauuccacccacaaggaacugaaaagaauauuccaccuauggcgcugcaagaaauauagggaccaguuuacagaucaacagaagcugaucuacgaggaaaagcucgaggccucagagcuguucaaagacaagaaagcacuuuaucccagcucuguaggacagccauuccagggcgccuacuuggaaauuaauaagaaccccaaauacaagaagcugaaagaugcuaucgaggaaaagauuaucauagcggaggucgugaauaaaauuaaccgugccaaugggaaguccacuucccggaucuuuuuacucaccaacaauaaccugcuucuggcagaccagaaaagcggacaaaucaagucugaaguuccucuaguggaugucacaaagguguccaugucaagucagaaugacggcuucuuugcuguucaucucaaagaggguagcgaggccgccucgaagggggacuuccuguuuuccucugaucacuugauugaaauggcuaccaaacuguauagaacuacguuaagccagacaaagcaaaaacucaacaucgagauuucagacgaguuccuggugcaguuuaggcaggauaagguaugugucaaguucauacaaggcaaucagaaaaacggaagugugccaaccugcaagcgcaaaaauaaccgacuucuggaaguggcagucccguga

SEQ ID NO: 2804 - RNA, 3411 nt, Artificial Sequence
  derived and/or modified sequence opt4 from MYO1B__Homo_sapiens__AAH53558
auggccaagauggaggugaagaccagccugcuggacaacaugaucggcgugggcgacauggugcugcuggagccccugaacgaggagaccuucaucaacaaccugaagaagagauucgaccacagcgagaucuacaccuacaucggcagcguggugaucagcgugaaccccuacagaagccugcccaucuacagccccgagaagguggaggaguacagaaacagaaacuucuacgagcugagcccccacaucuucgcccugagcgacgaggccuacagaagccugagagaccaggacaaggaccagugcauccugaucaccggcgagagcggcgccggcaagaccgaggccagcaagcuggugaugagcuacguggccgccgugugcggcaagggcgccgaggugaaccaggugaaggagcagcugcugcagagcaaccccgugcuggaggccuucggcaacgccaagaccgugagaaacgacaacagcagcagauucggcaaguacauggacaucgaguucgacuucaagggcgacccccugggcggcgugaucagcaacuaccugcuggagaagagcagaguggugaagcagcccagaggcgagagaaacuuccacguguucuaccagcugcugagcggcgccagcgaggagcugcugaacaagcugaagcuggagagagacuucagcagauacaacuaccugagccuggacagcgccaaggugaacggcguggacgacgccgccaacuucagaaccgugagaaacgccaugcagaucgugggcuucauggaccacgaggccgagagcgugcuggccgugguggccgccgugcugaagcugggcaacaucgaguucaagcccgagagcagagugaacggccuggacgagagcaagaucaaggacaagaacgagcugaaggagaucugcgagcugaccggcaucgaccagagcgugcuggagagagccuucagcuucagaaccguggaggccaagcaggagaaggugagcaccacccugaacguggcccaggccuacuacgccagagacgcccuggccaagaaccuguacagcagacuguucagcuggcuggugaacagaaucaacgagagcaucaaggcccagaccaaggugagaaagaaggugaugggcgugcuggacaucuacggcuucgagaucuucgaggacaacagcuucgagcaguucaucaucaacuacugcaacgagaagcugcagcagaucuucaucgagcugacccugaaggaggagcaggaggaguacaucagagaggacaucgaguggacccacaucgacuacuucaacaacgccaucaucugcgaccugaucgagaacaacaccaacggcauccuggccaugcuggacgaggagugccugagacccggcaccgugaccgacgagaccuuccuggagaagcugaaccaggugugcgccacccaccagcacuucgagagcagaaugagcaagugcagcagauuccugaacgacaccagccugccccacagcugcuucagaauccagcacuacgccggcaaggugcuguaccagguggagggcuucguggacaagaacaacgaccugcuguacagagaccugagccaggccauguggaaggccagccacgcccugaucaagagccuguuccccgagggcaaccccgccaagaucaaccugaagagaccccccaccgccggcagccaguucaaggccagcguggccacccugaugaagaaccugcagaccaagaaccccaacuacaucagaugcaucaagcccaacgacaagaaggccgcccacaucuucaacgaggcccuggugugccaccagaucagauaccugggccugcuggagaacgugagagugagaagagccggcuacgccuucagacaggccuacgagcccugccuggagagauacaagaugcugugcaagcagaccuggccccacuggaagggccccgccagaagcggcguggaggugcuguucaacgagcuggagauccccguggaggaguacagcuucggcagaagcaagaucuucaucagaaaccccagaacccuguucaagcuggaggaccugagaaagcagagacuggaggaccuggccacccugauccagaagaucuacagaggcuggaagugcagaacccacuuccugcugaugaagaagagccagaucgugaucgccgccugguacagaagauacgcccagcagaagagauaccagcagaccaagagcagcgcccuggugauccagagcuacaucagaggcuggaaggccagaaagauccugagagagcugaagcaccagaagagaugcaaggaggccgugaccaccaucgccgccuacuggcacggcacccaggccagaagagagcugagaagacugaaggaggaggccagaaacaagcacgccaucgccgugaucugggccuacuggcugggcagcaaggccagaagagagcugaagagacugaaggaggaggccagaagaaagcacgccguggccgugaucugggccuacuggcugggccugaaggugagaagagaguacagaaaguucuucagagccaacgccggcaagaagaucuacgaguucacccugcagagaaucgugcagaaguacuuccuggagaugaagaacaagaugcccagccugagccccaucgacaagaacuggcccagcagacccuaccuguuccuggacagcacccacaaggagcugaagagaaucuuccaccuguggagaugcaagaaguacagagaccaguucaccgaccagcagaagcugaucuacgaggagaagcuggaggccagcgagcuguucaaggacaagaaggcccuguaccccagcagcgugggccagcccuuccagggcgccuaccuggagaucaacaagaaccccaaguacaagaagcugaaggacgccaucgaggagaagaucaucaucgccgagguggugaacaagaucaacagagccaacggcaagagcaccagcagaaucuuccugcugaccaacaacaaccugcugcuggccgaccagaagagcggccagaucaagagcgaggugccccugguggacgugaccaaggugagcaugagcagccagaacgacggcuucuucgccgugcaccugaaggagggcagcgaggccgccagcaagggcgacuuccuguucagcagcgaccaccugaucgagauggccaccaagcuguacagaaccacccugagccagaccaagcagaagcugaacaucgagaucagcgacgaguuccuggugcaguucagacaggacaaggugugcgugaaguucauccagggcaaccagaagaacggcagcgugcccaccugcaagagaaagaacaacagacugcuggagguggccgugcccuga

SEQ ID NO: 2805 - RNA, 3411 nt, Artificial Sequence
  derived and/or modified sequence opt5 from MYO1B__Homo_sapiens__AAH53558
auggccaagauggaggugaaaaccagccugcucgacaacaugaucggcgucggggauaugguucugcuugaaccccugaaugaggaaacauucauuaacaaucucaagaaaagauuugaccacuccgagaucuacacguauauuggaucuguggugaucagcgucaacccuuaccggucccugccgauuuauucucccgaaaagguggaggaguaccgcaauagaaacuucuaugaacuuagcccucauaucuuugcucuguccgaugaggccuaccggucucuccgcgaccaggauaaagaccaaugcauccugauuaccggcgaaagcggggcgggaaagacagaggcuuccaagcugguuaugagcuauguggccgccgucuguggcaaaggggcugaggugaaucagguuaaggaacagcuccugcagucuaaccccgugcuugaggccuucggaaaugcuaaaaccgucagaaacgauaauuccagccgguuuggcaaguacauggacaucgaauuugauuuuaaaggcgacccucuugggggagugauuucuaacuaccuccuggagaagucccgcguggucaagcaacccagaggcgaacggaauuuccacguuuucuaucagcuucugagcggggccucugaggagcuccugaacaaacugaagcucgaacgcgauuucuccagauacaauuaucugagccuugacuccgcgaaagugaacggaguggaugacgccgcuaacuuucggacaguccgcaaugccaugcagaucgugggcuucauggaccaugaggcugaaucuguucuggccguggucgcggccgugcucaagcuggggaacauugaguuuaaaccugaaagcagaguuaauggacuugaugaguccaagaucaaagacaagaacgagcugaaggaaauuugcgagcucaccggcaucgaucagagcgugcuggaacgggcuuucucuuuccgcacagucgaggccaaacaagaaaagguguccaccacgcugaaugucgcucaggccuacuaugccagagacgcucucgcgaaaaaccuguacagccggcuguuuucuuggcuggugaauagaaucaacgagagcauuaaggcccagaccaaaguucgcaagaaggugaugggcguccucgauaucuauggguucgagauuuuugaagacaauuccuucgagcaguuuaucauuaacuacuguaaugaaaaacugcaacagaucuucaucgagcuuacacugaaggaggaacaggaggaauacauucgggaggauaucgaauggacccacauugacuauuuuaacaaugcuaucauuugcgaucucaucgagaacaauacaaacggaauccuggccaugcuggacgaggaaugucucagaccgggcaccgugacggaugagacauuccuggaaaaacuuaaccaaguuugcgccacccaucagcacuuugagucucgcaugagcaaguguucccgguuccugaaugacacaagccucccccacucuugcuuucgcauucagcauuacgcugggaaagugcuguaucaggucgaaggauucguggacaagaacaaugaucugcuuuacagagaccucucccaagccauguggaaggcgagccacgcucugaucaaaucucuguuuccugagggcaaccccgccaagauuaaucucaaacggccucccaccgccgggucccaguucaaggcuagcguggccacccugaugaaaaaccuucagacaaagaauccgaacuauaucagauguauuaagccuaaugauaaaaaggcugcccauaucuucaacgaggcgcugguuugccaccagauucgcuaccucggacugcuggaaaauguccgggugagacgcgccggcuaugcuuuucggcaagccuacgagcccugucuugaaagauacaaaaugcucugcaagcagacguggccucacuggaaaggccccgcucgguccgggguggagguccuguucaacgaacuggagauccccguggaggaauauucuuuuggacgcagcaagaucuucauuagaaauccucggacccucuuuaaacuggaggaccuuagaaagcagcgccuggaagaucucgccacacugauccagaagauuuaccggggcuggaaaugcagaacccauuuccugcuuaugaagaaaucccaaaucguuauugcggccugguaucgcagauacgcucagcagaagcgguaucagcaaacaaaaucuagcgcccucgugauccaguccuacauccgcggguggaaggcuagaaagauucugcgggagcugaaacaccagaagcgcuguaaagaggccgucaccacgaucgccgcuuauuggcauggaacacaagcgagacgggaacuccgcagacugaaggaggaagcccggaacaaacacgcuauugccgugaucugggccuacuggcuuggcagcaaggcucgcagagagcugaagcggcucaaagaagaggccagacgcaagcaugcgguugcugugauuugggccuacuggcuggggcugaaaguccggagagaguaucgcaaguuuuuccgggccaaugcuggcaaaaagaucuacgaauuuacccuucagagaaucgugcagaaguauuuccucgagaugaaaaacaagaugccgucucugucccccauugacaaaaacuggccuagccgccccuaccuguuucucgauucuacccacaaggaacugaaacggaucuuccaccuuuggagaugcaagaaauaucgcgaccaguuuacagaucaacagaagcugauuuacgaggaaaagcucgaggccuccgagcuguucaaagacaagaaagcgcuguauccuagcucuguuggacagcccuuccagggcgcuuaccuugaaaucaauaagaacccgaaauacaagaagcugaaagaugccauugaggaaaagaucaucauugccgagguggucaauaaaaucaaccgggcuaauggaaagagcaccuccagaauuuuucuccugacaaacaauaaccuccugcuugccgaccagaaaagcgggcaaaucaagucugaagugccucugguggaugucacgaagguuuccaugagcucccagaaugacggcuucuuugcugugcaucucaaagaggggucugaggccgcgagcaagggagacuuccuguuuuccucugaucaccugauugaaauggccaccaaacuuuaucggacaacccugagccagacaaagcaaaaacucaacaucgagauuuccgacgaguuccuggugcaguuucgccaggauaaggucugugugaaguucauccaaggcaaucagaaaaacgggucuguuccuaccugcaagcggaaaaauaacagacuccuggaaguggcuguccccuga

SEQ ID NO: 2806 - protein, 1063 aa, Artificial Sequence
  MYO1C__Homo_sapiens__O00159
MALQVELVPTGEIIRVVHPHRPCKLALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 2807 - RNA, 3192 nt, Artificial Sequence
  MYO1C__Homo_sapiens__CCDS42226.1
auggcgcugcaaguggagcugguacccaccggggagaucauccgcgugguucauccccacaggcccugcaagcuugcccugggcagugacgggguucgggugaccauggagagugcgcucaccgcccgugaccgggugggggugcaggauuucgugcugcuggagaacuucaccagcgaggccgccuucaucgagaaccugcggcggcgauuucgggagaaucucaucuacaccuacauuggccccguccuggucucugucaaucccuaccgggaccugcagaucuacagccggcagcauauggagcguuaccguggcgucagcuucuaugaagugcccccucaccuguuugccguggcggacacuguguaccgagcacugcgcacggagcgucgggaccaggcugugaugaucucuggggagagcggggcaggcaagaccgaggccaccaagaggcugcugcaguucuaugcagagaccugcccagcccccgagcgcggaggugccgugcgggaccggcugcuacagagcaacccggugcuggaggccuuuggaaaugccaagacccuccggaacgauaacuccagcagguucgggaaguacauggaugugcaguuugacuucaagggugcccccguggguggccacauccucaguuaccuccuggaaaagucacgaguggugcaccagaaucauggggagcggaacuuccacaucuucuaccagcugcuggaggggggcgaggaggagacucuucgcaggcugggcuuggaacggaacccccagagcuaccuguaccuggugaagggccagugugccaaagucuccuccaucaacgacaagagugacuggaaggucgucaggaaggcucugacagucauugauuucaccgaggaugaaguggaggaccugcugagcaucguggccagcguccuucauuugggcaacauccacuuugcugccaacgaggagagcaaugcccaggucaccaccgagaaccagcucaaguaucugaccaggcuccucagcguggaaggcucgacgcugcgagaagcccugacacacaggaagaucaucgccaagggggaggagcuccugagcccgcugaaccuggagcaggccgcguacgcacgagacgcccucgccaaggcuguguacagccgcacuuuuaccuggcucgucgggaagaucaacaggucgcuggccuccaaggacguggagagccccagcuggcggagcaccacgguucucgggcuccuggauauuuauggcuuugaaguguuucagcauaacagcuuugagcaguucugcaucaauuacugcaacgagaagcugcagcagcucuucaucgagcucacgcucaagucggagcaggaggaguacgaggcagagggcaucgcgugggagcccguccaguauuucaacaacaaaaucaucugugaucugguggaggagaaguuuaagggcaucaucucgauuuuggaugaggagugucugcgccccggggaggccacagaccugaccuuccuggagaagcuggaggauacugucaagcaccauccacacuuccugacgcacaagcuggcugaccagcggaccaggaaaucucugggccgaggggaauuccgccuucugcacuaugcgggggaggugaccuacagcgugaccggguuucuggacaaaaacaaugaccuucucuuccggaaccuuaaggagaccauguguagcucaaagaaucccauuaugagccagugcuuugaccggagcgagcucagugacaagaagcggccagagacggucgccacccaguucaagaugagccuccugcagcugguggagauccugcagucuaaggagcccgccuacguccgcugcaucaaacccaaugaugccaaacagcccggccgcuuugacgaggugcugauccgccaccaggugaaguaccuggggcuguuggaaaaccugcgcgugcgcagagccggcuuugccuaucgccgcaaauacgaagcuuuccugcaaagguacaagucacugugcccagagacguggcccacgugggcaggacggccgcaggaugggguggcugugcugguccgacaccugggcuacaagccagaagaguacaagaugggcaggaccaagaucuucauccgcuuccccaagacccuguuugccacagaggaugcccuggagguccggcggcagagccuggccacaaagauccaagcugccuggaggggcuuucacuggcggcagaaauuccuccgggugaagagaucagccaucugcauccagucgugguggcguggaacacugggccggaggaaggcagccaagaggaagugggcggcacagaccauccggcggcucauccgaggcuucguccugcgccacgccccccgcugccccgagaacgccuucuuccuggaccaugugcgcaccucuuuuuugcuaaaccugaggcggcagcugccccagaauguccuggacaccucguggcccacgcccccaccugcccugcgugaggccucagagcuucugcgggaguugugcauaaagaacaugguguggaaauacugccggaguaucagcccugaguggaagcagcagcugcagcagaaggccguggcuagugagaucuucaagggcaagaaggauaauuacccucagaguguacccaggcucuucaucagcacucggcuugguacagaugagaucagcccccgagugcugcaggccuugggcucugagcccauucaguaugcggugccuguugugaaauacgaccgcaagggcuacaagccucgcucccggcagcugcugcucacgcccaacgccgucgucaucguggaggacgccaaagucaagcagaggauugauuacgccaaccugaccggaaucucugucagcagccugagcgacagucuuuuugugcuucauguacagcgugcggacaauaagcaaaagggagauguggugcugcagagugaccacgugauugagacgcugaccaagacagcccucagugccaaccgcgugaacagcaucaacaucaaccagggcagcaucacguuugcagggggccccggcagggauggcaccauugacuucacacccggcucggagcugcucaucaccaaggccaagaacgggcaccuggcuguggucgccccacggcugaauucucgguga

SEQ ID NO: 2808 - RNA, 3192 nt, Artificial Sequence
  derived and/or modified sequence opt1 from MYO1C__Homo_sapiens__CCDS42226.1
auggcccuccagguggagcucguccccaccggcgagaucauccgcguggugcacccgcaccggcccugcaagcuggcccuggggagcgacggcguccgcgugaccauggaguccgcgcucacggcccgggaccgcguggggguccaggacuucgugcugcuggagaacuucaccagcgaggccgccuucaucgagaaccuccggcgccgguuccgcgagaaccugaucuacaccuacaucggccccgugcuggucuccgugaaccccuaccgggaccuccagaucuacagccgccagcacauggagcgguaccgcgggguguccuucuacgaggucccgccccaccuguucgccguggcggacaccguguaccgggcccugcgcacggagcggcgcgaccaggccgucaugaucagcggcgaguccggcgccgggaagaccgaggcgaccaagcggcuccugcaguucuacgccgagaccugccccgcccccgagcgcggcggggccgugcgggaccgccugcuccagagcaacccggugcuggaggccuucggcaacgcgaagacgcugcggaacgacaacuccagccgcuucgggaaguacauggacguccaguucgacuucaagggcgcccccgugggcgggcacauccucuccuaccugcuggagaagucccgcgugguccaccagaaccacggcgagcggaacuuccacaucuucuaccagcuccuggagggcggggaggaggagacccugcgccggcucggccuggagcgcaacccccaguccuaccuguaccucgugaaggggcagugcgccaaggugagcuccaucaacgacaagagcgacuggaaggucgugcggaaggcccugaccgucaucgacuucaccgaggacgagguggaggaccugcucuccaucguggccagcguccugcaccugggcaacauccacuucgcggccaacgaggaguccaacgcccaggugacgaccgagaaccagcucaaguaccugacccgccugcucagcguggaggggagcacccugcgggaggcccugacgcaccgcaagaucaucgccaagggcgaggagcuccugagcccccugaaccucgagcaggcggccuacgcccgggacgcccuggccaaggcggucuacagccgcaccuucaccuggcugguggggaagaucaaccggucccucgccagcaaggacguggaguccccgagcuggcgcuccaccacgguccugggccugcucgacaucuacggcuucgagguguuccagcacaacagcuucgagcaguucugcaucaacuacugcaacgagaagcugcagcagcuguucaucgagcugacccucaaguccgagcaggaggaguacgaggccgaggggaucgccugggagcccgugcaguacuucaacaacaagaucaucugcgaccuggucgaggagaaguucaagggcaucaucagcauccuggacgaggagugccuccggcccggggaggcgaccgaccugaccuuccuggagaagcucgaggacacggugaagcaccacccccacuuccugacccacaagcuggccgaccagcgcacccggaagucccucggccgcggggaguuccggcugcugcacuacgccggcgaggugaccuacagcgucacgggcuuccucgacaagaacaacgaccugcuguuccgcaaccucaaggagaccaugugcuccagcaagaacccgaucaugucccagugcuucgaccggagcgagcuguccgacaagaagcgccccgagaccguggccacccaguucaagaugagccugcuccagcugguggagauccugcaguccaaggagcccgccuacguccgcugcaucaagcccaacgacgcgaagcagccggggcgguucgacgaggugcucauccgccaccaggugaaguaccugggccugcucgagaaccugcggguccgccgggccggguucgccuaccgccggaaguacgaggccuuccugcagcgcuacaagagccucugccccgagacguggcccaccugggccggccggccccaggacgggguggcggugcugguccgccaccugggcuacaagccggaggaguacaagaugggccggaccaagaucuucauccgcuuccccaagacccucuucgccacggaggacgcccuggaggugcggcgccagagccuggccaccaagauccaggccgcguggcggggguuccacuggcgccagaaguuccuccgggugaagcgcuccgccaucugcauccagagcugguggcggggcacccuggggcgccggaaggccgccaagcgcaagugggcggcccagaccauccgccggcugauccgcggcuucguccuccggcacgcgccccgcugccccgagaacgccuucuuccuggaccacgugcggaccuccuuccugcucaaccugcgccggcagcugccgcagaacgugcucgacacgagcuggcccacgcccccgcccgcccugcgcgaggccuccgagcugcuccgggagcugugcaucaagaacauggucuggaaguacugccgcagcaucucccccgaguggaagcagcagcugcagcagaaggccguggccagcgagaucuucaagggcaagaaggacaacuacccccaguccgugccgcggcuguucaucagcacccgccuggggaccgacgagaucagcccccggguccugcaggcccucggcuccgagcccauccaguacgccgugcccguggucaaguacgaccgcaagggguacaagccgcggucccgccagcugcugcucacccccaacgcgguggugaucgucgaggacgccaaggugaagcagcggaucgacuacgccaaccugaccggcaucagcguguccagccuguccgacagccucuucguccugcacgugcagcgcgccgacaacaagcagaagggggacgugguccugcagagcgaccacgugaucgagacccucaccaagacggcccuguccgcgaaccgggugaacagcaucaacaucaaccagggcuccaucaccuucgccggcgggcccggccgcgacgggaccaucgacuucacccccggcagcgagcugcucaucacgaaggccaagaacgggcaccuggccgucguggcgccgcgccugaacucccgguga

SEQ ID NO: 2809 - RNA, 3192 nt, Artificial Sequence
  derived and/or modified sequence opt2 from MYO1C__Homo_sapiens__CCDS42226.1
auggcccuccaggucgagcucguccccaccggcgagaucauccgcgucguccacccccaccgccccugcaagcucgcccucggcuccgacggcguccgcgucaccauggaguccgcccucaccgcccgcgaccgcgucggcguccaggacuucguccuccucgagaacuucaccuccgaggccgccuucaucgagaaccuccgccgccgcuuccgcgagaaccucaucuacaccuacaucggccccguccucgucuccgucaaccccuaccgcgaccuccagaucuacucccgccagcacauggagcgcuaccgcggcgucuccuucuacgagguccccccccaccucuucgccgucgccgacaccgucuaccgcgcccuccgcaccgagcgccgcgaccaggccgucaugaucuccggcgaguccggcgccggcaagaccgaggccaccaagcgccuccuccaguucuacgccgagaccugccccgcccccgagcgcggcggcgccguccgcgaccgccuccuccaguccaaccccguccucgaggccuucggcaacgccaagacccuccgcaacgacaacuccucccgcuucggcaaguacauggacguccaguucgacuucaagggcgcccccgucggcggccacauccucuccuaccuccucgagaagucccgcgucguccaccagaaccacggcgagcgcaacuuccacaucuucuaccagcuccucgagggcggcgaggaggagacccuccgccgccucggccucgagcgcaacccccaguccuaccucuaccucgucaagggccagugcgccaaggucuccuccaucaacgacaaguccgacuggaaggucguccgcaaggcccucaccgucaucgacuucaccgaggacgaggucgaggaccuccucuccaucgucgccuccguccuccaccucggcaacauccacuucgccgccaacgaggaguccaacgcccaggucaccaccgagaaccagcucaaguaccucacccgccuccucuccgucgagggcuccacccuccgcgaggcccucacccaccgcaagaucaucgccaagggcgaggagcuccucuccccccucaaccucgagcaggccgccuacgcccgcgacgcccucgccaaggccgucuacucccgcaccuucaccuggcucgucggcaagaucaaccgcucccucgccuccaaggacgucgagucccccuccuggcgcuccaccaccguccucggccuccucgacaucuacggcuucgaggucuuccagcacaacuccuucgagcaguucugcaucaacuacugcaacgagaagcuccagcagcucuucaucgagcucacccucaaguccgagcaggaggaguacgaggccgagggcaucgccugggagcccguccaguacuucaacaacaagaucaucugcgaccucgucgaggagaaguucaagggcaucaucuccauccucgacgaggagugccuccgccccggcgaggccaccgaccucaccuuccucgagaagcucgaggacaccgucaagcaccacccccacuuccucacccacaagcucgccgaccagcgcacccgcaagucccucggccgcggcgaguuccgccuccuccacuacgccggcgaggucaccuacuccgucaccggcuuccucgacaagaacaacgaccuccucuuccgcaaccucaaggagaccaugugcuccuccaagaaccccaucaugucccagugcuucgaccgcuccgagcucuccgacaagaagcgccccgagaccgucgccacccaguucaagaugucccuccuccagcucgucgagauccuccaguccaaggagcccgccuacguccgcugcaucaagcccaacgacgccaagcagcccggccgcuucgacgagguccucauccgccaccaggucaaguaccucggccuccucgagaaccuccgcguccgccgcgccggcuucgccuaccgccgcaaguacgaggccuuccuccagcgcuacaagucccucugccccgagaccuggcccaccugggccggccgcccccaggacggcgucgccguccucguccgccaccucggcuacaagcccgaggaguacaagaugggccgcaccaagaucuucauccgcuuccccaagacccucuucgccaccgaggacgcccucgagguccgccgccagucccucgccaccaagauccaggccgccuggcgcggcuuccacuggcgccagaaguuccuccgcgucaagcgcuccgccaucugcauccaguccugguggcgcggcacccucggccgccgcaaggccgccaagcgcaagugggccgcccagaccauccgccgccucauccgcggcuucguccuccgccacgccccccgcugccccgagaacgccuucuuccucgaccacguccgcaccuccuuccuccucaaccuccgccgccagcucccccagaacguccucgacaccuccuggcccacccccccccccgcccuccgcgaggccuccgagcuccuccgcgagcucugcaucaagaacauggucuggaaguacugccgcuccaucucccccgaguggaagcagcagcuccagcagaaggccgucgccuccgagaucuucaagggcaagaaggacaacuacccccaguccgucccccgccucuucaucuccacccgccucggcaccgacgagaucuccccccgcguccuccaggcccucggcuccgagcccauccaguacgccguccccgucgucaaguacgaccgcaagggcuacaagccccgcucccgccagcuccuccucacccccaacgccgucgucaucgucgaggacgccaaggucaagcagcgcaucgacuacgccaaccucaccggcaucuccgucuccucccucuccgacucccucuucguccuccacguccagcgcgccgacaacaagcagaagggcgacgucguccuccaguccgaccacgucaucgagacccucaccaagaccgcccucuccgccaaccgcgucaacuccaucaacaucaaccagggcuccaucaccuucgccggcggccccggccgcgacggcaccaucgacuucacccccggcuccgagcuccucaucaccaaggccaagaacggccaccucgccgucgucgccccccgccucaacucccgcuga

SEQ ID NO: 2810 - RNA, 3192 nt, Artificial Sequence
  derived and/or modified sequence opt3 from MYO1C__Homo_sapiens__CCDS42226.1
auggcccuucagguggagcucguccccaccggcgaaaucauuagaguugugcacccucauaggccaugcaagcuggcucuggggagcgacggaguacgggugacaauggaguccgcauugacugcccgcgaucgagucggugugcaagacuucguuuuacuggaaaacuuuacgucugaggcggcuuucauagaaaaucuacguagaagguuucgggagaaccucaucuacaccuauauuggcccggugcuggucucagugaaucccuaccgcgaucuucagaucuauaguagacagcacauggagagguaccgcgggguuagcuucuaugaaguaccuccacaucuguuugccguggcagacacagucuaccgggccuugcgaacugagagaagggaucaggcugugaugauuuccggagaaucuggcgcagguaaaaccgaggccacaaagcggcuccugcaauucuaugcugagaccugucccgccccugaacgugggggagcggugcgcgacagacugcuccagucgaacccagucuuagaggcauuuggcaaugccaaaacucugaggaacgauaauucaagccgguucggcaaguacauggacguucaguuugauuucaaaggggcucccgugggaggucacauccuuaguuacuugcuggaaaagucccgaguagugcaucagaaccacggcgagcgcaauuuucacauauucuaucaacuacucgaagggggagaggaggaaacacugagaaggcuuggccuggagcggaacccucagucuuacuuguaucucgucaagggucagugcgccaaagugagcuccaucaaugacaagucagauuggaaaguugugcgcaaggcacugaccgucauugacuuuacggaagaugagguggaagacuuacugaguaucguagcuagcguucuccaucuugggaacauucacuucgccgcgaaugaggagucuaacgcccaggugacuaccgaaaaucaacugaaauacuugacaagacuacuguccgucgagggaucaacucucagggaagcacugacccaucguaagaucauagcuaagggcgaggaacuucugagcccauugaaccucgagcaggccgcuuaugcccgggacgcacuggccaaagcuguguacagucgaacauucaccugguuagucggcaagauuaacagaucucuggcguccaaagauguggagagcccgucguggaggucuacgacuguucuagggcuccuggacaucuauggauuugaaguguuccagcacaauuccuuugagcaauucuguauuaacuacugcaaugaaaaacuucagcaguuguuuaucgagcugacacucaagucagagcaggaagaguacgaagcagaggguaucgccugggaacccguacaauauuucaacaauaagauuauaugugaucuggucgaggagaaauuuaagggcaucauuaguauccuugacgaagagugccugcgcccuggggaagcuaccgauuugacuuuccucgagaagcuggaagacacagugaaacaccauccacacuuuuuaacccauaagcuggccgaucagcggacgagaaaaagccuaggaaggggcgaguuccgccuccugcacuacgcuggugagguuaccuauuccgugacaggguuucuugacaagaacaaugauuugcuguuccgaaaccucaaagaaacuauguguucuagcaagaaucccauaaugucacagugcuuugaccggagugagcuguccgauaagaaacguccugaaaccgucgccacacaguucaagaugagcuuacugcaacuuguggagauuuugcagucuaaagaaccagcuuacguaagauguaucaagcccaacgacgccaaacagccgggcagguucgacgaggugcucauccgccaucagguuaaguaucugggacuacuggagaaucuccgggucagaagggcaggcuuugcguaccgacgcaaguaugaggcuuuccugcaacgguacaaaucacuuugcccugaaacuuggcccaccugggccgggagaccacaggauggaguggcaguguuggucaggcaccuggguuacaagccugaagaguauaaaaugggccguacaaagauuuuuauccgcuuccccaaaaccuuauuugccacugaggacgcucucgaaguucggagacagagucuggccacgaagauucaggcagcuuggaggggguuccacuggcgacaaaaguuucuucgggugaaacgcagcgccauauguauccaguccugguggagaggaacacugggcaggcggaaggcggccaaacgaaagugggcugcacagaccauuagacgcuugaucagggguuucgugcuccgucaugccccacggugccccgagaacgcauuuuuccuggaucacguaagaacuucuuuucuacugaaucucaggcgccaacugccucagaacguccuugacaccucguggccaacaccgcccccugccuugcgagaagcaagcgagcuguuaagagaacucugcaucaaaaauaugguguggaaguacugucgguccauuucaccagaguggaaacagcagcugcaacagaaggcgguugccagugagauauucaaggggaaaaaggauaacuauccccagucugugccuaggcuuuuuaucagcacccgccugggcacugacgaaauuuccccacguguccuacaggcucucggaucagagcccauccaauacgccgugccgguugugaaauaugauagaaagggcuacaaaccucggagcaggcagcuguugcugacaccaaacgcaguagucauuguggaagacgcuaaggugaagcagcgcaucgauuaugccaauuuaacggggauaucugucuccagucucagcgacucucuguucguucuucaugugcagcgagcagauaacaaacaaaagggagacguagugcugcaguccgaucacgucaucgagaccuugacuaaaacagcccucucagcuaauagagugaacaguauuaauaucaaccaggguagcauuaccuucgcgggcgggcccggacgggacggcacaaucgacuuuacuccugguucggaacugcuaauaaccaaggccaaaaaugggcaccuggcaguuguggcucccaggcuuaacucccgcuga

SEQ ID NO: 2811 - RNA, 3192 nt, Artificial Sequence
  derived and/or modified sequence opt4 from MYO1C__Homo_sapiens__CCDS42226.1
auggcccugcagguggagcuggugcccaccggcgagaucaucagaguggugcacccccacagacccugcaagcuggcccugggcagcgacggcgugagagugaccauggagagcgcccugaccgccagagacagagugggcgugcaggacuucgugcugcuggagaacuucaccagcgaggccgccuucaucgagaaccugagaagaagauucagagagaaccugaucuacaccuacaucggccccgugcuggugagcgugaaccccuacagagaccugcagaucuacagcagacagcacauggagagauacagaggcgugagcuucuacgaggugcccccccaccuguucgccguggccgacaccguguacagagcccugagaaccgagagaagagaccaggccgugaugaucagcggcgagagcggcgccggcaagaccgaggccaccaagagacugcugcaguucuacgccgagaccugccccgcccccgagagaggcggcgccgugagagacagacugcugcagagcaaccccgugcuggaggccuucggcaacgccaagacccugagaaacgacaacagcagcagauucggcaaguacauggacgugcaguucgacuucaagggcgcccccgugggcggccacauccugagcuaccugcuggagaagagcagaguggugcaccagaaccacggcgagagaaacuuccacaucuucuaccagcugcuggagggcggcgaggaggagacccugagaagacugggccuggagagaaacccccagagcuaccuguaccuggugaagggccagugcgccaaggugagcagcaucaacgacaagagcgacuggaagguggugagaaaggcccugaccgugaucgacuucaccgaggacgagguggaggaccugcugagcaucguggccagcgugcugcaccugggcaacauccacuucgccgccaacgaggagagcaacgcccaggugaccaccgagaaccagcugaaguaccugaccagacugcugagcguggagggcagcacccugagagaggcccugacccacagaaagaucaucgccaagggcgaggagcugcugagcccccugaaccuggagcaggccgccuacgccagagacgcccuggccaaggccguguacagcagaaccuucaccuggcuggugggcaagaucaacagaagccuggccagcaaggacguggagagccccagcuggagaagcaccaccgugcugggccugcuggacaucuacggcuucgagguguuccagcacaacagcuucgagcaguucugcaucaacuacugcaacgagaagcugcagcagcuguucaucgagcugacccugaagagcgagcaggaggaguacgaggccgagggcaucgccugggagcccgugcaguacuucaacaacaagaucaucugcgaccugguggaggagaaguucaagggcaucaucagcauccuggacgaggagugccugagacccggcgaggccaccgaccugaccuuccuggagaagcuggaggacaccgugaagcaccacccccacuuccugacccacaagcuggccgaccagagaaccagaaagagccugggcagaggcgaguucagacugcugcacuacgccggcgaggugaccuacagcgugaccggcuuccuggacaagaacaacgaccugcuguucagaaaccugaaggagaccaugugcagcagcaagaaccccaucaugagccagugcuucgacagaagcgagcugagcgacaagaagagacccgagaccguggccacccaguucaagaugagccugcugcagcugguggagauccugcagagcaaggagcccgccuacgugagaugcaucaagcccaacgacgccaagcagcccggcagauucgacgaggugcugaucagacaccaggugaaguaccugggccugcuggagaaccugagagugagaagagccggcuucgccuacagaagaaaguacgaggccuuccugcagagauacaagagccugugccccgagaccuggcccaccugggccggcagaccccaggacggcguggccgugcuggugagacaccugggcuacaagcccgaggaguacaagaugggcagaaccaagaucuucaucagauuccccaagacccuguucgccaccgaggacgcccuggaggugagaagacagagccuggccaccaagauccaggccgccuggagaggcuuccacuggagacagaaguuccugagagugaagagaagcgccaucugcauccagagcugguggagaggcacccugggcagaagaaaggccgccaagagaaagugggccgcccagaccaucagaagacugaucagaggcuucgugcugagacacgcccccagaugccccgagaacgccuucuuccuggaccacgugagaaccagcuuccugcugaaccugagaagacagcugccccagaacgugcuggacaccagcuggcccacccccccccccgcccugagagaggccagcgagcugcugagagagcugugcaucaagaacaugguguggaaguacugcagaagcaucagccccgaguggaagcagcagcugcagcagaaggccguggccagcgagaucuucaagggcaagaaggacaacuacccccagagcgugcccagacuguucaucagcaccagacugggcaccgacgagaucagccccagagugcugcaggcccugggcagcgagcccauccaguacgccgugcccguggugaaguacgacagaaagggcuacaagcccagaagcagacagcugcugcugacccccaacgccguggugaucguggaggacgccaaggugaagcagagaaucgacuacgccaaccugaccggcaucagcgugagcagccugagcgacagccuguucgugcugcacgugcagagagccgacaacaagcagaagggcgacguggugcugcagagcgaccacgugaucgagacccugaccaagaccgcccugagcgccaacagagugaacagcaucaacaucaaccagggcagcaucaccuucgccggcggccccggcagagacggcaccaucgacuucacccccggcagcgagcugcugaucaccaaggccaagaacggccaccuggccgugguggcccccagacugaacagcagauga

SEQ ID NO: 2812 - RNA, 3192 nt, Artificial Sequence
  derived and/or modified sequence opt5 from MYO1C__Homo_sapiens__CCDS42226.1
auggcccuccagguggagcucguccccaccggcgaaaucauuagaguugugcacccucaucggccgugcaagcuggcucuugggagcgacggagugcgcgucacaauggaguccgcccugacggcgagagaucgggugggcguucaagacuucgugcuccuggaaaacuuuaccucugaggcugccuucaucgaaaaucuucgcagacgguuucgcgagaaccugauuuacacauauaucgggcccguccucgugagcguuaauccuuacagagaucugcagauuuauucccggcagcacauggagcgcuacagaggagugucuuucuaugaagugcccccucaucuguuugccgucgcugacaccguguaccgggcccuccgcacagagagacgggaucaggcugucaugaucagcggcgaauccggggccggaaaaaccgaggcgacaaagcgccugcuucaauucuaugccgagaccugucccgcuccugaaagaggcggcgccguucgggacagacugcuccagucuaacccggugcuggaggcuuuugggaaugccaaaacgcuucgcaacgauaauagcucccgguucggaaaguacauggacgugcaguuugauuucaaaggcgcgcccgucgggggacacauccugagcuaccuccuggaaaagucuagagugguucaucagaaccacggcgagcgcaauuuucacauuuucuaucaacugcucgaagggggagaggaggaaacccugcggagacuuggccuggagcgcaacccucaguccuaccucuaucuggugaagggccagugcgccaaagucagcucuaucaaugacaaguccgauuggaaagugguucggaaggcucuuacagugauugacuuuaccgaagaugaggucgaagaccugcucagcaucguggccucuguccugcaucuggggaacauucacuucgcugccaaugaggaguccaacgcccaggugacaaccgaaaaucaacucaaauaccugacgagacuucugagcguugagggauccacacuccgcgaagcucugacccaucggaagaucauugcgaagggcgaggaacuucugucuccccucaaccuggagcaggccgcuuaugccagagacgcccuggcuaaagccguguacagccgcacauucaccuggcucgucgggaagaucaaccggucccuggcgagcaaagauguggagucuccuuccuggagaagcaccacaguucuuggacugcucgacaucuauggcuuugaaguguuccagcacaauucuuuugagcaauucuguauuaacuacugcaaugaaaagcugcagcagcuguuuaucgagcuuacgcucaaaagcgagcaggaagaguacgaagcugaggggauugccugggaacccguccaauauuucaacaauaagaucauuugugaucugguggaggagaaauuuaagggaaucaucuccauucuggacgaagagugccuccggccgggcgaagccaccgaucugacauuccuugagaagcuggaagacaccgugaaacaccauccucacuuucucacacauaagcuggcugaucagcgcaccagaaaaucucugggccggggagaguucagacuucuccacuacgccggagagguuacguauagcgucacaggcuuucuggacaagaacaaugaucugcuguuccgcaaccugaaagaaaccauguguuccagcaagaaucccaucaugucucagugcuuugaccgguccgagcuuagcgauaagaaaagaccugaaaccguggcuacacaguucaagaugucucugcuccaacugguggagauucugcaguccaaagaacccgccuacguccgcuguaucaagcccaacgacgcgaaacagccugggagauucgacgaggugcuuauucggcaucagguuaaguaucucggacugcuggagaaucuccgcgugagacgggccggcuuugcuuaccgcagaaaguaugaagccuuccugcaacgguacaaaagccuuugcccggagaccuggcccacaugggcugggcgcccucaggauggcgucgccgugcugguuagacaccucggauacaagcccgaagaguauaaaaugggccggacgaagaucuuuauccgcuucccuaaaacccuguuugcgacagaggacgcccuggaagugagacggcagucccuugcuaccaagauucaggccgcuuggagaggguuccacuggcgccaaaaguuucuccgggucaaaagaucugccaucuguauucagagcugguggcgcggaacacugggccggagaaaggccgcuaaacgcaagugggcggcccagaccauccggagacugauucgcggguucgugcuccggcaugcucccagaugcccggagaacgccuuuuuccuggaucacguucggacguccuuucuucugaaucuccgcagacaacugccucagaacgugcuggacaccucuuggcccacaccucccccugcccuucgggaagcuagcgagcugcuccgcgaacugugcaucaaaaauauggucuggaaguacuguagauccauuagccccgaguggaaacagcagcuccaacagaaggccguggcgucugagaucuucaaggggaaaaaggauaacuauccgcaguccgugccucggcuguuuaucagcaccagacuuggcacagacgaaauuucuccccgcguccugcaggcucucggguccgagcccauccaauacgccguuccuguggugaaauaugaucggaagggcuacaaaccgagaagccgccagcugcugcuuacccccaacgccgucgugauuguugaagacgcuaaggugaagcagcggaucgauuaugccaaucugacgggaauuucugucagcucccucagcgacucucuguucgugcuccauguucagagagcggauaacaaacaaaagggcgacgugguccugcaguccgaucacgugaucgagacacuuaccaaaacagcucugagcgccaaucgcguuaacuccaucaauauuaaccaggggucuaucaccuucgccggaggcccugggcgggacggaaccauugacuuuacacccggcagcgaacuccugaucacgaaggcuaaaaaugggcaccuggccguggucgcuccuagacuuaacucccgcuga

SEQ ID NO: 2813 - protein, 1006 aa, Artificial Sequence
  MYO1D__Homo_sapiens__O94832
MAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKSEKRHLQVNVTNPVQCSLHGKKCTVSVETRLNQPQPDFTKNRSGFILSVPGN

SEQ ID NO: 2814 - RNA, 3021 nt, Artificial Sequence
  MYO1D__Homo_sapiens__AAI46764
auggcggagcaggagagccuggaauucggcaaggcagacuucgugcugauggacaccgucuccaugcccgaguucauggccaaccucaggcucagauuugaaaaagggcgcaucuauacguucauuggagaagucgucguuucugugaacccuuacaaguuguugaacaucuauggaagagacacaauugagcaguauaaaggccgugagcuguaugagagaccgccucaccuuuuugcuauugcggaugcugcuuacaaggcuaugaagaggcgaucaaaagacacuuguauugugauaucaggggaaaguggagcugguaaaacggaagccaguaaguacauuaugcaguauauugcggccaucaccaaccccagucagagagcagagguugaaagagugaagaauauguugcuuaaguccaacuguguuuuggaagcuuuuggaaaugccaaaaccaaccguaaugacaacucaagcagguuuggaaaauacauggauaucaacuuugacuucaagggugacccuauuggugggcauaucaauaacuacuuacuagaaaagucucgagugauugugcaacagccaggagaaagaagcuuucauucuuucuaucagcuacuccaaggagguucagaacaaaugcuacgcucucuacaucuccagaaaucccuuucauccuacaacuauauucaugugggagcucaauuaaagucuucuaucaaugaugcugccgaauucagaguuguugcugaugccaugaaagucauuggcuucaaaccugaggagauccaaacaguguauaagauuuuggcugcuauucugcacuugggaaauuuaaaauuuguaguagauggugacacgccucuuauugagaauggcaaaguaguaucuaucauagcagaauugcucucuacuaagacagauaugguugagaaagcccuucuuuaccggacuguggccacaggccgugacaucauugacaagcagcacacagaacaagaggccagcuacggcagagacgccuuugccaaggcaauauaugagcgccuuuuuuguuggaucguuacucgcaucaaugauauuauugaggucaagaacuaugacaccacaauccaugggaaaaacacuguuauuggugucuuggauaucuauggcuuugaaaucuucgacaacaacaguuuugaacaauucuguaucaauuacugcaaugagaaacugcagcagcuauuuauucagcugguucugaagcaagaacaagaggaauaccagcgggaagggauccccuggaaacauauugacuacuucaacaaucagaucauuguugaccucguggagcaacagcacaaagggaucauugcaauccuugaugaugcuugcaugaaugucggcaaagucaccgaugaaauguuucuugaagcacuuaacaguaaauugggcaaacacgcccauuuuuccagccgaaagcucugugccucagacaaaauucuggaguuugaucgagauuuucgaauucgacauuaugcaggcgauguagucuauucugucauugguuuuauugacaaaaauaaagauacuuuauuucaagauuucaagcgccuuauguauaacaguucaaauccugugcucaagaauauguggccugaaggcaaacugagcauuacagaggugaccaagcgaccucugacugcugcuaccuuguuuaagaauucuaugauugcucuaguagacaaccuugcaucaaaggaaccauauuacguucguugcaucaaacccaaugacaagaaaucuccacagauauuugaugaugaacgcugccggcaccaaguagaauaucuuggacuacuggaaaaugugagagugcgucgggcaggauuugccuuccgccagacauacgagaaguuucuucacagguauaagaugaucucugaauucaccuggcccaaccaugaccuuccuucagacaaagaggcugucaagaaacuaauugaacggugugguuuucaggaugauguagcuuaugggaagaccaaaauuuucauucgaacaccccgaacauuguuuaccuuggaagaacuccgugcccagaugcucauaaggauuguccucuuucuacaaaagguguggcggggcacccuggcccgcaugcgguacaaaagaaccaaggcagcucugacaauaaucagguacuaccggcgcuacaaagugaagucguacauccacgagguggccagacgcuuccauggcgucaagaccaugcgagacuacgggaagcacgugaaguggccaagcccuccuaaaguucuucgccguuuugaggaggcccugcagacgauuuucaauagauggagagcaucccagcucaucaagagcauuccggccucagaccugccccaggucagggcaaagguugcagccguggaaauguugaagggucaaagggcugaccucgggcuccagagggccugggagggcaacuaucuugcuucaaagccagauacaccucagaccucaggcacuuuugucccuguugcuaaugaauugaaacggaaggacaaauacaugaauguccucuuuuccugucacguccguaagguaaaucgauuuaguaagguggaagacagagcaauuuuugucacugaccgucaccuguauaaaauggaucccacuaaacaguacaaggugaugaagacuaucccucuauacaauuugacuggucugagugucuccaauggaaaggaccaacuuguaguguuccauacgaaagacaacaaagaccucauugucugccucuucagcaaacagccaacccaugagagucgaauuggagaacuuguuggagugcuggugaaucauuucaagagugagaagcgccaccuucaagugaacgucaccaacccaguacagugcagccugcacgggaagaagugcaccgucuccguggagacgcggcucaaccagccccagcccgacuucaccaagaaucgcucgggcuucauccucagcgugcccgggaacuga

SEQ ID NO: 2815 - RNA, 3021 nt, Artificial Sequence
  derived and/or modified sequence opt1 from MYO1D__Homo_sapiens__AAI46764
auggccgagcaggagagccuggaguucggcaaggccgacuucgugcucauggacaccgucuccaugcccgaguucauggcgaaccugcgccugcgguucgagaaggggcgcaucuacaccuucaucggcgaggugguggucagcgugaacccguacaagcuccugaacaucuacgggcgggacacgaucgagcaguacaagggccgcgagcuguacgagcggccgccccaccucuucgccaucgccgacgccgccuacaaggcgaugaagcgccgguccaaggacacgugcaucgugaucagcggggaguccggcgccggcaagaccgaggccagcaaguacaucaugcaguacaucgccgcgaucaccaaccccucccagcgcgccgaggucgagcgggugaagaacaugcugcucaagagcaacugcgugcuggaggccuucgggaacgccaagaccaaccgcaacgacaacuccagccgguucggcaaguacauggacaucaacuucgacuucaagggggaccccaucggcgggcacaucaacaacuaccugcuggagaagucccgcgucaucgugcagcagcccggcgagcggagcuuccacuccuucuaccagcuccugcagggcgggagcgagcagaugcugcgcucccuccaccuccagaagucccugagcagcuacaacuacauccacgugggcgcccagcugaaguccagcaucaacgacgcggccgaguuccgggucguggccgacgccaugaaggugaucggguucaagcccgaggagauccagaccgucuacaagauccuggccgcgauccugcaccucggcaaccugaaguucgugguggacggcgacacgccccugaucgagaacgggaaggucgugagcaucaucgccgagcuccuguccaccaagaccgacaugguggagaaggcccugcucuaccgcaccgucgccaccggccgggacaucaucgacaagcagcacaccgagcaggaggccagcuacgggcgcgacgcguucgccaaggccaucuacgagcggcuguucugcuggaucgugacgcgcaucaacgacaucaucgaggugaagaacuacgacaccaccauccacggcaagaacaccgucaucggggugcuggacaucuacggcuucgagaucuucgacaacaacuccuucgagcaguucugcaucaacuacugcaacgagaagcuccagcagcuguucauccagcugguccucaagcaggagcaggaggaguaccagcgggagggcaucccguggaagcacaucgacuacuucaacaaccagaucaucguggaccugguggagcagcagcacaaggggaucaucgccauccuggacgacgccugcaugaacgucggcaaggugacggacgagauguuccucgaggcgcugaacagcaagcuggggaagcacgcccacuucuccagccgcaagcucugcgccuccgacaagauccuggaguucgaccgcgacuuccggauccgccacuacgccggcgacguggucuacagcgugaucggguucaucgacaagaacaaggacacccuguuccaggacuucaagcggcucauguacaacuccagcaaccccgugcugaagaacauguggcccgagggcaagcuguccaucaccgaggucaccaagcgcccccucacggcggccacccuguucaagaacagcaugaucgcccugguggacaaccucgccuccaaggagccguacuacgugcggugcaucaagcccaacgacaagaaguccccgcagaucuucgacgacgagcgcugccggcaccaggucgaguaccugggccugcuggagaacgugcgcgugcggcgcgccggguucgcguuccggcagaccuacgagaaguuccuccaccgcuacaagaugaucagcgaguucaccuggcccaaccacgaccugcccagcgacaaggaggccgucaagaagcugaucgagcggugcggcuuccaggacgacguggccuacgggaagacgaagaucuucauccgcacgccccggacccucuucacccuggaggagcugcgcgcccagaugcucauccggaucgugcuguuccugcagaaggucuggcgcggcacccucgcccggaugcgcuacaagcgcaccaaggcggcccugaccaucauccgguacuaccgccgguacaaggugaaguccuacauccacgagguggcccgccgguuccacggggucaagaccaugcgcgacuacggcaagcacgugaaguggcccagcccgcccaaggugcugcggcgcuucgaggaggcccuccagacgaucuucaaccgguggcgcgccucccagcugaucaagagcauccccgcgagcgaccugccccagguccgggccaagguggccgccguggagaugcucaagggccagcgcgcggaccuggggcugcagcgggccugggagggcaacuaccucgccuccaagcccgacaccccgcagaccagcgggaccuucguccccguggccaacgagcugaagcgcaaggacaaguacaugaacgugcuguucuccugccacguccggaaggugaaccgcuucagcaagguggaggaccgggccaucuucgucacggaccgccaccucuacaagauggaccccaccaagcaguacaaggugaugaagaccaucccccuguacaaccugaccggccucuccgugagcaacggcaaggaccagcuggucguguuccacaccaaggacaacaaggaccugaucgugugccucuucuccaagcagccgacgcacgagagccggaucggggagcuggucggcgugcuggugaaccacuucaaguccgagaagcgccaccuccaggucaacgugaccaaccccgugcagugcagccugcacgggaagaagugcaccgucuccguggagacccggcugaaccagccccagccggacuucacgaagaaccgcagcggcuucauccucuccgugcccgggaacuga

SEQ ID NO: 2816 - RNA, 3021 nt, Artificial Sequence
  derived and/or modified sequence opt2 from MYO1D__Homo_sapiens__AAI46764
auggccgagcaggagucccucgaguucggcaaggccgacuucguccucauggacaccgucuccaugcccgaguucauggccaaccuccgccuccgcuucgagaagggccgcaucuacaccuucaucggcgaggucgucgucuccgucaaccccuacaagcuccucaacaucuacggccgcgacaccaucgagcaguacaagggccgcgagcucuacgagcgccccccccaccucuucgccaucgccgacgccgccuacaaggccaugaagcgccgcuccaaggacaccugcaucgucaucuccggcgaguccggcgccggcaagaccgaggccuccaaguacaucaugcaguacaucgccgccaucaccaaccccucccagcgcgccgaggucgagcgcgucaagaacaugcuccucaaguccaacugcguccucgaggccuucggcaacgccaagaccaaccgcaacgacaacuccucccgcuucggcaaguacauggacaucaacuucgacuucaagggcgaccccaucggcggccacaucaacaacuaccuccucgagaagucccgcgucaucguccagcagcccggcgagcgcuccuuccacuccuucuaccagcuccuccagggcggcuccgagcagaugcuccgcucccuccaccuccagaagucccucuccuccuacaacuacauccacgucggcgcccagcucaaguccuccaucaacgacgccgccgaguuccgcgucgucgccgacgccaugaaggucaucggcuucaagcccgaggagauccagaccgucuacaagauccucgccgccauccuccaccucggcaaccucaaguucgucgucgacggcgacaccccccucaucgagaacggcaaggucgucuccaucaucgccgagcuccucuccaccaagaccgacauggucgagaaggcccuccucuaccgcaccgucgccaccggccgcgacaucaucgacaagcagcacaccgagcaggaggccuccuacggccgcgacgccuucgccaaggccaucuacgagcgccucuucugcuggaucgucacccgcaucaacgacaucaucgaggucaagaacuacgacaccaccauccacggcaagaacaccgucaucggcguccucgacaucuacggcuucgagaucuucgacaacaacuccuucgagcaguucugcaucaacuacugcaacgagaagcuccagcagcucuucauccagcucguccucaagcaggagcaggaggaguaccagcgcgagggcauccccuggaagcacaucgacuacuucaacaaccagaucaucgucgaccucgucgagcagcagcacaagggcaucaucgccauccucgacgacgccugcaugaacgucggcaaggucaccgacgagauguuccucgaggcccucaacuccaagcucggcaagcacgcccacuucuccucccgcaagcucugcgccuccgacaagauccucgaguucgaccgcgacuuccgcauccgccacuacgccggcgacgucgucuacuccgucaucggcuucaucgacaagaacaaggacacccucuuccaggacuucaagcgccucauguacaacuccuccaaccccguccucaagaacauguggcccgagggcaagcucuccaucaccgaggucaccaagcgcccccucaccgccgccacccucuucaagaacuccaugaucgcccucgucgacaaccucgccuccaaggagcccuacuacguccgcugcaucaagcccaacgacaagaaguccccccagaucuucgacgacgagcgcugccgccaccaggucgaguaccucggccuccucgagaacguccgcguccgccgcgccggcuucgccuuccgccagaccuacgagaaguuccuccaccgcuacaagaugaucuccgaguucaccuggcccaaccacgaccuccccuccgacaaggaggccgucaagaagcucaucgagcgcugcggcuuccaggacgacgucgccuacggcaagaccaagaucuucauccgcaccccccgcacccucuucacccucgaggagcuccgcgcccagaugcucauccgcaucguccucuuccuccagaaggucuggcgcggcacccucgcccgcaugcgcuacaagcgcaccaaggccgcccucaccaucauccgcuacuaccgccgcuacaaggucaaguccuacauccacgaggucgcccgccgcuuccacggcgucaagaccaugcgcgacuacggcaagcacgucaaguggcccuccccccccaagguccuccgccgcuucgaggaggcccuccagaccaucuucaaccgcuggcgcgccucccagcucaucaaguccauccccgccuccgaccucccccagguccgcgccaaggucgccgccgucgagaugcucaagggccagcgcgccgaccucggccuccagcgcgccugggagggcaacuaccucgccuccaagcccgacaccccccagaccuccggcaccuucguccccgucgccaacgagcucaagcgcaaggacaaguacaugaacguccucuucuccugccacguccgcaaggucaaccgcuucuccaaggucgaggaccgcgccaucuucgucaccgaccgccaccucuacaagauggaccccaccaagcaguacaaggucaugaagaccaucccccucuacaaccucaccggccucuccgucuccaacggcaaggaccagcucgucgucuuccacaccaaggacaacaaggaccucaucgucugccucuucuccaagcagcccacccacgagucccgcaucggcgagcucgucggcguccucgucaaccacuucaaguccgagaagcgccaccuccaggucaacgucaccaaccccguccagugcucccuccacggcaagaagugcaccgucuccgucgagacccgccucaaccagccccagcccgacuucaccaagaaccgcuccggcuucauccucuccguccccggcaacuga

SEQ ID NO: 2817 - RNA, 3021 nt, Artificial Sequence
  derived and/or modified sequence opt3 from MYO1D__Homo_sapiens__AAI46764
auggccgagcaggaaagccuggaguucggcaaggcugacuuugugcucauggauaccgucuccaugcccgaguucauggcaaaccuuagacugagguuugagaaagggcggaucuacacauucauuggagaaguugugguaucugugaauccuuauaaguuguuaaacauauacggucgcgacacuaucgagcaauauaaaggccgagagcuguacgaacguccaccgcaccuauuugccauugcggaugcugccuauaaggcaaugaaaagaaggucaaaggacacgugcaucgucauuaguggggagagcggagccggcaagaccgaggcuuccaaauacaucaugcaguauauagcagccaucacaaaucccucucagcgggcugaaguggagcgcguuaagaacaugcuccugaaaucgaauugugugcuugaagccuucgguaacgcgaagacuaauagaaacgauaauucaagcagguuugggaaauacauggacauuaacuucgauuuuaagggagacccuaucggcggccauauuaauaacuaccuguuggagaagagucgggucaucgugcagcaaccaggggaacgcuccuuccacucuuuuuaucagcuccugcagggagguagcgagcagaugcugcgaucccuccauuuacaaaaaucacugaguagcuacaauuauauacacguaggcgcacagcuuaagucuuccauuaacgaugccgcugaguucagaguuguggccgacgcaaugaaagucaucggguuuaagcccgaagagauucagaccguguacaaaaucuuggcugccauccugcaucuaggaaaucucaaguucguggucgauggcgacacaccucugauugaaaacgguaaaguugugucaauaaucgcggagcuucugagcaccaagacugauaugguagaaaaggccuugcucuauaggacaguggcaaccgggcgggacauuaucgacaaacagcacacggagcaagaagcuaguuacggacgugaugccuucgcuaaggccauauaugagcgccuguuuugcuggauugucacuagaaucaacgacaucauugaggugaaaaauuacgauaccacaauccacggcaagaacacuguuauuggcguguuagacauauacggguucgaaaucuuugauaauaacucuuucgagcaguuuuguauuaauuauugcaacgaaaaacugcagcaacucuucauccagcuuguccugaagcaggagcaggaagaguaccaaagggagggaaucccauggaagcauauugacuauuuuaauaaccagauaaucguggauuugguagaacagcagcacaaagguauuaucgcaauucuagacgaugccuguaugaauguuggcaaggugaccgacgagauguuccuggaagcucucaacuccaaacuggggaagcaugcgcacuuuagcucgcggaaacuuugcgcaucugauaagauccuggaguucgaccgagacuuucgcauaagacacuacgccggagaugucguguauuccgucaucggcuucauugacaagaauaaagauacauuguuucaagacuucaagaggcucauguacaacucaaguaaucccgugcugaaaaacauguggccugaggguaaguuaagcaucaccgaaguuacgaaacggccacugacugcugccacacuauucaaaaauuccaugauugcacucguggauaaccuggccucuaaggagccguauuacguacgcuguaucaagcccaacgacaagaaaagcccucagauauuugaugacgaaagaugcaggcaucaggucgaguaccuuggguugcuggaaaaugugcguguucggcgagcuggcuucgccuuuagacagaccuaugagaaguuccuccacagguacaaaaugauuucagaguuuacuuggccaaaccaugaucugcccagugacaaggaagcagugaaaaagcugaucgagcgcuguggauuccaagaugacgucgcguauggcaagacaaaaauuuuuauccggaccccuagaacgcuuuucaccuuggaagaacucagggcucagaugcugauacgcaucguguuauuucugcagaagguauggcgagggacacuagcccggaugcguuacaaaagaacuaaggcagcccucaccauuaucagguauuaccgccgguauaaagugaaguccuacauucacgaaguugcuagaagguuccauggagucaagacaaugcgagauuacgguaaacacgugaaguggccaucacccccgaaagugcugcgccgguuugaggaggcccuucagacuaucuucaauagauggagggcaucucaauugauaaagucaauuccugcuagugaccugccccagguccgugccaaaguugcggccguggaaaugcucaagggccagcgcgcugaccugggguuacaacgggcaugggagggaaacuaucuggccagcaagccagauaccccucagacauccggcaccuuugugcccguagcuaaugaacuuaaaagaaaggacaaauacaugaacgucuuguucucuugccacgugaggaagguuaaucgauucucgaaaguggaggaucgggccaucuuugucacugaccgccaucucuauaagauggauccaacgaagcaguacaaagugaugaagacaaucccccuguauaaccuaaccggucugagcguuuccaaugggaaagaccagcucgugguauuccacacuaaggauaacaaagaccugauugucugucuuuuuagcaagcaaccuacccaugaaaguagaaucggcgaguuggugggagugcuggucaaucacuucaaaucugagaagaggcacuuacagguuaacgugacaaauccaguacagugcagccuccauggcaagaaaugcaccguguccgucgaaacucggcugaaccagccgcaacccgauuuuacaaagaaucgaucaggguucauucuuagcgugccuggaaacuga

SEQ ID NO: 2818 - RNA, 3021 nt, Artificial Sequence
  derived and/or modified sequence opt4 from MYO1D__Homo_sapiens__AAI46764
auggccgagcaggagagccuggaguucggcaaggccgacuucgugcugauggacaccgugagcaugcccgaguucauggccaaccugagacugagauucgagaagggcagaaucuacaccuucaucggcgaggugguggugagcgugaaccccuacaagcugcugaacaucuacggcagagacaccaucgagcaguacaagggcagagagcuguacgagagacccccccaccuguucgccaucgccgacgccgccuacaaggccaugaagagaagaagcaaggacaccugcaucgugaucagcggcgagagcggcgccggcaagaccgaggccagcaaguacaucaugcaguacaucgccgccaucaccaaccccagccagagagccgagguggagagagugaagaacaugcugcugaagagcaacugcgugcuggaggccuucggcaacgccaagaccaacagaaacgacaacagcagcagauucggcaaguacauggacaucaacuucgacuucaagggcgaccccaucggcggccacaucaacaacuaccugcuggagaagagcagagugaucgugcagcagcccggcgagagaagcuuccacagcuucuaccagcugcugcagggcggcagcgagcagaugcugagaagccugcaccugcagaagagccugagcagcuacaacuacauccacgugggcgcccagcugaagagcagcaucaacgacgccgccgaguucagagugguggccgacgccaugaaggugaucggcuucaagcccgaggagauccagaccguguacaagauccuggccgccauccugcaccugggcaaccugaaguucgugguggacggcgacaccccccugaucgagaacggcaagguggugagcaucaucgccgagcugcugagcaccaagaccgacaugguggagaaggcccugcuguacagaaccguggccaccggcagagacaucaucgacaagcagcacaccgagcaggaggccagcuacggcagagacgccuucgccaaggccaucuacgagagacuguucugcuggaucgugaccagaaucaacgacaucaucgaggugaagaacuacgacaccaccauccacggcaagaacaccgugaucggcgugcuggacaucuacggcuucgagaucuucgacaacaacagcuucgagcaguucugcaucaacuacugcaacgagaagcugcagcagcuguucauccagcuggugcugaagcaggagcaggaggaguaccagagagagggcauccccuggaagcacaucgacuacuucaacaaccagaucaucguggaccugguggagcagcagcacaagggcaucaucgccauccuggacgacgccugcaugaacgugggcaaggugaccgacgagauguuccuggaggcccugaacagcaagcugggcaagcacgcccacuucagcagcagaaagcugugcgccagcgacaagauccuggaguucgacagagacuucagaaucagacacuacgccggcgacgugguguacagcgugaucggcuucaucgacaagaacaaggacacccuguuccaggacuucaagagacugauguacaacagcagcaaccccgugcugaagaacauguggcccgagggcaagcugagcaucaccgaggugaccaagagaccccugaccgccgccacccuguucaagaacagcaugaucgcccugguggacaaccuggccagcaaggagcccuacuacgugagaugcaucaagcccaacgacaagaagagcccccagaucuucgacgacgagagaugcagacaccagguggaguaccugggccugcuggagaacgugagagugagaagagccggcuucgccuucagacagaccuacgagaaguuccugcacagauacaagaugaucagcgaguucaccuggcccaaccacgaccugcccagcgacaaggaggccgugaagaagcugaucgagagaugcggcuuccaggacgacguggccuacggcaagaccaagaucuucaucagaacccccagaacccuguucacccuggaggagcugagagcccagaugcugaucagaaucgugcuguuccugcagaagguguggagaggcacccuggccagaaugagauacaagagaaccaaggccgcccugaccaucaucagauacuacagaagauacaaggugaagagcuacauccacgagguggccagaagauuccacggcgugaagaccaugagagacuacggcaagcacgugaaguggcccagcccccccaaggugcugagaagauucgaggaggcccugcagaccaucuucaacagauggagagccagccagcugaucaagagcauccccgccagcgaccugccccaggugagagccaagguggccgccguggagaugcugaagggccagagagccgaccugggccugcagagagccugggagggcaacuaccuggccagcaagcccgacaccccccagaccagcggcaccuucgugcccguggccaacgagcugaagagaaaggacaaguacaugaacgugcuguucagcugccacgugagaaaggugaacagauucagcaagguggaggacagagccaucuucgugaccgacagacaccuguacaagauggaccccaccaagcaguacaaggugaugaagaccaucccccuguacaaccugaccggccugagcgugagcaacggcaaggaccagcuggugguguuccacaccaaggacaacaaggaccugaucgugugccuguucagcaagcagcccacccacgagagcagaaucggcgagcuggugggcgugcuggugaaccacuucaagagcgagaagagacaccugcaggugaacgugaccaaccccgugcagugcagccugcacggcaagaagugcaccgugagcguggagaccagacugaaccagccccagcccgacuucaccaagaacagaagcggcuucauccugagcgugcccggcaacuga

SEQ ID NO: 2819 - RNA, 3021 nt, Artificial Sequence
  derived and/or modified sequence opt5 from MYO1D__Homo_sapiens__AAI46764
auggccgagcaggaaagccuggaguucggcaaggcugacuuugugcucauggauaccgucuccaugcccgaguucauggccaaccugagacuucgguuugagaaagggcgcaucuacacauucauuggagaaguuguggugucugucaauccuuauaagcugcucaacaucuacggcagagacacgauugagcaauauaaagggcgggagcuguacgaacgcccgccccaccuuuuugcgaucgcugaugccgccuauaaggcuaugaaaagacggagcaaggauaccugcauugugaucuccggagagucuggcgccgggaagacagaagcuagcaaauacaucaugcaguauauugccgcgaucaccaauccuucccagcgcgccgagguugagagagugaagaacaugcugcucaaaucuaauuguguccuggaggcuuucggaaacgccaagacaaaucggaacgacaauagcucccgcuuuggcaaauacauggacauuaacuucgauuuuaagggcgaccccaucgggggacauauuaauaacuaccugcucgaaaagagcagagugaucguucagcaaccuggcgaacggucuuuccacuccuuuuaucagcugcuucaagggggaagcgagcagaugcugcgcucucuccaucugcagaaaucccuuagcucuuacaauuauauucacgugggcgcucagcugaaguccagcaucaacgaugccgcggaguucagagucguggccgacgcuaugaaagugaucggguuuaagcccgaagagauucagaccgucuacaaaauccucgccgcuauucugcaucugggaaaucucaaguucguuguggauggcgacacaccucugaucgaaaacggcaaaguggucuccauuaucgccgagcuucugucuaccaagacggauaugguggaaaaggcccuccuguaucggaccguugcuacagggcgcgacaucauugacaaacagcacaccgagcaagaagcgagcuacggaagagaugccuucgcuaaggccaucuaugagcggcuguuuugcuggauugugacaagaaucaacgacauuaucgaggucaaaaauuacgauaccacgauccacggcaagaacacagugauugggguucuggacaucuacggauucgaaauuuuugauaauaacuccuucgagcaguuuuguaucaauuauugcaacgaaaaacuccagcaacuguucauucagcuggugcucaagcaggagcaggaagaguaccaacgcgagggcaucccguggaagcauauugacuauuuuaauaaccagaucaucgucgaucugguggaacagcagcacaaagggauuaucgccauucuugacgaugcuuguaugaaugucggaaaggugaccgacgagauguuccuggaagcccucaacagcaaacugggcaagcaugcgcacuuuucuucccggaaacuuugcgcuagcgauaagauccuggaguucgacagagacuuucgcauucggcacuacgccggcgauguuguguauucugucaucggguucaucgacaagaauaaagauacacucuuucaagacuucaagagacugauguacaacagcuccaaucccgugcugaaaaacauguggccugagggaaagcucucuauuaccgaaguuaccaaacgcccccugacagccgcuacgcuuuucaagaauagcaugaucgcccugguggauaaccucgcuuccaaggagccuuauuacguccgguguauuaaacccaacgacaagaaaagcccgcagaucuuugaugacgaaagaugccgccaucagguggaguaccugggccugcuugaaaaugugcggguuagacgcgccggguucgcguuucggcagaccuaugagaaguuccuccacagauacaaaaugauuucugaguuuacauggccuaaccaugaucugcccuccgacaaggaagccgucaaaaagcugaucgagcgguguggauuccaagaugacguggcuuauggcaagaccaaaaucuuuauucgcacaccuagaacccucuucacgcuggaagaacuucgggcccagaugcugaucagaauugugcucuuucugcagaaggucuggcgcgggacacuggcucggaugagauacaaacgcaccaaggccgcgcuuaccaucauuagauauuaccggcgcuauaaaguuaagagcuacauccacgaaguggccagacgguuccauggcgugaagacaaugcgcgauuacggaaaacacgucaaguggcccucucccccuaaagugcucagacgguuugaggaggcucugcagaccaucuucaaucgcuggagagccucccaacugauuaagagcaucccggcuuccgaccucccccagguucgggccaaaguggccgcugucgaaaugcugaagggccagcgcgcggaccuugggcugcaaagagccugggagggaaacuaucucgcuucuaagccugauacaccccagacgagcggcaccuuugugccuguugccaaugaacugaaacggaaggacaaauacaugaacgugcuguucuccugccacgucagaaaggugaaucgcuucucuaaaguggaggaucgggccauuuuugucacagacagacaucuuuauaagauggaucccaccaagcaguacaaaguuaugaagacaaucccgcucuauaaccugaccgggcugagcguguccaauggaaaagaccagcucguggucuuccacacgaaggauaacaaagaccugauugugugucuuuuuagcaagcaaccuacccaugaaucucgcaucggcgagcugguuggggugcucgucaaucacuucaaauccgagaagcggcaccuucaggugaacguuacaaaucccgugcagugcagccugcauggcaagaaaugcaccgucucuguggaaacaagacuuaaccagccucaacccgauuuuaccaagaaucgcuccggauucauucucagcguuccuggcaacuga

SEQ ID NO: 2820 - protein, 1108 aa, Artificial Sequence
  MYO1E__Homo_sapiens__Q12965
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGSRQVQFHQGFGDLAVLKPSNKVLQVSIGPGLPKNSRPTRRNTTQNTGYSSGTQNANYPVRAAPPPPGYHQNGVIRNQYVPYPHAPGSQRSNQKSLYTSMARPPLPRQQSTSSDRVSQTPESLDFLKVPDQGAAGVRRQTTSRPPPAGGRPKPQPKPKPQVPQCKALYAYDAQDTDELSFNANDIIDIIKEDPSGWWTGRLRGKQGLFPNNYVTKI

SEQ ID NO: 2821 - RNA, 3327 nt, Artificial Sequence
  MYO1E__Homo_sapiens__CCDS32254.1
augggaagcaaaggugucuaccaguaccacuggcaaagccacaaugucaagcacagugguguggacgacauggugcuacuguccaagaucacagagaacuccaucguggagaaucugaagaagagauacauggaugacuacauuuuuacauauauaggaucuguauuaaucucagucaacccuuucaagcagaugccauauuuuggggaaaaggaaauugaaauguaccaaggagcggcacaguaugaaaacccaccacauaucuaugcccuugcagauaauauguacagaaacaugaucauugacagagagaaccagugcgucauuaucaguggugaaaguggugcuggaaaaacaguggcugccaaauauaucaugagcuacaucuccagagugucuggaggagggaccaaaguccagcacgugaaggacauuauccugcaguccaacccgcugcuggaggccuucgggaacgccaagaccguccggaacaacaacuccagccgauuuggaaaauacuuugaaauccaguucaguccagguggggaaccagaugguggaaagaucuccaacuuccuucuggaaaaaucuaggguggugaugaggaacccaggagagcggaguuuucacauauuuuaccagcucaucgagggcgccucugcagagcagaaacacagccuuggcaucaccagcauggacuauuauuacuaccugagccucucgggcucauacaagguugaugacauugacgacaggcgggaguuucaggaaacucugcacgccaugaaugugauugggaucuuugcagaagagcaaacgcugguguugcagauaguggcggguauucuccaccugggaaacaucagcuucaaagaaguuggcaacuacgcggcuguggagagugaagaguuuuuagcuuuuccugcauaucugcuagggauaaaccaggaccgguugaaagaaaagcuaacaagccggcagauggauagcaaguggggaggcaaauccgaauccauccacgugacccucaacguagagcaggccuguuacacccgggaugcgcucgccaaggcccugcacgcccgggucuuugauuucuugguagauuccaucaauaaagccauggagaaagaccaugaagaauacaacauuggcguccuagacaucuauggcuuugaaauauuccagaaaaauggcuuugaacaguuuuguaucaauuuuguuaaugaaaaacugcagcagauuuuuauugaacugacauuaaaggcagaacaggaagaauauguucaagagggaauaagauggacacccauugaguacuuuaauaauaaaaucguaugugaccucauagagaacaaagugaacccuccuggcaucaugagcauccuggaugacgugugcgccacgaugcaugcggugggugagggggcagaucagacgcugcuccagaaacuucagaugcagauugggagucaugagcacuucaacaguuggaaccaaggcuucaucauucaucauuaugcugggaagguauccuaugacauggauggcuuuugugaaaggaaccgggaugugcuuuuuauggaucucaucgagcuuaugcagagcagcgagcugccuuucauaaagucuuuauuuccggaaaaucugcaggcugacaagaaagggcgcccaacuacugccggaagcaaaauaaagaaacaagccaaugaccuugugagcacccugaugaaauguacgccccacuacauucgcugcaucaagccaaacgaaaccaagaagcccagagacugggaggaaagcaggguaaagcaucaagucgaauauuugggucugaaagagaacauucgagugagaagagcuggcuaugccuaucggcgcaucuuccaaaaauuccuacagagguaugccauucugaccaaagccaccuggccuucuuggcagggagaggagaagcaaggcguccugcaccugcugcagucggucaacauggacagcgaccaguuccagcuggggaggaguaaaguguucaucaaagcccccgagucucuauuucuuuuagaagagaugagagagagaaaguaugauggguaugcucgagugauacagaaaucauggaggaaauucguggcccggaagaaauacguucaaaugagagaagaagccucagaccucuuauugaacaagaaggagagaaggagaaacaguauuaacaggaacuuuauaggggauuauauugggauggaagagcacccagaacuccagcaguucgugggcaagagggagaagauugauuucgcagacacagucaccaaguaugacaggagguucaaggguguaaagcgagaccugcuccuuaccccaaagugcuuguacuuaaucggacgagaaaaagucaaacagggcccagacaagggccuggugaaagaaguccugaagcggaaaaucgagauagaacggaucuugucugugucccucaguacuaugcaggaugacauuuuuauucuccaugagcaagaguaugacaguuugcuugaaucugucuucaaaacugaauuccuaagccucuuagcaaagcguuacgaggagaagacccagaagcaacuaccucugaaauucagcaauacgcuugaacugaaguugaaaaaggaaaacuggggccccuggagugcagggggcucccggcaagugcaguuccaccaaggguuuggggaccuggcuguccucaagcccaguaacaaagugcugcaggucagcaucggaccuggacugcccaagaacucccguccuaccagaaggaacacuacccaaaauacagguuauuccagugggacucaaaaugccaacuacccagugagagcugccccuccucccccaggauaccaucagaacggagucaucagaaaccaguaugugccauauccccaugcuccuggaagccagagguccaaucagaaaagccuguacaccuccauggcccgcccgcccuugccucggcagcagucuaccaguucagaccgagugucacagacgccagagagccuggauuuccucaaggucccggaccagggagcugcaggggucaggagacaaacaaccagucggccucccccagcagggggcagacccaagccccagcccaagcccaagccucaggugccacagugcaaggcuuuguaugccuaugacgcucaggacacagacgaacucagcuuuaaugccaaugacauuauugauauuaucaaagaagauccuucuggcugguggacgggucgacuacgaggcaagcagggccuguuccccaacaacuaugugaccaagaucuga

SEQ ID NO: 2822 - RNA, 3327 nt, Artificial Sequence
  derived and/or modified sequence opt1 from MYO1E__Homo_sapiens__CCDS32254.1
augggcagcaaggggguguaccaguaccacuggcagucccacaacgucaagcacagcggcguggacgacauggugcugcucuccaagaucaccgagaacagcaucgucgagaaccugaagaagcgcuacauggacgacuacaucuucaccuacaucggguccgugcugaucagcgugaaccccuucaagcagaugccguacuucggcgagaaggagaucgagauguaccagggggccgcccaguacgagaaccccccccacaucuacgcgcucgccgacaacauguaccggaacaugaucaucgaccgcgagaaccagugcgucaucaucuccggcgagagcggcgccgggaagacgguggccgccaaguacaucauguccuacaucagccggguguccggcgggggcaccaagguccagcacgugaaggacaucauccugcagagcaacccccugcucgaggcguucgggaacgccaagaccgugcgcaacaacaacuccagccgguucggcaaguacuucgagauccaguucuccccgggcggggagcccgacggcgggaagaucagcaacuuccugcuggagaagucccgcgucgugaugcggaaccccggcgagcgcagcuuccacaucuucuaccagcucaucgagggcgccuccgccgagcagaagcacagccuggggaucaccagcauggacuacuacuacuaccugucccucagcggcuccuacaagguggacgacaucgacgaccggcgcgaguuccaggagacgcugcacgcgaugaacgucaucgggaucuucgccgaggagcagacccuggugcuccagaucguggccggcauccugcaccuggggaacaucagcuucaaggaggucggcaacuacgccgccguggaguccgaggaguuccucgcguuccccgccuaccugcugggcaucaaccaggaccggcucaaggagaagcugaccagccgccagauggacuccaagugggggggcaagagcgaguccauccacgugacccugaacgucgagcaggccugcuacacgcgggacgcccucgccaaggcgcugcacgcccgcguguucgacuuccugguggacagcaucaacaaggccauggagaaggaccacgaggaguacaacaucgggguccucgacaucuacggcuucgagaucuuccagaagaacggguucgagcaguucugcaucaacuucgugaacgagaagcugcagcagaucuucaucgagcugacccucaaggccgagcaggaggaguacguccaggagggcauccgguggaccccgaucgaguacuucaacaacaagaucgugugcgaccugaucgagaacaaggugaacccccccggcaucauguccauccuggacgacgucugcgccaccaugcacgcggugggggagggcgccgaccagacgcuccugcagaagcugcagaugcagaucgggagccacgagcacuucaacuccuggaaccagggcuucaucauccaccacuacgccgggaaggugagcuacgacauggacggcuucugcgagcgcaaccgggacguccucuucauggaccugaucgagcugaugcaguccagcgagcuccccuucaucaagucccuguucccggagaaccugcaggccgacaagaagggccgccccaccaccgccgggagcaagaucaagaagcaggcgaacgaccucguguccacccugaugaagugcacgccccacuacauccggugcaucaagcccaacgagaccaagaagccgcgcgacugggaggagagccgggugaagcaccaggucgaguaccugggccucaaggagaacauccgcgugcgccgggccggguacgccuaccgccggaucuuccagaaguuccugcagcgcuacgccauccugaccaaggcgaccuggcccagcuggcagggcgaggagaagcagggcgugcuccaccugcugcaguccgucaacauggacagcgaccaguuccagcuggggcgguccaagguguucaucaaggcccccgagagccucuuccugcuggaggagaugcgcgagcggaaguacgacggcuacgcccgcgugauccagaaguccuggcggaaguucgucgcccgcaagaaguacgugcagaugcgggaggaggccagcgaccuccugcugaacaagaaggagcgccggcgcaacuccaucaaccggaacuucaucggggacuacaucggcauggaggagcaccccgagcuccagcaguucguggggaagcgcgagaagaucgacuucgcggacacggucaccaaguacgaccggcgcuucaagggcgugaagcgggaccugcugcucaccccgaagugccuguaccugaucggccgcgagaaggugaagcaggggcccgacaagggccucgucaaggaggugcugaagcgcaagaucgagaucgagcggauccugagcgugucccucagcaccaugcaggacgacaucuucauccugcacgagcaggaguacgacucccugcucgagagcgucuucaagacggaguuccugucccugcucgccaagcgcuacgaggagaagacccagaagcagcugccccugaaguucagcaacacccucgagcugaagcugaagaaggagaacugggggcccugguccgccggcgggagccggcaggugcaguuccaccagggcuucggcgaccucgccgugcugaagccguccaacaagguccugcaggugagcaucgggcccggccuccccaagaacagccgccccacccggcgcaacacgacccagaacaccggguacuccagcggcacccagaacgccaacuacccggugcgggcggccccccccccgcccggguaccaccagaacggcgucauccgcaaccaguacgugcccuacccccacgccccgggcucccagcggagcaaccagaagucccuguacacgagcauggcccgccccccccugccccggcagcaguccaccagcuccgaccgcgugagccagaccccggagucccucgacuuccugaagguccccgaccagggggccgcgggcgugcggcgccagaccacgagccggccccccccggccgggggccgccccaagccccagcccaagccgaagccccaggugccccagugcaaggcccuguacgccuacgacgcgcaggacaccgacgagcucuccuucaacgccaacgacaucaucgacaucaucaaggaggaccccagcgggugguggaccggccggcugcgcggcaagcaggggcuguucccgaacaacuacgucaccaagaucuga

SEQ ID NO: 2823 - RNA, 3327 nt, Artificial Sequence
  derived and/or modified sequence opt2 from MYO1E__Homo_sapiens__CCDS32254.1
augggcuccaagggcgucuaccaguaccacuggcagucccacaacgucaagcacuccggcgucgacgacaugguccuccucuccaagaucaccgagaacuccaucgucgagaaccucaagaagcgcuacauggacgacuacaucuucaccuacaucggcuccguccucaucuccgucaaccccuucaagcagaugcccuacuucggcgagaaggagaucgagauguaccagggcgccgcccaguacgagaaccccccccacaucuacgcccucgccgacaacauguaccgcaacaugaucaucgaccgcgagaaccagugcgucaucaucuccggcgaguccggcgccggcaagaccgucgccgccaaguacaucauguccuacaucucccgcgucuccggcggcggcaccaagguccagcacgucaaggacaucauccuccaguccaacccccuccucgaggccuucggcaacgccaagaccguccgcaacaacaacuccucccgcuucggcaaguacuucgagauccaguucucccccggcggcgagcccgacggcggcaagaucuccaacuuccuccucgagaagucccgcgucgucaugcgcaaccccggcgagcgcuccuuccacaucuucuaccagcucaucgagggcgccuccgccgagcagaagcacucccucggcaucaccuccauggacuacuacuacuaccucucccucuccggcuccuacaaggucgacgacaucgacgaccgccgcgaguuccaggagacccuccacgccaugaacgucaucggcaucuucgccgaggagcagacccucguccuccagaucgucgccggcauccuccaccucggcaacaucuccuucaaggaggucggcaacuacgccgccgucgaguccgaggaguuccucgccuuccccgccuaccuccucggcaucaaccaggaccgccucaaggagaagcucaccucccgccagauggacuccaaguggggcggcaaguccgaguccauccacgucacccucaacgucgagcaggccugcuacacccgcgacgcccucgccaaggcccuccacgcccgcgucuucgacuuccucgucgacuccaucaacaaggccauggagaaggaccacgaggaguacaacaucggcguccucgacaucuacggcuucgagaucuuccagaagaacggcuucgagcaguucugcaucaacuucgucaacgagaagcuccagcagaucuucaucgagcucacccucaaggccgagcaggaggaguacguccaggagggcauccgcuggacccccaucgaguacuucaacaacaagaucgucugcgaccucaucgagaacaaggucaacccccccggcaucauguccauccucgacgacgucugcgccaccaugcacgccgucggcgagggcgccgaccagacccuccuccagaagcuccagaugcagaucggcucccacgagcacuucaacuccuggaaccagggcuucaucauccaccacuacgccggcaaggucuccuacgacauggacggcuucugcgagcgcaaccgcgacguccucuucauggaccucaucgagcucaugcaguccuccgagcuccccuucaucaagucccucuuccccgagaaccuccaggccgacaagaagggccgccccaccaccgccggcuccaagaucaagaagcaggccaacgaccucgucuccacccucaugaagugcaccccccacuacauccgcugcaucaagcccaacgagaccaagaagccccgcgacugggaggagucccgcgucaagcaccaggucgaguaccucggccucaaggagaacauccgcguccgccgcgccggcuacgccuaccgccgcaucuuccagaaguuccuccagcgcuacgccauccucaccaaggccaccuggcccuccuggcagggcgaggagaagcagggcguccuccaccuccuccaguccgucaacauggacuccgaccaguuccagcucggccgcuccaaggucuucaucaaggcccccgagucccucuuccuccucgaggagaugcgcgagcgcaaguacgacggcuacgcccgcgucauccagaaguccuggcgcaaguucgucgcccgcaagaaguacguccagaugcgcgaggaggccuccgaccuccuccucaacaagaaggagcgccgccgcaacuccaucaaccgcaacuucaucggcgacuacaucggcauggaggagcaccccgagcuccagcaguucgucggcaagcgcgagaagaucgacuucgccgacaccgucaccaaguacgaccgccgcuucaagggcgucaagcgcgaccuccuccucacccccaagugccucuaccucaucggccgcgagaaggucaagcagggccccgacaagggccucgucaaggagguccucaagcgcaagaucgagaucgagcgcauccucuccgucucccucuccaccaugcaggacgacaucuucauccuccacgagcaggaguacgacucccuccucgaguccgucuucaagaccgaguuccucucccuccucgccaagcgcuacgaggagaagacccagaagcagcucccccucaaguucuccaacacccucgagcucaagcucaagaaggagaacuggggccccugguccgccggcggcucccgccagguccaguuccaccagggcuucggcgaccucgccguccucaagcccuccaacaagguccuccaggucuccaucggccccggccuccccaagaacucccgccccacccgccgcaacaccacccagaacaccggcuacuccuccggcacccagaacgccaacuaccccguccgcgccgccccccccccccccggcuaccaccagaacggcgucauccgcaaccaguacguccccuacccccacgcccccggcucccagcgcuccaaccagaagucccucuacaccuccauggcccgccccccccucccccgccagcaguccaccuccuccgaccgcgucucccagacccccgagucccucgacuuccucaagguccccgaccagggcgccgccggcguccgccgccagaccaccucccgccccccccccgccggcggccgccccaagccccagcccaagcccaagccccaggucccccagugcaaggcccucuacgccuacgacgcccaggacaccgacgagcucuccuucaacgccaacgacaucaucgacaucaucaaggaggaccccuccggcugguggaccggccgccuccgcggcaagcagggccucuuccccaacaacuacgucaccaagaucuga

SEQ ID NO: 2824 - RNA, 3327 nt, Artificial Sequence
  derived and/or modified sequence opt3 from MYO1E__Homo_sapiens__CCDS32254.1
augggcagcaaggggguguaccaguaucacuggcaaucccauaacgucaaacacucuggaguugacgauauggugcugcucucaaagaucaccgagaauaguauuguagaaaaccuuaaaaagagauacauggacgauuauauauucacauacaucgguagcgugcugauuuccgucaaucccuuuaaacagaugccuuauuucggcgagaaggaaaucgagauguaccagggggccgcucaguaugaaaacccaccgcauauuuacgcauuggccgacaauauguacaggaacaugaucauagaucgggagaaucaaugcgugaucauuucuggagagucgggcgcggguaagacuguugcugccaaauauaucaugucauacauuagccgcgugagugggggaggcacgaagguccagcacgugaaagacaucauauuacaguccaacccccugcuagaagcauuuggcaaugccaagaccguacgaaacaauaacucuagccguuucgggaaauauuuugagauucaguucuccccuggaggugaaccagauggcgggaagaucucaaauuuucuccuggagaagaguagaguugugaugaggaaccccggagagcggagcuuccauauuuucuaccaacuuaucgaaggcgcuucugcagagcagaaacacucccuggguaucacaucaauggacuauuacuauuacuugagccucagugggucuuacaaggucgaugacauugaugaccgcagagaauuucaggagacucugcacgccaugaaugugauaggaaucuuugcugaggaacagacccuggugcuccaaauugucgccggcaucuuacaucugggcaacauauccuucaaagagguugggaacuaugcggcaguggaaagcgaggaauuucuugccuucccugcuuacuugcugggaauuaaucaggauaggcuaaaggagaaacucacaucgcggcagauggacucuaagugggguggcaaauccgaaucaauccacguaacccugaacguggagcaagccuguuauacucgcgacgcacuugcuaaggcccugcaugcgcgagucuucgauuuucucguggacaguaucaauaaggccauggagaaagaucacgaagaguacaacauugggguucucgacaucuauggauucgaaauuuuucagaagaauggcuucgagcaguuuugcauaaacuucgugaaugaaaaacugcagcaaaucuuuauugaguuaacacugaaggcagagcaggaagaguacguccaggaagguaucagauggaccccaaucgaguauuucaacaauaaaauugugugugaucucauagagaacaagguaaaucccccugggaucaugagcauucuugacgauguuugcgcuacgaugcacgccgugggcgaaggagcugaccagacucuguugcaaaagcuacagaugcagaucggcucccaugagcacuuuaacucuuggaaucagggguucauuauccaucacuacgccggaaaagucagcuacgauauggacgguuuuugugaaaggaaccgggaugugcuguucauggaccucauagagcugaugcaaucaagugaacuuccauuuaucaagucccuguucccggagaauuugcaggcagacaaaaagggccgucccaccacagccgggagcaaaauuaagaagcaggcuaacgaucucgucucuacucugaugaaaugcaccccucauuauauccgcuguauuaagccaaacgagaccaaaaagcccagagacugggaagagucaagggugaaacaccagguugaauacuuaggacugaaggagaauauccgggugcgacgcgcgggcuaugcauacagaaggauauuccaaaaguuucuacagcgguaugccauucucacaaaagcuacguggccuaguuggcagggugaagagaagcaagggguacugcaccuuuugcagagcgucaacauggauuccgaccaguuccagcugggccgcucuaaaguguuuaucaaggccccagagucguuguuccugcuugaagagaugagagaaaggaaauacgauggauaugcacguguuauucaaaagagcuggcggaaauuuguggcccgaaagaaguacguccagaugagagaggaggcuuccgaccuguugcucaauaaaaaggaaaggcgccggaacucaaucaauagaaacuucauaggcgauuacaucgggauggaggaacaucccgagcugcagcaguuugugggaaaaagggaaaagauugacuucgccgauacuguaacaaaauaugaccgccgauuuaagggugugaagcgggauuuacugcuaaccccgaaaugccucuaccugaucggccgugagaagguuaaacaagggccugacaagggacuugucaaagagguguugaagagaaagauugaaaucgagaggauacugagugugucucucagcacuaugcaggaugacauuuucauccugcacgaacaggaguaugacuccuuacuggaaucagucuuuaaaacagaguuccuuagcuugcucgcaaagcgcuacgaggagaaaacccagaagcaacugccccuaaaauuuucuaauacgcuggaacucaagcugaagaaagaaaacuggggcccaugguccgcgggugggagucggcagguucaguuccaucaaggcuucggagaucuugcuguguugaagccuagcaauaaagugcugcagguaucuaucggccccggguuaccaaagaacuccagacccaccaggcgaaauacaacucagaacaccggauauucaaguggcacacagaaugccaacuacccuguccgcgcagccccaccgcccccugguuaucaccaaaauggggugauucggaaccaguacguuccauacccccacgcuccuggaagccagagaucgaaccagaaaucccucuauacuucuauggccaggccaccccugccgcgucaacagagcaccucaagugaccgcgugucccagacaccugagucucuugauuuucugaaggucccagaccagggcgcagcuggugugcggagacaaaccacuagcaggcccccucccgccggcgggcgaccaaaaccucagcccaagccaaagccgcagguuccucaguguaaagcguuguacgccuaugaugcucaagacacggaugaacucuccuucaaugcaaacgacaucauugauauaaucaaggaggaccccucaggaugguggacaggccggcugcgcgggaaacagggacuauuuccaaauaacuacgugaccaagauuuga

SEQ ID NO: 2825 - RNA, 3327 nt, Artificial Sequence
  derived and/or modified sequence opt4 from MYO1E__Homo_sapiens__CCDS32254.1
augggcagcaagggcguguaccaguaccacuggcagagccacaacgugaagcacagcggcguggacgacauggugcugcugagcaagaucaccgagaacagcaucguggagaaccugaagaagagauacauggacgacuacaucuucaccuacaucggcagcgugcugaucagcgugaaccccuucaagcagaugcccuacuucggcgagaaggagaucgagauguaccagggcgccgcccaguacgagaaccccccccacaucuacgcccuggccgacaacauguacagaaacaugaucaucgacagagagaaccagugcgugaucaucagcggcgagagcggcgccggcaagaccguggccgccaaguacaucaugagcuacaucagcagagugagcggcggcggcaccaaggugcagcacgugaaggacaucauccugcagagcaacccccugcuggaggccuucggcaacgccaagaccgugagaaacaacaacagcagcagauucggcaaguacuucgagauccaguucagccccggcggcgagcccgacggcggcaagaucagcaacuuccugcuggagaagagcagaguggugaugagaaaccccggcgagagaagcuuccacaucuucuaccagcugaucgagggcgccagcgccgagcagaagcacagccugggcaucaccagcauggacuacuacuacuaccugagccugagcggcagcuacaagguggacgacaucgacgacagaagagaguuccaggagacccugcacgccaugaacgugaucggcaucuucgccgaggagcagacccuggugcugcagaucguggccggcauccugcaccugggcaacaucagcuucaaggaggugggcaacuacgccgccguggagagcgaggaguuccuggccuuccccgccuaccugcugggcaucaaccaggacagacugaaggagaagcugaccagcagacagauggacagcaaguggggcggcaagagcgagagcauccacgugacccugaacguggagcaggccugcuacaccagagacgcccuggccaaggcccugcacgccagaguguucgacuuccugguggacagcaucaacaaggccauggagaaggaccacgaggaguacaacaucggcgugcuggacaucuacggcuucgagaucuuccagaagaacggcuucgagcaguucugcaucaacuucgugaacgagaagcugcagcagaucuucaucgagcugacccugaaggccgagcaggaggaguacgugcaggagggcaucagauggacccccaucgaguacuucaacaacaagaucgugugcgaccugaucgagaacaaggugaacccccccggcaucaugagcauccuggacgacgugugcgccaccaugcacgccgugggcgagggcgccgaccagacccugcugcagaagcugcagaugcagaucggcagccacgagcacuucaacagcuggaaccagggcuucaucauccaccacuacgccggcaaggugagcuacgacauggacggcuucugcgagagaaacagagacgugcuguucauggaccugaucgagcugaugcagagcagcgagcugcccuucaucaagagccuguuccccgagaaccugcaggccgacaagaagggcagacccaccaccgccggcagcaagaucaagaagcaggccaacgaccuggugagcacccugaugaagugcaccccccacuacaucagaugcaucaagcccaacgagaccaagaagcccagagacugggaggagagcagagugaagcaccagguggaguaccugggccugaaggagaacaucagagugagaagagccggcuacgccuacagaagaaucuuccagaaguuccugcagagauacgccauccugaccaaggccaccuggcccagcuggcagggcgaggagaagcagggcgugcugcaccugcugcagagcgugaacauggacagcgaccaguuccagcugggcagaagcaagguguucaucaaggcccccgagagccuguuccugcuggaggagaugagagagagaaaguacgacggcuacgccagagugauccagaagagcuggagaaaguucguggccagaaagaaguacgugcagaugagagaggaggccagcgaccugcugcugaacaagaaggagagaagaagaaacagcaucaacagaaacuucaucggcgacuacaucggcauggaggagcaccccgagcugcagcaguucgugggcaagagagagaagaucgacuucgccgacaccgugaccaaguacgacagaagauucaagggcgugaagagagaccugcugcugacccccaagugccuguaccugaucggcagagagaaggugaagcagggccccgacaagggccuggugaaggaggugcugaagagaaagaucgagaucgagagaauccugagcgugagccugagcaccaugcaggacgacaucuucauccugcacgagcaggaguacgacagccugcuggagagcguguucaagaccgaguuccugagccugcuggccaagagauacgaggagaagacccagaagcagcugccccugaaguucagcaacacccuggagcugaagcugaagaaggagaacuggggccccuggagcgccggcggcagcagacaggugcaguuccaccagggcuucggcgaccuggccgugcugaagcccagcaacaaggugcugcaggugagcaucggccccggccugcccaagaacagcagacccaccagaagaaacaccacccagaacaccggcuacagcagcggcacccagaacgccaacuaccccgugagagccgccccccccccccccggcuaccaccagaacggcgugaucagaaaccaguacgugcccuacccccacgcccccggcagccagagaagcaaccagaagagccuguacaccagcauggccagacccccccugcccagacagcagagcaccagcagcgacagagugagccagacccccgagagccuggacuuccugaaggugcccgaccagggcgccgccggcgugagaagacagaccaccagcagacccccccccgccggcggcagacccaagccccagcccaagcccaagccccaggugccccagugcaaggcccuguacgccuacgacgcccaggacaccgacgagcugagcuucaacgccaacgacaucaucgacaucaucaaggaggaccccagcggcugguggaccggcagacugagaggcaagcagggccuguuccccaacaacuacgugaccaagaucuga

SEQ ID NO: 2826 - RNA, 3327 nt, Artificial Sequence
  derived and/or modified sequence opt5 from MYO1E__Homo_sapiens__CCDS32254.1
augggcagcaaggggguguaccaguaucacuggcaaucccauaacgucaaacacucuggaguugacgauauggugcugcucagcaagaucaccgaaaauuccauuguggaaaaccugaaaaagagauacauggacgauuauaucuucacauacauuggcucuguccuuaucagcgugaaucccuuuaaacagaugccuuauuucggggagaaggaaauugagauguaccagggagccgcucaguaugaaaacccgccccauaucuacgcccuggcggacaauauguaccggaacaugaucauugaucgcgagaaucaaugcguuaucauuuccggcgagucuggggcuggaaagacgguggccgccaaauauaucaugagcuacauuuccagagucagcggcggcgggaccaaggugcagcacguuaaagacaucauucuccagucuaacccucugcuugaggcuuuuggaaaugccaagacagugcggaacaauaacuccagccgcuucggcaaauauuuugagauccaguucucucccgggggagaaccugauggcgggaagaucuccaauuuucugcucgaaaagagcagagucgugaugcggaaccccggagagcgcucuuuccauaucuuuuaccaacugauugaaggcgcuuccgccgagcagaaacacagccugggcauuaccuccauggacuauuacuauuaccucucucugagcggguccuacaagguggaugacaucgaugacagacgggaguuccaggagacacuucacgcgaugaaugucauuggaaucuuugccgaggaacagacccugguucuccaaaucguggcuggcauucugcaucuugggaacaucagcuucaaagaggugggaaacuaugccgcugucgaaucugaggaauuucuggccuucccugcguaccuccugggcauuaaucaggaucgccugaaggagaaacucacauccagacagauggacagcaaguggggagggaaaucugaaagcauccacgugacccugaacguugagcaagccuguuauacgcgggacgcucuugccaaggcucugcaugcccgcguguucgauuuucucgucgacuccauuaauaaggccauggagaaagaucacgaagaguacaacaucggcgugcuggacaucuauggcuucgaaauuuuucagaagaauggguucgagcaguuuugcaucaacuucguuaaugaaaaacuucagcaaauuuuuaucgagcugacccucaaggcugagcaggaagaguacgugcaggaaggaauuagauggacaccgaucgaguauuucaacaauaaaauugucugugaucugaucgagaacaaggugaaucccccuggcaucaugucuauucuggacgaugucugcgcgaccaugcacgccgugggggaaggagcugaccagacacuccugcaaaaacuucagaugcagaucggcagccaugagcacuuuaacuccuggaaucagggguucauuauccaucacuacgccggcaaaguuagcuacgauauggacggauuuugugaacggaaccgcgaugugcuguucauggaccucauugagcugaugcaaucuuccgaacuucccuuuaucaagagccuguucccugagaaucuccaggccgacaaaaagggcagacccaccacggcugggucuaaaaucaagaagcaggccaacgaucuggucuccacacugaugaaaugcaccccgcauuauauucgguguaucaagccuaacgagacaaagaagcccagagacugggaagagagccgcgugaaacaccagguugaauaccucggacugaaggagaauauucgggugagacgcgcgggcuaugcuuaccggagaaucuuccaaaaguuucuucagcgcuaugccauucugaccaaagccaccuggccuuccuggcagggggaagagaagcaaggaguccuccaucugcugcagucugugaacauggauagcgaccaguuccagcuuggccgguccaaaguguuuaucaaggcucccgagucucucuuccugcuggaagagaugagagaacgcaaauacgauggguaugcccggguuauccaaaagagcuggagaaaauuugucgcucgcaagaaguacgugcagaugcgggaggaagccuccgaccuccugcuuaauaaaaaggagagacggcgcaacagcauuaauagaaacuucaucggcgauuacauuggaauggaggaacaccccgagcugcagcaguuugugggcaaacgggaaaagaucgacuucgcggauacagucacgaaauaugacagacgcuuuaagggggugaagcgggaucuccugcugaccccuaaaugccuuuaccucauuggaagagagaagguuaaacaaggcccggacaaggggcuggugaaagagguccugaagcgcaagaucgaaaucgagcggauucucucugugucccugagcacaaugcaggaugacaucuucauucuucacgaacaggaguaugacucucugcucgaauccguuuuuaaaaccgaguuccugagccugcuugccaagagauacgaggagaaaacacagaagcaacucccccugaaauuuucuaauacccuggaacucaagcugaagaaagaaaacuggggaccuuggagcgcuggcgggucccgccaggugcaguuccaucaaggcuucggagaucuugccguccugaagcccagcaauaaagugcuccagguuucuaucggcccugggcugcccaagaacuccagaccgacgcggcgcaauacaacccagaacaccggauauagcuccggcacacagaaugcuaacuacccugugagagccgcgcccccucccccuggguaucaccaaaauggagucauucggaaccaguacgugcccuacccgcacgccccuggcucucagcgcagcaaccagaaaucccuguauaccucuauggcuagaccuccccuuccccggcaacagagcacauccucugaccgcgugagccagacgccggagucccucgauuuucugaagguccccgaccagggggccgcuggcguuagacggcaaaccacaagcagaccucccccugccggaggccgccccaaaccucagcccaagccgaagccucaggugccccaguguaaagcccuguacgcuuaugaugcgcaagacaccgaugaacucucuuucaaugccaacgacaucauugauaucaucaaggaggacccuuccgggugguggacaggacggcugagaggcaaacaggggcuuuuucccaauaacuacgugaccaagauuuga

SEQ ID NO: 2827 - protein, 1098 aa, Artificial Sequence
  MYO1F__Homo_sapiens__O00160
MGSKERFHWQSHNVKQSGVDDMVLLPQITEDAIAANLRKRFMDDYIFTYIGSVLISVNPFKQMPYFTDREIDLYQGAAQYENPPHIYALTDNMYRNMLIDCENQCVIISGESGAGKTVAAKYIMGYISKVSGGGEKVQHVKDIILQSNPLLEAFGNAKTVRNNNSSRFGKYFEIQFSRGGEPDGGKISNFLLEKSRVVMQNENERNFHIYYQLLEGASQEQRQNLGLMTPDYYYYLNQSDTYQVDGTDDRSDFGETLSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYAGKVSYDVSGFCERNRDVLFSDLIELMQTSEQAFLRMLFPEKLDGDKKGRPSTAGSKIKKQANDLVATLMRCTPHYIRCIKPNETKRPRDWEENRVKHQVEYLGLKENIRVRRAGFAYRRQFAKFLQRYAILTPETWPRWRGDERQGVQHLLRAVNMEPDQYQMGSTKVFVKNPESLFLLEEVRERKFDGFARTIQKAWRRHVAVRKYEEMREEASNILLNKKERRRNSINRNFVGDYLGLEERPELRQFLGKRERVDFADSVTKYDRRFKPIKRDLILTPKCVYVIGREKVKKGPEKGQVCEVLKKKVDIQALRGVSLSTRQDDFFILQEDAADSFLESVFKTEFVSLLCKRFEEATRRPLPLTFSDTLQFRVKKEGWGGGGTRSVTFSRGFGDLAVLKVGGRTLTVSVGDGLPKSSKPTRKGMAKGKPRRSSQAPTRAAPAPPRGMDRNGVPPSARGGPLPLEIMSGGGTHRPPRGPPSTSLGASRRPRARPPSEHNTEFLNVPDQGMAGMQRKRSVGQRPVPGVGRPKPQPRTHGPRCRALYQYVGQDVDELSFNVNEVIEILMEDPSGWWKGRLHGQEGLFPGNYVEKI

SEQ ID NO: 2828 - RNA, 3297 nt, Artificial Sequence
  MYO1F__Homo_sapiens__AAH28071
augggcagcaaggagcgcuuccacuggcagagccacaacgugaagcagagcggcguggaugacauggugcuucuuccccagaucaccgaagacgccauugccgccaaccuccggaagcgcuucauggacgacuacaucuucaccuacaucggcucugugcucaucucuguaaaccccuucaagcagaugcccuacuucaccgaccgugagaucgaccucuaucagggcgcggcccaguaugagaaucccccgcacaucuacgcccucacggacaacauguaccggaacaugcuuaucgacugugagaaccagugugucaucauuaguggagagaguggagcugggaagacaguggcagccaaauauaucaugggcuacaucuccaaggugucuggcggaggcgagaagguccagcacgucaaagauaucauccugcaguccaacccgcugcucgaggccuucggcaacgccaagacugugcgcaacaacaauuccagccgcuuuggcaaguacuuugagauccaguucagccgagguggggagccagaugggggcaagaucuccaacuucuugcuggagaagucccgcguggucaugcaaaaugaaaaugagaggaacuuccacaucuacuaccagcugcuggaaggggccucccaggagcaaaggcagaaccugggccucaugacaccggacuacuauuacuaccucaaccaaucggacaccuaccagguggacggcacggacgacagaagcgacuuuggugagacucugagugcuaugcagguuauugggaucccgcccagcauccagcagcugguccugcagcucguggcggggaucuugcaccuggggaacaucaguuucugugaagacgggaauuacgcccgaguggagaguguggaccuccuggccuuucccgccuaccugcugggcauugacagcgggcgacugcaggagaagcugaccagccgcaagauggacagccgcuggggcgggcgcagcgaguccaucaaugugacccucaacguggagcaggcagccuacacccgugaugcccuggccaaggggcucuaugcccgccucuucgacuuccucguggaggccaucaaccgugcuaugcagaaaccccaggaagaguacagcaucggugugcuggacauuuacggcuucgagaucuuccagaaaaauggcuucgagcaguuuugcaucaacuucgucaaugagaagcugcagcaaaucuuuaucgaacuuacccugaaggccgagcaggaggaguaugugcaggaaggcauccgcuggacuccaauccaguacuucaacaacaaggucgucugugaccucaucgaaaacaagcugagccccccaggcaucaugagcgucuuggacgacgugugcgccaccaugcacgccacgggcgggggagcagaccagacacugcugcagaagcugcaggcggcuguggggacccacgagcauuucaacagcuggagcgccggcuucgucauccaccacuacgcuggcaaggucuccuacgacgucagcggcuucugcgagaggaaccgagacguucucuucuccgaccucauagagcugaugcagaccagugagcaggccuuccuccggaugcucuuccccgagaagcuggauggagacaagaaggggcgccccagcaccgccggcuccaagaucaagaaacaagccaacgaccugguggccacacugaugaggugcacaccccacuacauccgcugcaucaaacccaacgagaccaagaggccccgagacugggaggagaacagagucaagcaccagguggaauaccugggccugaaggagaacaucagggugcgcagagccggcuucgccuaccgccgccaguucgccaaauuccugcagagguaugccauucugacccccgagacguggccgcgguggcguggggacgaacgccagggcguccagcaccugcuucgggcggucaacauggagcccgaccaguaccagauggggagcaccaaggucuuugucaagaacccagagucgcuuuuccuccuggaggaggugcgagagcgaaaguucgauggcuuugcccgaaccauccagaaggccuggcggcgccacguggcuguccggaaguacgaggagaugcgggaggaagcuuccaacauccugcugaacaagaaggagcggaggcgcaacagcaucaaucggaacuucgucggggacuaccuggggcuggaggagcggcccgagcugcgucaguuccugggcaagagggagcggguggacuucgccgauucggucaccaaguacgaccgccgcuucaagcccaucaagcgggacuugauccugacgcccaaguguguguaugugauugggcgagagaaagugaagaagggaccugagaagggccaggugugugaagucuugaagaagaaaguggacauccaggcucugcggggagucucccucagcacgcgacaggacgacuucuucauccuccaagaggaugccgccgacagcuuccuggagagcgucuucaagaccgaguuugucagccuucugugcaagcgcuucgaggaggcgacgcggaggccccugccccucaccuucagcgacacacuacaguuucgggugaagaaggagggcuggggcgguggcggcacccgcagcgucaccuucucccgcggcuucggcgacuuggcagugcucaagguuggcggucggacccucacggucagcgugggcgaugggcugcccaagagcuccaagccuacgcggaagggaauggccaagggaaaaccucggaggucgucccaagccccuacccgggcggccccugcgccccccagaggcauggaucgcaauggggugccccccucugccagagggggcccccugccccuggagaucaugucuggagggggcacccacaggccuccccggggcccuccguccacaucccugggagccagcagacgaccccgggcacguccgcccucagagcacaacacagaauuccucaacgugccugaccagggcauggccggcaugcagaggaagcgcagcguggggcaacggccagugccuggugugggccgacccaagccccagccucggacacauggucccaggugccgggcccuauaccaguacgugggccaagauguggacgagcugagcuucaacgugaacgaggucauugagauccucauggaagaucccucgggcugguggaagggccggcuucacggccaggagggccuuuucccaggaaacuacguggagaagaucuga

SEQ ID NO: 2829 - RNA, 3297 nt, Artificial Sequence
  derived and/or modified sequence opt1 from MYO1F__Homo_sapiens__AAH28071
augggcagcaaggagcgcuuccacuggcagucccacaacgugaagcagagcggggucgacgacauggugcugcucccccagaucaccgaggacgccaucgccgcgaaccugcggaagcgcuucauggacgacuacaucuucaccuacaucggcuccgugcugaucagcgucaacccguucaagcagaugcccuacuucacggaccgggagaucgaccucuaccagggggccgcccaguacgagaacccgccccacaucuacgcccugaccgacaacauguaccgcaacaugcugaucgacugcgagaaccagugcgugaucaucuccggcgagagcggggccggcaagaccguggcggccaaguacaucaugggcuacaucuccaaggucagcgggggcggggagaaggugcagcacgugaaggacaucauccuccaguccaacccccugcuggaggccuucggcaacgccaagaccguccggaacaacaacagcucccgcuucgggaaguacuucgagauccaguucagccggggcggcgagcccgacgggggcaagaucuccaacuuccuccuggagaagucccgcguggugaugcagaacgagaacgagcggaacuuccacaucuacuaccagcugcucgagggggcgucccaggagcagcgccagaaccugggccugaugacgcccgacuacuacuacuaccucaaccagagcgacaccuaccaggucgacggcaccgacgaccgguccgacuucggggagacccugagcgccaugcaggucaucggcaucccgcccuccauccagcagcuggugcuccagcuggucgccgggauccugcaccucggcaacaucagcuucugcgaggacgggaacuacgcccgcguggagagcguggaccugcuggccuuccccgcguaccuccugggcaucgacuccggccggcugcaggagaagcucacgagccgcaagauggacucccgguggggcgggcgcagcgaguccaucaacgucacccugaacguggagcaggccgccuacacccgggacgcccuggccaaggggcucuacgcgcgccuguucgacuuccugguggaggccaucaaccgggccaugcagaagccccaggaggaguacagcaucggcgugcucgacaucuacggguucgagaucuuccagaagaacggcuucgagcaguucugcaucaacuucgugaacgagaagcugcagcagaucuucaucgagcugacccucaaggccgagcaggaggaguacgugcaggagggcauccgcuggacgcccauccaguacuucaacaacaaggucgugugcgaccugaucgagaacaagcugagcccgcccgggaucaugagcguccucgacgacgugugcgccaccaugcacgcgaccggcgggggcgccgaccagacccugcugcagaagcuccaggccgccguggggacgcacgagcacuucaacuccuggagcgccggcuucgucauccaccacuacgcgggcaagguguccuacgacgugagcggguucugcgagcggaaccgcgacguccuguucuccgaccugaucgagcucaugcagaccagcgagcaggccuuccugcgcaugcuguuccccgagaagcucgacggcgacaagaaggggcggcccuccaccgccggcagcaagaucaagaagcaggccaacgaccugguggcgacccugaugcgcugcacgccgcacuacauccggugcaucaagcccaacgagaccaagcgcccccgggacugggaggagaaccgcgugaagcaccaggucgaguaccugggccucaaggagaacauccgggugcgccgggccggguucgccuaccgccggcaguucgccaaguuccugcagcgcuacgccauccugacccccgagaccuggccgcgguggcgcggcgacgagcggcagggggugcagcaccuccugcgcgcggucaacauggagcccgaccaguaccagaugggcuccacgaagguguucgugaagaaccccgagagccuguuccuccuggaggagguccgggagcgcaaguucgacggguucgcccggaccauccagaaggccuggcgccgccacguggccgugcggaaguacgaggagaugcgcgaggaggccuccaacauccugcucaacaagaaggagcggcgccggaacagcaucaaccgcaacuucgucggcgacuaccugggccuggaggagcggcccgagcuccgccaguuccuggggaagcgggagcgcguggacuucgcggacagcgugaccaaguacgaccggcgcuucaagccgaucaagcgggaccugauccucacccccaagugcgucuacgugaucggccgcgagaaggugaagaaggggcccgagaagggccaggucugcgaggugcugaagaagaagguggacauccaggcccugcgcggggucucccucagcacgcggcaggacgacuucuucauccugcaggaggacgccgccgacuccuuccuggagagcguguucaagaccgaguucgugucccuccugugcaagcgguucgaggaggccacccgccggccccugccgcucaccuucagcgacacgcugcaguuccgcgucaagaaggagggcuggggcgggggcgggacccgguccgugaccuucagccgcggcuucggggaccuggcggugcucaaggucggcggccgcacccugacgguguccgugggggacggccugcccaagagcuccaagcccacccggaaggggauggccaagggcaagccgcgccggagcucccaggcccccacccgcgccgcgcccgcgcccccgcgggggauggaccgcaacggcgucccgcccagcgcccggggcgggccccucccccuggagaucauguccggcgggggcacccaccgcccgccccggggcccgcccagcaccucccugggggccagccgccggccccgcgcccggccgcccagcgagcacaacacggaguuccucaacgugcccgaccagggcauggccgggaugcagcgcaagcgguccgugggccagcgccccguccccggggugggccggcccaagccccagccccgcacccacggcccccggugccgcgcccuguaccaguacguggggcaggacgucgacgagcugagcuucaacgugaacgaggugaucgagauccucauggaggaccccuccggcugguggaaggggcgccugcacggccaggaggggcuguucccgggcaacuacgucgagaagaucuga

SEQ ID NO: 2830 - RNA, 3297 nt, Artificial Sequence
  derived and/or modified sequence opt2 from MYO1F__Homo_sapiens__AAH28071
augggcuccaaggagcgcuuccacuggcagucccacaacgucaagcaguccggcgucgacgacaugguccuccucccccagaucaccgaggacgccaucgccgccaaccuccgcaagcgcuucauggacgacuacaucuucaccuacaucggcuccguccucaucuccgucaaccccuucaagcagaugcccuacuucaccgaccgcgagaucgaccucuaccagggcgccgcccaguacgagaaccccccccacaucuacgcccucaccgacaacauguaccgcaacaugcucaucgacugcgagaaccagugcgucaucaucuccggcgaguccggcgccggcaagaccgucgccgccaaguacaucaugggcuacaucuccaaggucuccggcggcggcgagaagguccagcacgucaaggacaucauccuccaguccaacccccuccucgaggccuucggcaacgccaagaccguccgcaacaacaacuccucccgcuucggcaaguacuucgagauccaguucucccgcggcggcgagcccgacggcggcaagaucuccaacuuccuccucgagaagucccgcgucgucaugcagaacgagaacgagcgcaacuuccacaucuacuaccagcuccucgagggcgccucccaggagcagcgccagaaccucggccucaugacccccgacuacuacuacuaccucaaccaguccgacaccuaccaggucgacggcaccgacgaccgcuccgacuucggcgagacccucuccgccaugcaggucaucggcaucccccccuccauccagcagcucguccuccagcucgucgccggcauccuccaccucggcaacaucuccuucugcgaggacggcaacuacgcccgcgucgaguccgucgaccuccucgccuuccccgccuaccuccucggcaucgacuccggccgccuccaggagaagcucaccucccgcaagauggacucccgcuggggcggccgcuccgaguccaucaacgucacccucaacgucgagcaggccgccuacacccgcgacgcccucgccaagggccucuacgcccgccucuucgacuuccucgucgaggccaucaaccgcgccaugcagaagccccaggaggaguacuccaucggcguccucgacaucuacggcuucgagaucuuccagaagaacggcuucgagcaguucugcaucaacuucgucaacgagaagcuccagcagaucuucaucgagcucacccucaaggccgagcaggaggaguacguccaggagggcauccgcuggacccccauccaguacuucaacaacaaggucgucugcgaccucaucgagaacaagcucuccccccccggcaucauguccguccucgacgacgucugcgccaccaugcacgccaccggcggcggcgccgaccagacccuccuccagaagcuccaggccgccgucggcacccacgagcacuucaacuccugguccgccggcuucgucauccaccacuacgccggcaaggucuccuacgacgucuccggcuucugcgagcgcaaccgcgacguccucuucuccgaccucaucgagcucaugcagaccuccgagcaggccuuccuccgcaugcucuuccccgagaagcucgacggcgacaagaagggccgccccuccaccgccggcuccaagaucaagaagcaggccaacgaccucgucgccacccucaugcgcugcaccccccacuacauccgcugcaucaagcccaacgagaccaagcgcccccgcgacugggaggagaaccgcgucaagcaccaggucgaguaccucggccucaaggagaacauccgcguccgccgcgccggcuucgccuaccgccgccaguucgccaaguuccuccagcgcuacgccauccucacccccgagaccuggccccgcuggcgcggcgacgagcgccagggcguccagcaccuccuccgcgccgucaacauggagcccgaccaguaccagaugggcuccaccaaggucuucgucaagaaccccgagucccucuuccuccucgaggagguccgcgagcgcaaguucgacggcuucgcccgcaccauccagaaggccuggcgccgccacgucgccguccgcaaguacgaggagaugcgcgaggaggccuccaacauccuccucaacaagaaggagcgccgccgcaacuccaucaaccgcaacuucgucggcgacuaccucggccucgaggagcgccccgagcuccgccaguuccucggcaagcgcgagcgcgucgacuucgccgacuccgucaccaaguacgaccgccgcuucaagcccaucaagcgcgaccucauccucacccccaagugcgucuacgucaucggccgcgagaaggucaagaagggccccgagaagggccaggucugcgagguccucaagaagaaggucgacauccaggcccuccgcggcgucucccucuccacccgccaggacgacuucuucauccuccaggaggacgccgccgacuccuuccucgaguccgucuucaagaccgaguucgucucccuccucugcaagcgcuucgaggaggccacccgccgcccccucccccucaccuucuccgacacccuccaguuccgcgucaagaaggagggcuggggcggcggcggcacccgcuccgucaccuucucccgcggcuucggcgaccucgccguccucaaggucggcggccgcacccucaccgucuccgucggcgacggccuccccaaguccuccaagcccacccgcaagggcauggccaagggcaagccccgccgcuccucccaggcccccacccgcgccgcccccgcccccccccgcggcauggaccgcaacggcgucccccccuccgcccgcggcggcccccucccccucgagaucauguccggcggcggcacccaccgccccccccgcggcccccccuccaccucccucggcgccucccgccgcccccgcgcccgcccccccuccgagcacaacaccgaguuccucaacguccccgaccagggcauggccggcaugcagcgcaagcgcuccgucggccagcgccccguccccggcgucggccgccccaagccccagccccgcacccacggcccccgcugccgcgcccucuaccaguacgucggccaggacgucgacgagcucuccuucaacgucaacgaggucaucgagauccucauggaggaccccuccggcugguggaagggccgccuccacggccaggagggccucuuccccggcaacuacgucgagaagaucuga

SEQ ID NO: 2831 - RNA, 3297 nt, Artificial Sequence
  derived and/or modified sequence opt3 from MYO1F__Homo_sapiens__AAH28071
augggcagcaaggagagauuccacuggcagucccauaacgugaaacaaucuggggucgacgauaugguucugcucccccagaucaccgaagacgccauugcugcaaaucuuaggaagcgguuuauggaugacuacauauucacauauaucggaucagugcugauuaguguaaacccuuuuaaacagaugccauacuucacugaucgcgagaucgacuuguaucagggugccgcgcaauacgaaaauccgccccacauuuaugcuuuaacggauaacauguaccgaaauaugcugaucgacugcgagaaccagugugugauaaucagcggcgaauccggggccggaaagaccgucgcagccaaauauauuaugggcuacaucucuaaggugucgggugggggagagaagguucagcaugugaaagauauuauccuacagucaaauccucuccuggaggcuuuuggcaacgcaaagacaguccguaauaacaauagcaguagauucggcaaauacuuugaaauacaauucuccaggggaggagagccagacgguggcaagauuucuaacuuucuucuggagaaaagccgggugguaaugcagaaugaaaacgagcgcaauuuccacaucuauuaccaguugcucgaaggggccucccaggagcaaagacagaaccugggacugaugacucccgauuauuacuauuaccucaaccagucagacaccuaucaaguugauggcacagacgacaggagugauuuuggugaaaccuuaagcgcuaugcaagugauugggaucccuccaucuauccagcagcugguccuucaguugguggccgggauucugcaucuaggcaauauauccuucugcgaggacggcaacuacgcgcggguggaaucagucgaucuccuggcauuucccgccuaccuucuggggaucgacagcggacgcuugcaggagaagcucacuucacgaaagauggauucuagaugggguggcagguccgagagcauuaauguuacacugaacguggaacaggcugccuauacccgggacgcauuagcuaaagggcuguacgcccgucucuucgauuuccuuguagaggcgaucaaucgcgccaugcagaagccucaagaagaguauucgauaggagugcuggacauuuacggcuuugaaaucuuccagaaaaacgguuuugagcaguucuguaucaauuuugucaacgagaaguugcagcaaauuuucaucgaacuaacgcugaaagcagagcaggaagaguaugugcaggaagggauuagauggacuccaauacaguacuuuaauaacaagguugugugcgaucucaucgagaauaaacugucuccgcccggcauuauguccguccuugacgaugugugugcuaccaugcacgccacaggaggcggggcugaccaaacucuguugcagaagcuccaggccgcaguaggaacccacgagcauuucaacucauggagugccgguuuuguuauccaccauuaugcuggcaaggugagcuacgacgucuccggguucugcgaaaggaaucgggaugugcuguuuucugacuuaaucgagcugaugcaaacaagcgaacaggcguuccuacgaaugcucuuuccugagaaacuggauggagacaagaaaggccgcccaucaaccgcagguaguaagauuaaaaagcaggccaacgaucuugucgcuacguugaugagauguacuccccacuacauaaggugcaucaagccuaaugagacaaaacggccacgcgacugggaagagaacagagugaagcaccagguugaauaucuggggcucaaagagaacauuagggugcgucgggccggcuucgcauaccgaagacaauucgccaaguuucugcagagguaugcuauccuuacccccgaaacuuggccgcgcuggcggggagaugagagacagggcguacagcaucuguugagggccgucaauauggagccugaccaauaccagaugggguccacaaaaguguucguuaagaaccccgaaagccucuuucuguuagaggaagugcgcgagcgaaaguucgauggauuugcacggaccauucagaaagcguggcguagacacgucgcugugaggaaguaugaagagaugcgcgaggaagccucuaauauccugcuaaacaaaaaggagcggagaaggaauaguauaaaccgaaauuucguaggugacuaccucggccuggaggaacgcccagaacuucggcaguuuuuggggaaaagagagaggguggauuucgcagacaguguuacgaaguaugaucgucgcuuuaagccuaucaaacgggaccugauucucacccccaagugugucuacgugaucggaagagagaaagugaagaaaggcccagaaaagggucaagucugcgagguucugaaaaagaagguggacauucaggccuuacgaggggugagccuguccacaaggcaggaugacuucuuuauccuucaagaagaugcugccgacucuuucuuggagucgguauuuaaaacugaguucgucagccuccuguguaagcgguucgaagaggcaacccgcagaccccuaccucugacauuuuccgauacucuccaguucagggugaaaaaggaaggcuggggaggcgggggaacccggucaguuacauuuagucgaggcuucggugaccuggcugugcuuaaagucgggggaagaaccuugacugugucuguuggcgauggucugccaaagagcuccaagccgacgcgcaaaggcauggccaaggggaaacccaggcguucaagccaggcgccuacacgggccgcuccagcacccccuagaggaauggacaggaacggcgugccacccucugcccgcgggggaccguuaccucucgagauaauguccggcggugggacccaucgaccacccagaggaccucccaguacuagccugggcgcuucucggaggccacgcgcccguccucccuccgaacacaauaccgaguuucuuaacguaccagaucaggguauggcaggcaugcaaagaaagcggucagucgggcagaggccggugccuggagugggccgccccaaaccacagccccgaacacaugggccuagaugccgggcgcuguaccaguaugucggacaagacguugaugaguugaguuucaaugugaacgaaguaauugagauccucauggaagacccaagcggcugguggaaggguaggcugcacgggcaggagggacuauuucccggcaauuacguggaaaagauuuga

SEQ ID NO: 2832 - RNA, 3297 nt, Artificial Sequence
  derived and/or modified sequence opt4 from MYO1F__Homo_sapiens__AAH28071
augggcagcaaggagagauuccacuggcagagccacaacgugaagcagagcggcguggacgacauggugcugcugccccagaucaccgaggacgccaucgccgccaaccugagaaagagauucauggacgacuacaucuucaccuacaucggcagcgugcugaucagcgugaaccccuucaagcagaugcccuacuucaccgacagagagaucgaccuguaccagggcgccgcccaguacgagaaccccccccacaucuacgcccugaccgacaacauguacagaaacaugcugaucgacugcgagaaccagugcgugaucaucagcggcgagagcggcgccggcaagaccguggccgccaaguacaucaugggcuacaucagcaaggugagcggcggcggcgagaaggugcagcacgugaaggacaucauccugcagagcaacccccugcuggaggccuucggcaacgccaagaccgugagaaacaacaacagcagcagauucggcaaguacuucgagauccaguucagcagaggcggcgagcccgacggcggcaagaucagcaacuuccugcuggagaagagcagaguggugaugcagaacgagaacgagagaaacuuccacaucuacuaccagcugcuggagggcgccagccaggagcagagacagaaccugggccugaugacccccgacuacuacuacuaccugaaccagagcgacaccuaccagguggacggcaccgacgacagaagcgacuucggcgagacccugagcgccaugcaggugaucggcaucccccccagcauccagcagcuggugcugcagcugguggccggcauccugcaccugggcaacaucagcuucugcgaggacggcaacuacgccagaguggagagcguggaccugcuggccuuccccgccuaccugcugggcaucgacagcggcagacugcaggagaagcugaccagcagaaagauggacagcagauggggcggcagaagcgagagcaucaacgugacccugaacguggagcaggccgccuacaccagagacgcccuggccaagggccuguacgccagacuguucgacuuccugguggaggccaucaacagagccaugcagaagccccaggaggaguacagcaucggcgugcuggacaucuacggcuucgagaucuuccagaagaacggcuucgagcaguucugcaucaacuucgugaacgagaagcugcagcagaucuucaucgagcugacccugaaggccgagcaggaggaguacgugcaggagggcaucagauggacccccauccaguacuucaacaacaagguggugugcgaccugaucgagaacaagcugagcccccccggcaucaugagcgugcuggacgacgugugcgccaccaugcacgccaccggcggcggcgccgaccagacccugcugcagaagcugcaggccgccgugggcacccacgagcacuucaacagcuggagcgccggcuucgugauccaccacuacgccggcaaggugagcuacgacgugagcggcuucugcgagagaaacagagacgugcuguucagcgaccugaucgagcugaugcagaccagcgagcaggccuuccugagaaugcuguuccccgagaagcuggacggcgacaagaagggcagacccagcaccgccggcagcaagaucaagaagcaggccaacgaccugguggccacccugaugagaugcaccccccacuacaucagaugcaucaagcccaacgagaccaagagacccagagacugggaggagaacagagugaagcaccagguggaguaccugggccugaaggagaacaucagagugagaagagccggcuucgccuacagaagacaguucgccaaguuccugcagagauacgccauccugacccccgagaccuggcccagauggagaggcgacgagagacagggcgugcagcaccugcugagagccgugaacauggagcccgaccaguaccagaugggcagcaccaagguguucgugaagaaccccgagagccuguuccugcuggaggaggugagagagagaaaguucgacggcuucgccagaaccauccagaaggccuggagaagacacguggccgugagaaaguacgaggagaugagagaggaggccagcaacauccugcugaacaagaaggagagaagaagaaacagcaucaacagaaacuucgugggcgacuaccugggccuggaggagagacccgagcugagacaguuccugggcaagagagagagaguggacuucgccgacagcgugaccaaguacgacagaagauucaagcccaucaagagagaccugauccugacccccaagugcguguacgugaucggcagagagaaggugaagaagggccccgagaagggccaggugugcgaggugcugaagaagaagguggacauccaggcccugagaggcgugagccugagcaccagacaggacgacuucuucauccugcaggaggacgccgccgacagcuuccuggagagcguguucaagaccgaguucgugagccugcugugcaagagauucgaggaggccaccagaagaccccugccccugaccuucagcgacacccugcaguucagagugaagaaggagggcuggggcggcggcggcaccagaagcgugaccuucagcagaggcuucggcgaccuggccgugcugaaggugggcggcagaacccugaccgugagcgugggcgacggccugcccaagagcagcaagcccaccagaaagggcauggccaagggcaagcccagaagaagcagccaggcccccaccagagccgcccccgccccccccagaggcauggacagaaacggcgugccccccagcgccagaggcggcccccugccccuggagaucaugagcggcggcggcacccacagaccccccagaggcccccccagcaccagccugggcgccagcagaagacccagagccagaccccccagcgagcacaacaccgaguuccugaacgugcccgaccagggcauggccggcaugcagagaaagagaagcgugggccagagacccgugcccggcgugggcagacccaagccccagcccagaacccacggccccagaugcagagcccuguaccaguacgugggccaggacguggacgagcugagcuucaacgugaacgaggugaucgagauccugauggaggaccccagcggcugguggaagggcagacugcacggccaggagggccuguuccccggcaacuacguggagaagaucuga

SEQ ID NO: 2833 - RNA, 3297 nt, Artificial Sequence
  derived and/or modified sequence opt5 from MYO1F__Homo_sapiens__AAH28071
augggcagcaaggagagauuccacuggcagucccauaacgugaaacaaucuggggucgacgauaugguucugcucccccagaucaccgaagacgccauugcugccaaucugcggaagcgcuuuauggaugacuacaucuucacauauauuggaagcgugcuuaucuccgugaacccuuuuaaacagaugccguacuucacggauagagagauugaccuguaucagggcgcggcucaauacgaaaaucccccucacaucuaugcccucaccgauaacauguaccggaauaugcugaucgacugcgagaaccagugugucauuaucucuggggaaagcggagccggcaagacaguggcugccaaauauauuaugggguacaucuccaagguuucuggaggcggcgagaaggugcagcaugucaaagauauuauccuucagagcaauccccugcucgaggcuuuugggaacgccaagaccgugcgcaauaacaauuccagcagauucggaaaauacuuugaaauucaauucucucggggcggggagccugacggaggcaagaucuccaacuuucugcuggaaaaaucccgcguugugaugcagaaugagaacgagagaaauuuccacaucuauuaccagcuccuggaaggggcgucucaggagcaacggcagaaccuuggacugaugacacccgauuauuacuauuaccucaaccaguccgacaccuaucaagucgauggcacagacgaccgcagcgauuuuggcgaaacccugucugccaugcaagugauugggaucccuccguccauucagcagcuugugcugcagcucgucgcuggaauccugcaucugggcaauauuagcuucugcgaggacgggaacuacgccagaguugaauccguggaucuccuggcuuuucccgccuaccuucugggaaucgacucuggccggcuccaggagaagcugacgagccgcaagauggauuccagauggggagggcggagcgagucuaucaaugugacccuuaacgucgaacaggcggccuauacacgcgacgcucuggccaaaggccucuacgcuagacuguucgauuuccugguggaggccauuaaucgggccaugcagaagccucaagaagaguauuccaucggcguucucgacauuuacggguuugaaaucuuccagaaaaacggauuugagcaguucuguauuaauuuugugaacgagaagcugcagcaaaucuucaucgaacuuacccugaaagcugagcaggaagaguauguccaggaaggcauuagauggacacccauccaguacuuuaauaacaaggugguuugcgaucucauugagaauaaacugagcccucccgggaucaugucugugcuugacgaugucugugcgaccaugcacgccacgggaggcggggcugaccaaacacugcuccagaagcugcaggccgccgugggcacccacgagcauuucaacagcugguccgcuggauuugucauucaccauuaugccggcaaggugucuuacgacguuagcggguucugcgaacgcaaucgggaugugcuguuuuccgaccucaucgagcugaugcaaacaagcgaacaggcguuccuuagaaugcuguuuccggagaaacucgauggagacaagaaaggccgcccuucuaccgcuggguccaagauuaaaaagcaggccaacgaucuggucgccacccugaugcgguguacaccccacuacaucagaugcaucaagccuaaugagacgaaacgcccccgggacugggaagagaacagagugaagcaccagguugaauaucuuggacucaaagagaacauucgcgugcggagagcuggcuucgccuaccgccggcaauucgcuaaguuucugcagagauaugccauccugacccccgaaacauggccucgguggcgcggggaugagagacagggcguccagcaucuccugcgggcggugaauauggagccggaccaauaccagaugggaagcaccaaaguguucguuaagaaccccgaaucucuuuuucugcucgaggaagucagagagcgcaaguucgauggcuuugcccggacaauucagaaggcuuggagacgccacguggccgugagaaaauaugaagagaugcgggaggaagcuagcaauauccugcugaacaaaaaggagcgcagacggaauagcauuaaccgcaauuucgucggggacuaccuuggacucgaagagagaccugaacugcggcaguuucugggcaaacgcgagagaguggauuucgccgacuccguuaccaaguaugaucggcgcuuuaagcccaucaaaagagaccucauccugacgccuaaguguguguacgucauugggcgggagaaagugaagaaaggacccgaaaagggccaaguuugcgaggugcuuaaaaagaaggucgacauccaggcgcugagaggggugucucucagcacacgccaggaugacuucuuuauucugcaagaagaugccgcugacuccuuccuggagucuguuuuuaaaaccgaguucgugagccuucucuguaagcgguucgaagaggccaccagacgcccgcugccucugacauuuuccgauacccuccaguuccgggucaaaaaggaaggcuggggaggcgggggaacaagaagcgugacguuuucucgcggcuucggggaccuggcugugcuuaaagucggaggccggacccugacaguuuccgugggggauggccuccccaagagcucuaagccuaccagaaaaggaauggccaagggcaaaccccgccgguccagccaggccccuacaagagcugcgcccgccccgccucgggggauggaccgcaacggagugccucccucugcuagaggcgggccccugccgcuggagaucaugagcggaggcggcacccaucggcccccucgcgggcccccuuccacgagccuuggagccucuagacggcccagagcccgcccucccuccgaacacaauaccgaguuucucaacgucccggaucagggcauggcugggaugcaacggaagagaagcgugggacagcgcccuguucccggcguggggcggccuaaaccccagccgagaacacauggaccucgcugccgggcccuguaccaguaugucggccaagacguggaugagcuguccuucaauguuaacgaagugauugagauccucauggaagaccccucuggcugguggaaggggagacugcacggacaggagggccuuuuuccugggaauuacgucgaaaagaucuga

SEQ ID NO: 2834 - protein, 1018 aa, Artificial Sequence
  MYO1G__Homo_sapiens__B0I1T2
MEDEEGPEYGKPDFVLLDQVTMEDFMRNLQLRFEKGRIYTYIGEVLVSVNPYQELPLYGPEAIARYQGRELYERPPHLYAVANAAYKAMKHRSRDTCIVISGESGAGKTEASKHIMQYIAAVTNPSQRAEVERVKDVLLKSTCVLEAFGNARTNRNHNSSRFGKYMDINFDFKGDPIGGHIHSYLLEKSRVLKQHVGERNFHAFYQLLRGSEDKQLHELHLERNPAVYNFTHQGAGLNMTVHSALDSDEQSHQAVTEAMRVIGFSPEEVESVHRILAAILHLGNIEFVETEEGGLQKEGLAVAEEALVDHVAELTATPRDLVLRSLLARTVASGGRELIEKGHTAAEASYARDACAKAVYQRLFEWVVNRINSVMEPRGRDPRRDGKDTVIGVLDIYGFEVFPVNSFEQFCINYCNEKLQQLFIQLILKQEQEEYEREGITWQSVEYFNNATIVDLVERPHRGILAVLDEACSSAGTITDRIFLQTLDMHHRHHLHYTSRQLCPTDKTMEFGRDFRIKHYAGDVTYSVEGFIDKNRDFLFQDFKRLLYNSTDPTLRAMWPDGQQDITEVTKRPLTAGTLFKNSMVALVENLASKEPFYVRCIKPNEDKVAGKLDENHCRHQVAYLGLLENVRVRRAGFASRQPYSRFLLRYKMTCEYTWPNHLLGSDKAAVSALLEQHGLQGDVAFGHSKLFIRSPRTLVTLEQSRARLIPIIVLLLQKAWRGTLARWRCRRLRAIYTIMRWFRRHKVRAHLAELQRRFQAARQPPLYGRDLVWPLPPAVLQPFQDTCHALFCRWRARQLVKNIPPSDMPQIKAKVAAMGALQGLRQDWGCRRAWARDYLSSATDNPTASSLFAQRLKTLQDKDGFGAVLFSSHVRKVNRFHKIRNRALLLTDQHLYKLDPDRQYRVMRAVPLEAVTGLSVTSGGDQLVVLHARGQDDLVVCLHRSRPPLDNRVGELVGVLAAHCQGEGRTLEVRVSDCIPLSHRGVRRLISVEPRPEQPEPDFRCARGSFTLLWPSR

SEQ ID NO: 2835 - RNA, 3057 nt, Artificial Sequence
  MYO1G__Homo_sapiens__CCDS34629.1
auggaggacgaggaaggcccugaguauggcaaaccugacuuugugcuuuuggaccaagugaccauggaggacuucaugaggaaccugcagcucagguucgagaagggccgcaucuacaccuacaucggugaggugcugguguccgugaaccccuaccaggagcugccccuguaugggccugaggccaucgccagguaccagggccgugagcucuaugagcggccaccccaucucuaugcuguggccaacgccgccuacaaggcaaugaagcaccgguccagggacaccugcaucgucaucucaggggagaguggggcagggaagacagaagccaguaagcacaucaugcaguacaucgcugcugucaccaauccaagccagagggcugagguggagagggucaaggacgugcugcucaaguccaccugugugcuggaggccuuuggcaaugcccgcaccaaccgcaaucacaacuccagccgcuuuggcaaguacauggacaucaacuuugacuucaagggggacccgaucggaggacacauccacagcuaccuacuggagaagucucggguccucaagcagcacgugggugaaagaaacuuccacgccuucuaccaauugcugagaggcagugaggacaagcagcugcaugaacugcacuuggagagaaacccugcuguauacaauuucacacaccagggagcaggacucaacaugacugugcacagugccuuggacagugaugagcagagccaccaggcagugaccgaggccaugagggucaucggcuucaguccugaagagguggagucugugcaucgcauccuggcugccauauugcaccugggaaacaucgaguuuguggagacggaggagggugggcugcagaaggagggccuggcaguggccgaggaggcacugguggaccauguggcugagcugacggccacaccccgggaccucgugcuccgcucccugcuggcucgcacaguugccucgggaggcagggaacucauagagaagggccacacugcagcugaggccagcuaugcccgggaugccugugccaaggcaguguaccagcggcuguuugaguggguggugaacaggaucaacagugucauggaaccccggggccgggauccucggcgugauggcaaggacacagucauuggcgugcuggacaucuauggcuucgagguguuucccgucaacaguuucgagcaguucugcaucaacuacugcaacgagaagcugcagcagcuauucauccagcucauccugaagcaggaacaggaagaguacgagcgcgagggcaucaccuggcagagcguugaguauuucaacaacgccaccauuguggaucugguggagcggccccaccguggcauccuggccgugcuggacgaggccugcagcucugcuggcaccaucacugaccgaaucuuccugcagacccuggacaugcaccaccgccaucaccuacacuacaccagccgccagcucugccccacagacaagaccauggaguuuggccgagacuuccggaucaagcacuaugcaggggacgucacguacuccguggaaggcuucaucgacaagaacagagauuuccucuuccaggacuucaagcggcugcuguacaacagcacggaccccacucuacgggccauguggccggacgggcagcaggacaucacagaggugaccaagcgcccccugacggcuggcacacucuucaagaacuccaugguggcccugguggagaaccuugccuccaaggagcccuucuacguccgcugcaucaagcccaaugaggacaagguagcugggaagcuggaugagaaccacugucgccaccaggucgcauaccuggggcugcuggagaaugugaggguccgcagggcuggcuucgcuucccgccagcccuacucucgauuccugcucagguacaagaugaccugugaauacacauggcccaaccaccugcugggcuccgacaaggcagccgugagcgcucuccuggagcagcacgggcugcagggggacguggccuuuggccacagcaagcuguucauccgcucaccccggacacuggucacacuggagcagagccgagcccgccucauccccaucauugugcugcuauugcagaaggcauggcggggcaccuuggcgagguggcgcugccggaggcugagggcuaucuacaccaucaugcgcugguuccggagacacaaggugcgggcucaccuggcugagcugcagcggcgauuccaggcugcaaggcagccgccacucuacgggcgugaccuuguguggccgcugcccccugcugugcugcagcccuuccaggacaccugccacgcacucuucugcagguggcgggcccggcagcuggugaagaacauccccccuucagacaugccccagaucaaggccaagguggccgccaugggggcccugcaagggcuucgucaggacuggggcugccgacgggccugggcccgagacuaccuguccucugccacugacaaucccacagcaucaagccuguuugcucagcgacuaaagacacuucaggacaaagauggcuucggggcugugcucuuuucaagccauguccgcaaggugaaccgcuuccacaagauccggaaccgggcccuccugcucacagaccagcaccucuacaagcuggacccugaccggcaguaccgggugaugcgggccgugccccuugaggcggugacggggcugagcgugaccagcggaggagaccagcugguggugcugcacgcccgcggccaggacgaccucguggugugccugcaccgcucccggccgccauuggacaaccgcguuggggagcuggugggcgugcuggccgcacacugccagggggagggccgcacccuggagguucgcgucuccgacugcaucccacuaagccaucgcgggguccggcgccucaucuccguggagcccaggccggagcagccagagcccgauuuccgcugcgcucgcggcuccuucacccugcucuggcccagccgcuga

SEQ ID NO: 2836 - RNA, 3057 nt, Artificial Sequence
  derived and/or modified sequence opt1 from MYO1G__Homo_sapiens__CCDS34629.1
auggaggacgaggagggccccgaguacgggaagccggacuucgugcugcucgaccaggucaccauggaggacuucaugcgcaaccugcagcugcgguucgagaagggccgcaucuacaccuacaucggggaggugcucgugagcgucaaccccuaccaggagcugccccuguacggccccgaggccaucgcccgguaccaggggcgcgagcucuacgagcggccgccccaccuguacgcgguggccaacgccgccuacaaggccaugaagcaccgcucccgggacacgugcaucgugaucagcggcgaguccggcgcggggaagaccgaggccagcaagcacaucaugcaguacaucgccgccgucaccaaccccucccagcgcgcggagguggagcgggugaaggacguccugcucaagagcaccugcgugcuggaggccuucggcaacgcccgcacgaaccggaaccacaacuccagccgcuucgggaaguacauggacaucaacuucgacuucaagggcgaccccaucgggggccacauccacuccuaccugcucgagaagagccgggugcugaagcagcacgucggcgagcgcaacuuccacgccuucuaccagcugcuccggggguccgaggacaagcagcugcacgagcugcaccucgagcgcaacccggccguguacaacuucacccaccagggcgcggggcugaacaugaccgugcacagcgcccuggacuccgacgagcagagccaccaggccgucaccgaggccaugcgggugaucggcuucucccccgaggagguggagagcguccaccgcauccucgccgcgauccugcaccugggcaacaucgaguucguggagacggaggaggggggccuccagaaggaggggcuggccguggccgaggaggcccuggucgaccacguggccgagcucaccgcgaccccccgggaccuggugcugcgcucccuccuggcccggaccgucgccagcggcgggcgcgagcugaucgagaagggccacacggccgccgaggcguccuacgcccgcgacgccugcgccaaggcgguguaccagcggcucuucgagugggucgugaaccgcaucaacagcgugauggagccccggggccgcgacccgcggcgcgacgggaaggacaccgucaucggcgugcuggacaucuacggguucgagguguuccccgucaacagcuucgagcaguucugcaucaacuacugcaacgagaagcugcagcagcucuucauccagcugauccugaagcaggagcaggaggaguacgagcgggagggcaucaccuggcaguccguggaguacuucaacaacgccaccaucguggaccucgucgagcgcccccaccgggggauccuggccgugcuggacgaggccugcagcuccgccggcacgaucaccgaccgcaucuuccuccagacccuggacaugcaccaccggcaccaccugcacuacaccagccgccagcucugccccacggacaagaccauggaguucggccgggacuuccgcaucaagcacuacgcgggggacgugaccuacuccgucgagggcuucaucgacaagaaccgggacuuccuguuccaggacuucaagcgccugcucuacaacagcaccgacccgacgcugcgggccauguggcccgacgggcagcaggacaucaccgaggugaccaagcgcccccugaccgccggcacgcuguucaagaacuccaugguggcccucgucgagaaccuggccagcaaggagcccuucuacgugcggugcaucaagccgaacgaggacaagguggcggggaagcuggacgagaaccacugccgccaccaggucgccuaccucggccugcuggagaacgugcgcgugcggcgcgccggcuucgccucccggcagcccuacagccgcuuccuccugcgguacaagaugaccugcgaguacaccuggcccaaccaccugcucggguccgacaaggccgcggucagcgcccugcuggagcagcacggccuccagggggacguggccuucggccacuccaagcuguucauccgcagcccccggacccuggugacgcucgagcagucccgcgcccggcugaucccgaucaucguccugcuccugcagaaggcguggcgcggcacccuggcccgguggcgcugccggcgccuccgggccaucuacaccaucaugcgcugguuccggcgccacaaggugcgggcccaccuggccgagcugcagcgccgguuccaggcggcccgccagcccccccucuacgggcgcgaccugguguggccccugccgcccgccguccuccagcccuuccaggacaccugccacgcccuguucugccgguggcgcgcccggcagcuggugaagaacaucccgcccagcgacaugccccagaucaaggcgaagguggccgccaugggcgcccuccaggggcugcgccaggacuggggcugccggcgcgccugggcgcgggacuaccuguccagcgccacggacaaccccaccgccuccagccucuucgcccagcgccugaagacccugcaggacaaggacggguucggcgcgguccucuucagcucccacgugcggaaggugaaccgcuuccacaagauccggaaccgcgcccugcugcucaccgaccagcaccuguacaagcuggacccggaccggcaguaccgcgucaugcgggccgugccccucgaggccgugaccggccugagcgucacguccgggggcgaccagcugguggugcuccacgcccgcgggcaggacgaccuggucgugugccugcaccggagccgccccccccucgacaaccgggugggcgagcuggucggggugcuggcggcccacugccagggcgagggccgcacccucgaggugcgcgucuccgacugcaucccgcugagccaccggggggugcgccggcugaucuccguggagccccgccccgagcagcccgagccggacuuccggugcgcccgcggcagcuucacccuccuguggcccucccgguga

SEQ ID NO: 2837 - RNA, 3057 nt, Artificial Sequence
  derived and/or modified sequence opt2 from MYO1G__Homo_sapiens__CCDS34629.1
auggaggacgaggagggccccgaguacggcaagcccgacuucguccuccucgaccaggucaccauggaggacuucaugcgcaaccuccagcuccgcuucgagaagggccgcaucuacaccuacaucggcgagguccucgucuccgucaaccccuaccaggagcucccccucuacggccccgaggccaucgcccgcuaccagggccgcgagcucuacgagcgccccccccaccucuacgccgucgccaacgccgccuacaaggccaugaagcaccgcucccgcgacaccugcaucgucaucuccggcgaguccggcgccggcaagaccgaggccuccaagcacaucaugcaguacaucgccgccgucaccaaccccucccagcgcgccgaggucgagcgcgucaaggacguccuccucaaguccaccugcguccucgaggccuucggcaacgcccgcaccaaccgcaaccacaacuccucccgcuucggcaaguacauggacaucaacuucgacuucaagggcgaccccaucggcggccacauccacuccuaccuccucgagaagucccgcguccucaagcagcacgucggcgagcgcaacuuccacgccuucuaccagcuccuccgcggcuccgaggacaagcagcuccacgagcuccaccucgagcgcaaccccgccgucuacaacuucacccaccagggcgccggccucaacaugaccguccacuccgcccucgacuccgacgagcagucccaccaggccgucaccgaggccaugcgcgucaucggcuucucccccgaggaggucgaguccguccaccgcauccucgccgccauccuccaccucggcaacaucgaguucgucgagaccgaggagggcggccuccagaaggagggccucgccgucgccgaggaggcccucgucgaccacgucgccgagcucaccgccaccccccgcgaccucguccuccgcucccuccucgcccgcaccgucgccuccggcggccgcgagcucaucgagaagggccacaccgccgccgaggccuccuacgcccgcgacgccugcgccaaggccgucuaccagcgccucuucgagugggucgucaaccgcaucaacuccgucauggagccccgcggccgcgacccccgccgcgacggcaaggacaccgucaucggcguccucgacaucuacggcuucgaggucuuccccgucaacuccuucgagcaguucugcaucaacuacugcaacgagaagcuccagcagcucuucauccagcucauccucaagcaggagcaggaggaguacgagcgcgagggcaucaccuggcaguccgucgaguacuucaacaacgccaccaucgucgaccucgucgagcgcccccaccgcggcauccucgccguccucgacgaggccugcuccuccgccggcaccaucaccgaccgcaucuuccuccagacccucgacaugcaccaccgccaccaccuccacuacaccucccgccagcucugccccaccgacaagaccauggaguucggccgcgacuuccgcaucaagcacuacgccggcgacgucaccuacuccgucgagggcuucaucgacaagaaccgcgacuuccucuuccaggacuucaagcgccuccucuacaacuccaccgaccccacccuccgcgccauguggcccgacggccagcaggacaucaccgaggucaccaagcgcccccucaccgccggcacccucuucaagaacuccauggucgcccucgucgagaaccucgccuccaaggagcccuucuacguccgcugcaucaagcccaacgaggacaaggucgccggcaagcucgacgagaaccacugccgccaccaggucgccuaccucggccuccucgagaacguccgcguccgccgcgccggcuucgccucccgccagcccuacucccgcuuccuccuccgcuacaagaugaccugcgaguacaccuggcccaaccaccuccucggcuccgacaaggccgccgucuccgcccuccucgagcagcacggccuccagggcgacgucgccuucggccacuccaagcucuucauccgcuccccccgcacccucgucacccucgagcagucccgcgcccgccucauccccaucaucguccuccuccuccagaaggccuggcgcggcacccucgcccgcuggcgcugccgccgccuccgcgccaucuacaccaucaugcgcugguuccgccgccacaagguccgcgcccaccucgccgagcuccagcgccgcuuccaggccgcccgccagcccccccucuacggccgcgaccucgucuggccccucccccccgccguccuccagcccuuccaggacaccugccacgcccucuucugccgcuggcgcgcccgccagcucgucaagaacaucccccccuccgacaugccccagaucaaggccaaggucgccgccaugggcgcccuccagggccuccgccaggacuggggcugccgccgcgccugggcccgcgacuaccucuccuccgccaccgacaaccccaccgccuccucccucuucgcccagcgccucaagacccuccaggacaaggacggcuucggcgccguccucuucuccucccacguccgcaaggucaaccgcuuccacaagauccgcaaccgcgcccuccuccucaccgaccagcaccucuacaagcucgaccccgaccgccaguaccgcgucaugcgcgccgucccccucgaggccgucaccggccucuccgucaccuccggcggcgaccagcucgucguccuccacgcccgcggccaggacgaccucgucgucugccuccaccgcucccgccccccccucgacaaccgcgucggcgagcucgucggcguccucgccgcccacugccagggcgagggccgcacccucgagguccgcgucuccgacugcaucccccucucccaccgcggcguccgccgccucaucuccgucgagccccgccccgagcagcccgagcccgacuuccgcugcgcccgcggcuccuucacccuccucuggcccucccgcuga

SEQ ID NO: 2838 - RNA, 3057 nt, Artificial Sequence
  derived and/or modified sequence opt3 from MYO1G__Homo_sapiens__CCDS34629.1
auggaggacgaagagggccccgaauacgggaagccugauuucgugcugcucgaccaggucaccauggaggauuuuaugagaaaccuucaacugagguucgaaaaaggacggaucuauacauacauuggugagguuuuggugagcguaaauccauaucaggaguuaccgcuguacggccccgaagccauagcucgcuaucaggggcgagagcuauacgaacguccuccacaccucuaugcaguggccaacgcggcuuacaaggccaugaaacauagauccagggacacuugcaucgucauuucuggagagucaggcgcagguaagacggaggccaguaaacacaucaugcaguacauugcugcagugaccaaucccagccaacgggccgaaguugagcgcgugaaggauguccugcuuaaguccacaugugugcuggaagccuuugggaacgcuagaacuaauaggaaccauaauucuucgcgguucggaaaauauauggacaucaacuuugauuucaagggcgacccuauaggcgggcacauccauucauacuugcucgagaaaagccgcguacugaagcagcacguuggagaacgaaauuuucacgcguucuaucagcugcucagagguagugaggauaaacaguuacaugagcugcaccuugaaaggaacccagcaguguacaauuuuacccaucaaggcgccggguugaacaugacaguccacuccgcucuggacucugaugagcagagccaccaggccgugaccgaagcaaugcgggugauuggauucucccccgaggaagucgagucaguucaucguauccuagcugccauucuccaccugggcaauaucgaguuuguggaaacugaggaaggugggcuucagaaggagggacuggcgguagccgaagaggcauugguggaccaugucgcugagcucacagccaccccucgcgaucugguguuaagaagucugcucgcuaggacgguugccagcggcggccgggaacuuauagagaaggggcacacugcagccgaggcuucuuaugcgcgagacgcaugcgccaaagcuguguaccaacgccuguucgaaugggucgugaacagaauuaauuccguaauggagccaaggggacgggacccgcgcagagaugguaaggacaccguuaucggcguguuggauauuuauggguuugaagucuuccccgugaacucauucgagcaguuuuguaucaacuacugcaaugaaaaacuacagcaacuguucauccagcucauucugaagcaggagcaggaagaguacgagagggaaggaauaacauggcaaagcgucgaguauuuuaacaaugccacuaucguggaccuuguugaacguccucaucggggcauucuggcaguguuggaugaggccuguaguucugcugguaccaucacagaccgaauauuccuccagacccuggauaugcaccacagacaucacuuacauuacacguccaggcagcugugcccaacugacaaaacaauggaauuugggcgcgauuuccggauuaagcacuaugccggcgacguaaccuacagcgucgagggauuuaucgauaaaaacagagacuuccuauuucaggacuucaagaggcuccuguauaauucgacugaucccacacuucgcgcaauguggccugacggccaacaggauaucaccgaggugacgaagcgaccauugaccgcggggacacuguuuaaaaacucuaugguugcucucguggaaaaucuggccuccaaggagcccuucuacguccgguguauuaaaccgaacgaagacaagguggcaggaaaacuugaugagaaucacugccgucaucagguagccuaucuggguuugcucgaaaacgugagaguuaggcgcgcuggcuuugccucacggcagccuuacaguagauuccuguuaagguacaagaugacuugugaguauaccuggcccaaucaccuccuagggagcgacaaggcagcugucuccgcccuccuggagcaacauggacuucagggcgauguggcguucggucacucuaaauuguuuauccgaagcccacgcacacuggugacucucgaacagucacgggccagacugauuccuauaaucgucuuacugcuucagaaggcuuggagggggaccuuggcacguuggcgcugccggagacucagggccauuuacacaaucaugcgaugguuccggcgccauaaaguuagagcucaccuggccgagcuacaaaggcgguuucaggcagcgcgacagcccccacuguauggcagagaccucguguggccccugccuccagccgugcuucaaccguuccaggauaccugucacgcuuuguuuugccgcuggagggcccgucagcugguaaagaacauucccccuagugacaugccacagaucaaagcaaaggucgcugccaugggagcauuacaaggccuccggcaggauugggggugcagaagggccugggcucgcgacuaccuguccagcgcgacugauaaucccacggccucuucacuuuucgcacagcgacugaagacauugcaggacaaagacggauuuggugcugugcuguucaguagccauguuagaaaggugaaccgguuucacaaaauaaggaaucgcgcccugcuacugaccgaucaacaucucuauaagcuggacccugaucgucaguacagagucaugcgggccgugccacuugaagcuguuacuggcuuguccgugaccucugggggagaccagcugguagucuuacacgcaaggggccaggaugaccucguggugugucugcaucgcucgcgacccccgcuugauaacagagucggugagcugguuggggugcuagccgcgcacugccaaggcgagggacggacacucgaaguaagggugagcgacuguaucccucugucccaccgcggcgucagaagguugauuucaguggagccacggcccgaacagccugagcccgauuuccguugcgcucgcgggaguuuuacccuguuauggccaucucgauga

SEQ ID NO: 2839 - RNA, 3057 nt, Artificial Sequence
  derived and/or modified sequence opt4 from MYO1G__Homo_sapiens__CCDS34629.1
auggaggacgaggagggccccgaguacggcaagcccgacuucgugcugcuggaccaggugaccauggaggacuucaugagaaaccugcagcugagauucgagaagggcagaaucuacaccuacaucggcgaggugcuggugagcgugaaccccuaccaggagcugccccuguacggccccgaggccaucgccagauaccagggcagagagcuguacgagagacccccccaccuguacgccguggccaacgccgccuacaaggccaugaagcacagaagcagagacaccugcaucgugaucagcggcgagagcggcgccggcaagaccgaggccagcaagcacaucaugcaguacaucgccgccgugaccaaccccagccagagagccgagguggagagagugaaggacgugcugcugaagagcaccugcgugcuggaggccuucggcaacgccagaaccaacagaaaccacaacagcagcagauucggcaaguacauggacaucaacuucgacuucaagggcgaccccaucggcggccacauccacagcuaccugcuggagaagagcagagugcugaagcagcacgugggcgagagaaacuuccacgccuucuaccagcugcugagaggcagcgaggacaagcagcugcacgagcugcaccuggagagaaaccccgccguguacaacuucacccaccagggcgccggccugaacaugaccgugcacagcgcccuggacagcgacgagcagagccaccaggccgugaccgaggccaugagagugaucggcuucagccccgaggagguggagagcgugcacagaauccuggccgccauccugcaccugggcaacaucgaguucguggagaccgaggagggcggccugcagaaggagggccuggccguggccgaggaggcccugguggaccacguggccgagcugaccgccacccccagagaccuggugcugagaagccugcuggccagaaccguggccagcggcggcagagagcugaucgagaagggccacaccgccgccgaggccagcuacgccagagacgccugcgccaaggccguguaccagagacuguucgaguggguggugaacagaaucaacagcgugauggagcccagaggcagagaccccagaagagacggcaaggacaccgugaucggcgugcuggacaucuacggcuucgagguguuccccgugaacagcuucgagcaguucugcaucaacuacugcaacgagaagcugcagcagcuguucauccagcugauccugaagcaggagcaggaggaguacgagagagagggcaucaccuggcagagcguggaguacuucaacaacgccaccaucguggaccugguggagagaccccacagaggcauccuggccgugcuggacgaggccugcagcagcgccggcaccaucaccgacagaaucuuccugcagacccuggacaugcaccacagacaccaccugcacuacaccagcagacagcugugccccaccgacaagaccauggaguucggcagagacuucagaaucaagcacuacgccggcgacgugaccuacagcguggagggcuucaucgacaagaacagagacuuccuguuccaggacuucaagagacugcuguacaacagcaccgaccccacccugagagccauguggcccgacggccagcaggacaucaccgaggugaccaagagaccccugaccgccggcacccuguucaagaacagcaugguggcccugguggagaaccuggccagcaaggagcccuucuacgugagaugcaucaagcccaacgaggacaagguggccggcaagcuggacgagaaccacugcagacaccagguggccuaccugggccugcuggagaacgugagagugagaagagccggcuucgccagcagacagcccuacagcagauuccugcugagauacaagaugaccugcgaguacaccuggcccaaccaccugcugggcagcgacaaggccgccgugagcgcccugcuggagcagcacggccugcagggcgacguggccuucggccacagcaagcuguucaucagaagccccagaacccuggugacccuggagcagagcagagccagacugauccccaucaucgugcugcugcugcagaaggccuggagaggcacccuggccagauggagaugcagaagacugagagccaucuacaccaucaugagaugguucagaagacacaaggugagagcccaccuggccgagcugcagagaagauuccaggccgccagacagcccccccuguacggcagagaccugguguggccccugccccccgccgugcugcagcccuuccaggacaccugccacgcccuguucugcagauggagagccagacagcuggugaagaacaucccccccagcgacaugccccagaucaaggccaagguggccgccaugggcgcccugcagggccugagacaggacuggggcugcagaagagccugggccagagacuaccugagcagcgccaccgacaaccccaccgccagcagccuguucgcccagagacugaagacccugcaggacaaggacggcuucggcgccgugcuguucagcagccacgugagaaaggugaacagauuccacaagaucagaaacagagcccugcugcugaccgaccagcaccuguacaagcuggaccccgacagacaguacagagugaugagagccgugccccuggaggccgugaccggccugagcgugaccagcggcggcgaccagcugguggugcugcacgccagaggccaggacgaccugguggugugccugcacagaagcagacccccccuggacaacagagugggcgagcuggugggcgugcuggccgcccacugccagggcgagggcagaacccuggaggugagagugagcgacugcaucccccugagccacagaggcgugagaagacugaucagcguggagcccagacccgagcagcccgagcccgacuucagaugcgccagaggcagcuucacccugcuguggcccagcagauga

SEQ ID NO: 2840 - RNA, 3057 nt, Artificial Sequence
  derived and/or modified sequence opt5 from MYO1G__Homo_sapiens__CCDS34629.1
auggaggacgaagagggccccgaauacgggaagccugauuucgugcugcucgaccaggucaccauggaggauuuuaugagaaaccugcaacuucgguucgaaaaaggacgcaucuauacauacauuggcgagguucuggugagcgugaauccguaucaggagcucccccuguacgggccugaagccaucgcuagauaucagggacgggagcuuuacgaaagacccccucaccuguaugccgucgcgaacgcugccuacaaggccaugaaacaucgcucccgggacacgugcauugugaucucuggcgagagcggggcuggaaagaccgaggccuccaaacacauuaugcaguacaucgcugccguuacaaaucccucucaacgcgcggaaguggagagagucaaggaugugcuccucaagagcaccuguguucuggaagccuuuggcaacgcucggacaaaucgcaaccauaauuccucuagauucggcaaauauauggacaucaacuuugauuucaagggggacccuauuggaggccacauccauagcuaccugcuggagaaaucccgggugcuuaagcagcacgucggggaacgcaauuuucacgccuucuaucagcugcucagaggaagcgaggauaaacagcugcaugagcuucaccuggaacggaacccggcuguguacaauuuuacccaucaaggcgccgggcucaacaugacagugcacucugcgcuggacuccgaugagcagagccaccaggccgucaccgaagcuaugcgcguuauuggauucucucccgaggaaguggaguccgugcauagaauccuggccgcuauucuccaccugggcaauaucgaguuugucgaaacggaggaaggcgggcuucagaaggagggacuggccguggccgaagaggcucucguugaccauguggcggagcugaccgccacaccucgggaucuuguccugagaagccuccuggcucgcaccguggccucuggcgggcgggaacugauugagaagggacacacagccgcugaagccuccuaugcgagagacgcuugcgccaaagccguuuaccaacgccucuucgaguggguggucaaccggaucaauagcgugauggagcccagaggccgcgacccucggagagaugggaaggacaccgucaucggagugcuggauauuuauggcuuugaaguuuuccccgugaacuccuucgagcaguuuuguaucaacuacugcaaugaaaaacuucagcaacuguucauucagcucauccugaagcaggagcaggaagaguacgagcgcgaaggcauuacguggcaaucugucgaguauuuuaacaaugcuacaaucguggaccuuguugaacggccgcauagagggauccuggccgugcucgaugaggcuuguagcuccgccggaaccauuacagaccgcaucuuccugcagacccuggauaugcaccaccggcaucaccuccauuacaccagcagacagcugugcccuacagacaaaacgauggaauuuggccgggauuuccgcauuaagcacuaugcgggggacgucaccuacucuguggagggauuuaucgauaaaaacagagacuuccuuuuucaggacuucaagcggcugcucuauaauuccacagaucccacccugagagccauguggccugacggccaacaggauauuacagaggugaccaagcgcccccugacggcugggacacuuuuuaaaaacagcaugguugcccucgucgaaaaucuggcuucuaaggagcccuucuacgugcgguguaucaaaccuaacgaagacaagguggccggcaaacuggaugagaaucacugcagacaucaggucgcguaucucggacugcuugaaaacgugcgcguuagacgggccggcuuugcuagccgccagccguacuccagauuccugcuccgguacaagaugaccugugaguauaccuggcccaaucaucugcuggggucugacaaggccgcugugagcgcccuucucgagcaacacggacugcagggcgaugucgccuucgggcacuccaaacuguuuauccgcagcccuagaacacucgugacccuggaacagucucgggcucgccuuauucccaucauuguucugcuccugcagaaggcguggagaggaacacuggcccgguggcgcugcagacggcuuagagcuaucuacacgauuaugcgcugguuccggagacauaaagugcgcgcccaccucgccgagcugcaacggagauuucaggcugcccgccagccuccccuguauggccgggaccucgucuggccgcugccucccgcggugcuucaaccuuuccaggauaccugucacgcucuguuuugcagauggcgcgcccggcagcucguuaagaacauucccccuuccgacaugccccagaucaaagccaagguggcugccaugggggcgcugcaaggccugagacaggauuggggaugccggcgcgcuugggccagagacuaccuuagcucugccacagauaauccgaccgcuuccagccucuucgcccagcggcugaagacacugcaggacaaagacggcuuuggggcuguccucuucuccucucaugugcgcaaggugaacagauuucacaaaauccggaauagagcccugcuucugaccgaucaacaucucuauaagcuggacccugaucgccaguaccgggucaugagagcgguuccccuggaagccgugacgggacuuagcgugaccuccggcggggaccagcuggucgugcuccacgcucgcggacaggaugaccugguugugugucuccaucggucuagacccccucuggauaaccgcgucggcgagcuuguggggguucuggccgcucacugccaaggcgagggacggacacucgaagugagagucagcgacuguaucccgcugucccaccgcggcgugagacggcugauuagcguugagccccgcccugaacagcccgagccugauuucagaugcgcccgggggucuuuuacccuucuguggcccucccgcuga

SEQ ID NO: 2841 - protein, 1022 aa, Artificial Sequence
  MYO1H__Homo_sapiens__NP_001094891
MEGALTARDKVGVQDFVLLDAYTSESAFVDNLRKRFSENLIYTYIGTLLVSVNPYQELGIYTVSQMELYQGVNFFELPPHVYAIADNAYRMMCAELNNHFILISGESGAGKTEASKKILEYFAVTCPMTQSLQIARDRLLFSNPVLEAFGNARTLRNDNSSRFGKYMDIQFDFQGIPVGGHIISYLIEKSRVVYQNEGERNFHIFYQLLAGGEEERLSYLGLERDPQLYKYLSQGHCAKESSISDKNDWKTVSNAFSVIDFTEADLENLFGIIASVLHLGNIGFEEDDQGCATIPDTHEIKWIAKLLGVHPSVLLEALTHRKIEAKTEEVICPLTLELSVYARDAMAKAVYGRTFTWLVNKINSSLVNKDFTRKTVIGLLDIYGFEVFDKNGFEQFCINYCNEKLQQLLIERTLKAEQAEYEMEGIEWEPIKYFNNKIICDLVEERHKGIISILDEECIRPGPATDLSFLEKLEEKVGKHAHFETRKLAGPKGRKRIGWMEFRLLHYAGEVTYCTKGFLEKNNDLLYRHLKEVLCKSKNIILRECFLLAELENRRRPPTVGTQFKNSLSSLLETLISKEPSYIRCIKPNDRKEPSKFDDFLIRHQIKYLGLMEHLRVRRAGFAYRRKYEHFLQRYKSLCPDTWPHWHGPPAEGVERLIKYIGYKPEEYKLGKTKIFIRFPRTLFATEDAFEFSKHQLVARIQATYKRCLGRREYVKKRQAAIKLEAHWRGALARKAIQRRKWAVRIIRKFIKGFISRNKPLCPDNEEFIVFVRKNYILNLRYHLPKTVLDKSWLRPPGILENASDLLRKMCVRNLVQKYCRGITAERKAMMQQKVVTSEIFRGRKDGYTESLNQPFVNSRIDEGDINPKVLQLISHEKIQYGVPVIKYDRKGFKARQRQLILTQKAAYVVELAKIKQKIEYSALKGVSTSNLSDGILVIHVSPEDSKQKGDAVLQCGHVFEAVTKLVMLVKKENIVNVVQGSLQFFISPGKEGTIVFDTGLEEQVYKNKNGQLTVVSVRRKS

SEQ ID NO: 2842 - RNA, 3069 nt, Artificial Sequence
  MYO1H__Homo_sapiens__CCDS53826.1
auggaaggggcgcugacugcccgggacaaggucgggguucaggauuuugugcuauuggacgcguacaccagcgaaucugccuuugucgacaaccuccgcaagcguuucagcgagaaccucauauacacauauauuggcacccuccuugugucugugaauccauaccaggagcucggaaucuacacugugagccagauggaacuuuaucaaggggucaauuucuuugaacugccaccacaugucuacgcuauagccgacaacgcuuaccgaaugaugugugcugaacuaaauaaccauuucauccucauuucuggagagaguggggcagggaaaacagaggccuccaagaaaauucucgaguauuuugcagugaccugcccaaugacccagucacuacaaauagcccgugacagacugcuguucuccaacccagugcuggaggcuuuuggaaaugccagaacgcuccggaaugacaacuccagcagauuugggaaauacauggauauacaauuugauuuucagggcauucccguaggugggcauaucaucaguuacuugauagagaagucccgaguugucuaccaaaacgaaggcgagcggaauuuccacaucuucuaccagcugcuggcagguggcgaagaggagcgccugucuuaccugggacucgagcgagacccccagcuguauaaauaccucucacagggucauugugccaaagagucauccauuagugacaagaaugacuggaaaacuguuuccaacgccuuuucugucauugauuuuacugaagcugaccucgagaaucucuuuggaauuauugccagugucuuacaccuggggaacauugguuuugaagaagacgaccaaggcugugccacuaucccagacacccaugagaucaaguggauagccaagcuccuggggguccacccaucaguccuucuggaagcucucacccacagaaaaauugaagccaaaacugaggaggugaucugcccguugacacuagaacucucugucuacgcuagagaugcaauggcaaaggcuguuuauggacgaacguuuacuuggcuggucaacaaaaucaauuccuccuuaguuaacaaggauuucaccaggaaaacuguaauuggauuacuggacaucuauggguuugaagucuuugacaagaaugguuuugaacaguucuguauaaauuacugcaaugagaaacuccagcaacuguuaauugagaggacucuaaaagcagaacaggcagaauaugaaauggaaggcauagagugggagccaauuaaauauuucaacaacaagaucaucugugauuugguagaagagagacauaaaggaaucauaucuauucuggaugaagaaugcauucggccugguccugcuacagacuugaguuuccuggagaaauuggaagagaaagugggcaaacaugcacacuucgaaacccguaagcuggcugguccaaagggccgaaagaggauuggcuggauggaguuccgacuccuccacuaugcaggagaggucacauacugcaccaagggauucuuggaaaaaaacaaugaucuucuuuacagacaucugaaagaagugcugugcaaguccaagaacauuauccugagggaaugcuuccugcuggccgaguuagaaaaccggaggaggcccccaacaguggggacucaguuuaaaaacagucugagcagccuucuagaaacccucaucucuaaggagcccuccuacauccguugcaucaagcccaacgacaggaaagaacccagcaaauuugaugacuuccucauaaggcaucagaucaaauaccuggggcugauggagcaccugcgggugagacgggcugguuuugcauaccgaaggaaauacgagcauuucuugcaaagguacaaguccuuaugcccagacaccuggccgcacuggcacgggccuccagcagagggcguggaacggcugaucaaguacaucggcuacaaacccgaggaauacaaguuaggcaaaaccaaaauauucauucguuuccccagaacucuguuugcuaccgaagaugccuuugaauuuaguaaacaucaacuaguugcaagaauccaagccacuuacaaacgcugccuaggaaggagagaauacgugaaaaaaagacaagcagccaucaaacuggaagcccacuggcguggggcccuggcucggaaggcaauccaaaggagaaagugggccgugcggauuaucagaaaguucauuaaaggauucaucagucgcaacaaaccccucuguccugacaacgaggaauuuaucguguuugugcggaagaauuacaucuugaaucuccgguaucaccuuccaaagacuguccuggacaagagcuggcugaggccuccuggcaucuuggaaaaugcaucagaucugcucaggaaaaugugcgugaggaaccuggugcagaaguacugccgcgggaucacagcugagcggaaagcaaugaugcagcaaaagguaguuacaagugaaaucuucaggggaaggaaagacggcuacacagaaaguuuaaaucaacccuuugucaacagucggauagaugaaggagacauuaauccgaaagugcuucagcuaauuagccaugagaaaauccaguauggugucccggucauuaaauaugacagaaaaggcuucaaagcacggcagcggcaacucauucuuacucagaaagcagcuuacgugguggaacuugccaaaaucaagcagaaaauagaguacucagcucucaaaggugucuccacuagcaaucugagugauggaaucuuagucauucauguuucaccagaggacagcaagcaaaagggggaugccguuuugcaguguggacacguguuugaagcaguuacuaaacucgucaugcugguuaagaaggagaacauugucaauguuguucaaggaaguuuacaguuuuuuauuaguccgggaaaagaaggcacaauaguuuucgacacuggacuggaagaacaagucuauaaaaauaaaaauggacaauuaacaguggugucaguccggaggaaguccuga

SEQ ID NO: 2843 - RNA, 3069 nt, Artificial Sequence
  derived and/or modified sequence opt1 from MYO1H__Homo_sapiens__CCDS53826.1
auggagggcgcccugaccgcccgcgacaagguggggguccaggacuucgugcuccuggacgcguacaccagcgaguccgccuucguggacaaccugcggaagcgcuucagcgagaaccucaucuacacguacaucggcacccugcuggucuccgugaaccccuaccaggagcucgggaucuacaccgugagccagauggagcuguaccagggcgucaacuucuucgagcugccgccccacguguacgccaucgccgacaacgccuaccggaugaugugcgcggagcucaacaaccacuucauccugaucuccggggagagcggcgccggcaagaccgaggccuccaagaagauccuggaguacuucgccgugacgugccccaugacccagagccuccagaucgcgcgcgaccggcugcuguucuccaaccccguccucgaggccuucgggaacgcccgcacccugcggaacgacaacagcucccgcuucggcaaguacauggacauccaguucgacuuccaggggaucccggugggcgggcacaucaucagcuaccugaucgagaagucccggguggucuaccagaacgagggcgagcgcaacuuccacaucuucuaccagcuccuggccggcggggaggaggagcggcugagcuaccucggccuggagcgcgacccccagcuguacaaguaccucucccaggggcacugcgccaaggagagcuccaucagcgacaagaacgacuggaagaccguguccaacgcguucagcgugaucgacuucacggaggccgaccuggagaaccuguucggcaucaucgccagcguccuccaccugggcaacaucggguucgaggaggacgaccagggcugcgccaccauccccgacacccacgagaucaaguggaucgccaagcugcucggggugcaccccuccgugcugcuggaggcgcucacccaccggaagaucgaggccaagacggaggaggucaucugcccgcugacccuggagcucagcguguacgcccgcgacgccauggccaaggcgguguacggccggaccuucaccuggcuggucaacaagaucaacuccagccuggugaacaaggacuucacgcgcaagaccgugaucgggcuccuggacaucuacggcuucgaggucuucgacaagaacggcuucgagcaguucugcaucaacuacugcaacgagaagcugcagcagcuccugaucgagcggacccugaaggccgagcaggccgaguacgagauggaggggaucgagugggagcccaucaaguacuucaacaacaagaucaucugcgaccucguggaggagcgccacaagggcaucaucuccauccuggacgaggagugcauccggcccgggcccgccaccgaccugagcuuccucgagaagcuggaggagaaggucggcaagcacgcccacuucgagacgcgcaagcuggcggggccgaagggccggaagcgcaucggcuggauggaguuccgccugcuccacuacgccggggaggugaccuacugcaccaagggcuuccuggagaagaacaacgaccugcucuaccggcaccugaaggaggugcugugcaaguccaagaacaucauccuccgcgagugcuuccugcuggccgagcucgagaaccggcgccggccgcccaccgucgggacgcaguucaagaacagccuguccagccugcucgagacccugaucuccaaggagcccagcuacauccgcugcaucaagcccaacgaccggaaggagcccuccaaguucgacgacuuccugauccgccaccagaucaaguaccucggccugauggagcaccuccgggugcgccgggccggguucgcguaccgccggaaguacgagcacuuccugcagcgcuacaagagccugugccccgacaccuggccccacuggcacggcccgcccgccgagggcguggagcggcugaucaaguacaucggguacaagcccgaggaguacaagcucggcaagaccaagaucuucauccgcuucccccggacgcuguucgccaccgaggacgccuucgaguucuccaagcaccagcuggucgcccgcauccaggcgaccuacaagcggugccucgggcgccgcgaguacgugaagaagcggcaggccgccaucaagcuggaggcccacuggcgcggcgcccuggcgcggaaggccauccagcgccggaagugggccgugcgcaucauccggaaguucaucaagggcuucaucagccgcaacaagccgcucugccccgacaacgaggaguucaucgucuucgugcggaagaacuacauccugaaccugcgcuaccaccuccccaagaccgugcuggacaaguccuggcugcggcccccggggauccucgagaacgccagcgaccugcugcgcaagaugugcguccggaaccucgugcagaaguacugccgcggcaucacggccgagcggaaggcgaugaugcagcagaagguggucaccuccgagaucuuccgcgggcggaaggacggcuacaccgagagccugaaccagcccuucgugaacagccgcaucgacgagggggacaucaaccccaaggugcugcagcucaucucccacgagaagauccaguacggcgucccggugaucaaguacgaccggaagggcuucaaggcccgccagcggcagcugauccugacccagaaggccgccuacguggucgagcucgcgaagaucaagcagaagaucgaguacagcgcccugaaggggguguccacgagcaaccuguccgacggcauccucgugauccacgucagccccgaggacuccaagcagaagggggacgccgugcugcagugcggccacguguucgaggccgucaccaagcuggugaugcucgugaagaaggagaacaucgucaacguggugcaggggagccugcaguucuucaucucccccggcaaggagggcaccaucgucuucgacaccgggcuggaggagcaggucuacaagaacaagaacggccagcucaccguggugagcgugcgccgcaaguccuga

SEQ ID NO: 2844 - RNA, 3069 nt, Artificial Sequence
  derived and/or modified sequence opt2 from MYO1H__Homo_sapiens__CCDS53826.1
auggagggcgcccucaccgcccgcgacaaggucggcguccaggacuucguccuccucgacgccuacaccuccgaguccgccuucgucgacaaccuccgcaagcgcuucuccgagaaccucaucuacaccuacaucggcacccuccucgucuccgucaaccccuaccaggagcucggcaucuacaccgucucccagauggagcucuaccagggcgucaacuucuucgagcuccccccccacgucuacgccaucgccgacaacgccuaccgcaugaugugcgccgagcucaacaaccacuucauccucaucuccggcgaguccggcgccggcaagaccgaggccuccaagaagauccucgaguacuucgccgucaccugccccaugacccagucccuccagaucgcccgcgaccgccuccucuucuccaaccccguccucgaggccuucggcaacgcccgcacccuccgcaacgacaacuccucccgcuucggcaaguacauggacauccaguucgacuuccagggcauccccgucggcggccacaucaucuccuaccucaucgagaagucccgcgucgucuaccagaacgagggcgagcgcaacuuccacaucuucuaccagcuccucgccggcggcgaggaggagcgccucuccuaccucggccucgagcgcgacccccagcucuacaaguaccucucccagggccacugcgccaaggaguccuccaucuccgacaagaacgacuggaagaccgucuccaacgccuucuccgucaucgacuucaccgaggccgaccucgagaaccucuucggcaucaucgccuccguccuccaccucggcaacaucggcuucgaggaggacgaccagggcugcgccaccauccccgacacccacgagaucaaguggaucgccaagcuccucggcguccaccccuccguccuccucgaggcccucacccaccgcaagaucgaggccaagaccgaggaggucaucugcccccucacccucgagcucuccgucuacgcccgcgacgccauggccaaggccgucuacggccgcaccuucaccuggcucgucaacaagaucaacuccucccucgucaacaaggacuucacccgcaagaccgucaucggccuccucgacaucuacggcuucgaggucuucgacaagaacggcuucgagcaguucugcaucaacuacugcaacgagaagcuccagcagcuccucaucgagcgcacccucaaggccgagcaggccgaguacgagauggagggcaucgagugggagcccaucaaguacuucaacaacaagaucaucugcgaccucgucgaggagcgccacaagggcaucaucuccauccucgacgaggagugcauccgccccggccccgccaccgaccucuccuuccucgagaagcucgaggagaaggucggcaagcacgcccacuucgagacccgcaagcucgccggccccaagggccgcaagcgcaucggcuggauggaguuccgccuccuccacuacgccggcgaggucaccuacugcaccaagggcuuccucgagaagaacaacgaccuccucuaccgccaccucaaggagguccucugcaaguccaagaacaucauccuccgcgagugcuuccuccucgccgagcucgagaaccgccgccgcccccccaccgucggcacccaguucaagaacucccucuccucccuccucgagacccucaucuccaaggagcccuccuacauccgcugcaucaagcccaacgaccgcaaggagcccuccaaguucgacgacuuccucauccgccaccagaucaaguaccucggccucauggagcaccuccgcguccgccgcgccggcuucgccuaccgccgcaaguacgagcacuuccuccagcgcuacaagucccucugccccgacaccuggccccacuggcacggcccccccgccgagggcgucgagcgccucaucaaguacaucggcuacaagcccgaggaguacaagcucggcaagaccaagaucuucauccgcuucccccgcacccucuucgccaccgaggacgccuucgaguucuccaagcaccagcucgucgcccgcauccaggccaccuacaagcgcugccucggccgccgcgaguacgucaagaagcgccaggccgccaucaagcucgaggcccacuggcgcggcgcccucgcccgcaaggccauccagcgccgcaagugggccguccgcaucauccgcaaguucaucaagggcuucaucucccgcaacaagccccucugccccgacaacgaggaguucaucgucuucguccgcaagaacuacauccucaaccuccgcuaccaccuccccaagaccguccucgacaaguccuggcuccgcccccccggcauccucgagaacgccuccgaccuccuccgcaagaugugcguccgcaaccucguccagaaguacugccgcggcaucaccgccgagcgcaaggccaugaugcagcagaaggucgucaccuccgagaucuuccgcggccgcaaggacggcuacaccgagucccucaaccagcccuucgucaacucccgcaucgacgagggcgacaucaaccccaagguccuccagcucaucucccacgagaagauccaguacggcguccccgucaucaaguacgaccgcaagggcuucaaggcccgccagcgccagcucauccucacccagaaggccgccuacgucgucgagcucgccaagaucaagcagaagaucgaguacuccgcccucaagggcgucuccaccuccaaccucuccgacggcauccucgucauccacgucucccccgaggacuccaagcagaagggcgacgccguccuccagugcggccacgucuucgaggccgucaccaagcucgucaugcucgucaagaaggagaacaucgucaacgucguccagggcucccuccaguucuucaucucccccggcaaggagggcaccaucgucuucgacaccggccucgaggagcaggucuacaagaacaagaacggccagcucaccgucgucuccguccgccgcaaguccuga

SEQ ID NO: 2845 - RNA, 3069 nt, Artificial Sequence
  derived and/or modified sequence opt3 from MYO1H__Homo_sapiens__CCDS53826.1
auggagggcgcccugaccgcuagagacaagguggggguccaggauuucguucuccuugacgcauacacaagcgaauccgccuuuguggauaaccugaggaaacgguucucugagaauuugaucuauacuuacauuggaacguuacugguaucagugaaccccuaucaagaacuagguauauacaccgucagucagauggagcucuaucagggcgugaacuuuuucgaacugccuccacacguuuacgcgaucgcugacaaugccuaucgcaugaugugcgcagagcuuaauaaccauuuuauucugaucagcggggaguccggagccggcaagacagaggcuucuaaaaagauuuuggaguacuucgcagugacuuguccgaugacccagucgcuccaaaucgcccgagaucgucugcuguuuucaaaucccguccucgaggcuuucgguaacgccagaacauuaaggaaugacaacagcagucgguuugggaaauacauggauauacaguucgacuuucagggaaucccugugggcggccacauuaucuccuaucugauugagaagucucgcguaguuuaccagaaugagggggaaagaaacuuccauaucuuuuaucaacuuuuggcgggaggugaggaagagaggcugagcuaccuaggccucgaacgggauccacagcuguauaaguaccuuucccaggggcacugcgcaaaagagucaaguauaagcgacaagaaugauuggaaaaccgugucuaacgccuucuccgucauugacuucacugaggcugaucuggaaaauuuguuuggaaucauugccucagugcuccaucugggcaacaucgguuucgaggaagacgaccaggggugugcaacaauccccgauacccacgagauuaaguggauagcuaaauuacugggagugcacccuagcguccuccuugaagcccugacgcaucgcaagaucgaggcgaagacugaggaaguuauuugcccauugacccuagagcugaguguguaugcccgagacgcaauggcuaaagccguauacggcagaacauuuacuuggcucgugaacaagaucaauucuucccuggucaacaaagauuucaccaggaagacagugauaggccuucuggacauuuacggguuugaaguuuucgauaaaaauggauuugagcaauucuguaucaacuauugcaaugaaaaguugcagcagcuccugaucgagcggaccuuaaaagcugagcaagccgaauacgagauggaagguauugagugggagcccaucaaguauuuuaacaauaagauuauaugugaccugguggaagaacgucacaaaggcaucauuagcauccuagaugaagagugcauccgcccugggccagcaacggaccucucguuccuggaaaaacuugaggagaaagucggaaagcaugcccacuuugaaacuagaaaauuggcuggcccgaaggguaggaagcggauuggguggauggaguuccgacugcuccacuacgcgggcgaagugacauauuguaccaaaggauuucuggagaagaacaaugaucuucuguaccgccauuugaaagaaguacucugcaagucuaaaaacauaauccugagagaguguuucuuacuggcagagcuagaaaauaggcggcgacccccuacuguuggcacacaguucaagaacucccucucaagucugcuugagaccuugauuagcaaggaaccauccuauaucagaugcauuaaacccaaugacaggaaggagccuucuaaauuugaugacuuccugauccgucaccagauaaaguaccucgggcugauggaacauuuacgggugcgcagagccggauuugcuuacaggcgcaaauaugagcacuuccugcagcgguacaagagccuuugcccagacacguggccccauuggcacgguccgccugccgagggcgucgaaagauugaucaaguauauuggguacaaacccgaggaauauaagcucggaaaaaccaagaucuuuauuagguucccacgcacacuguuugcaacugaggaugccuucgaguuuucaaaacaccagcuaguggcucgaauccaagccaccuacaagcggugucugggccguagagaauaugucaaaaagaggcaggcagcgauaaagcucgaggcucauuggcgcggugcccuggcacggaaagccauucagagaaggaagugggcugugcgaaucauucgcaaauucaucaagggguuuauaagucggaacaaaccucuuugccccgacaaugaagaguucaucguuuuugugagaaagaacuacauuuugaaccugagguaccacuuaccaaagacaguacucgauaaauccuggcugcgucccccuggcauccuugaaaaugccagcgaccuguugcgcaagauguguguccggaaccucgugcaaaaauauugcagaggaauuacugcagagaggaaggcuaugaugcagcagaaaguugugaccucugagaucuuccgaggccggaaggauggguacacagaaucacugaaucagccauucgucaacagucgcauagacgagggagauauuaauccgaaggugcuacaacugaucagccaugaaaagauccaguaugguguacccgugauuaaguacgacagaaaaggcuuuaaggccaggcagcggcagcucauccugacccaaaaagcggccuauguugucgagcuugcuaagauuaagcagaaaauagaauacuccgcauugaagggggugucuacuucgaaccugagcgauggaaucuuagugauucacgucuccccugaggacucaaaacagaagggcgaugccguucuccaauguggucacguguucgaggcugugacgaaacugguaaugcuugucaagaaagaaaauaucgugaacguugugcaggggagucugcaguuuuucauuucuccaggcaaggagggaacaaucgucuuugacaccggccuagaagaacagguguauaagaauaaaaacgggcaacucacuguugugagcguacgaagaaaguccuga

SEQ ID NO: 2846 - RNA, 3069 nt, Artificial Sequence
  derived and/or modified sequence opt4 from MYO1H__Homo_sapiens__CCDS53826.1
auggagggcgcccugaccgccagagacaaggugggcgugcaggacuucgugcugcuggacgccuacaccagcgagagcgccuucguggacaaccugagaaagagauucagcgagaaccugaucuacaccuacaucggcacccugcuggugagcgugaaccccuaccaggagcugggcaucuacaccgugagccagauggagcuguaccagggcgugaacuucuucgagcugcccccccacguguacgccaucgccgacaacgccuacagaaugaugugcgccgagcugaacaaccacuucauccugaucagcggcgagagcggcgccggcaagaccgaggccagcaagaagauccuggaguacuucgccgugaccugccccaugacccagagccugcagaucgccagagacagacugcuguucagcaaccccgugcuggaggccuucggcaacgccagaacccugagaaacgacaacagcagcagauucggcaaguacauggacauccaguucgacuuccagggcauccccgugggcggccacaucaucagcuaccugaucgagaagagcagagugguguaccagaacgagggcgagagaaacuuccacaucuucuaccagcugcuggccggcggcgaggaggagagacugagcuaccugggccuggagagagacccccagcuguacaaguaccugagccagggccacugcgccaaggagagcagcaucagcgacaagaacgacuggaagaccgugagcaacgccuucagcgugaucgacuucaccgaggccgaccuggagaaccuguucggcaucaucgccagcgugcugcaccugggcaacaucggcuucgaggaggacgaccagggcugcgccaccauccccgacacccacgagaucaaguggaucgccaagcugcugggcgugcaccccagcgugcugcuggaggcccugacccacagaaagaucgaggccaagaccgaggaggugaucugcccccugacccuggagcugagcguguacgccagagacgccauggccaaggccguguacggcagaaccuucaccuggcuggugaacaagaucaacagcagccuggugaacaaggacuucaccagaaagaccgugaucggccugcuggacaucuacggcuucgagguguucgacaagaacggcuucgagcaguucugcaucaacuacugcaacgagaagcugcagcagcugcugaucgagagaacccugaaggccgagcaggccgaguacgagauggagggcaucgagugggagcccaucaaguacuucaacaacaagaucaucugcgaccugguggaggagagacacaagggcaucaucagcauccuggacgaggagugcaucagacccggccccgccaccgaccugagcuuccuggagaagcuggaggagaaggugggcaagcacgcccacuucgagaccagaaagcuggccggccccaagggcagaaagagaaucggcuggauggaguucagacugcugcacuacgccggcgaggugaccuacugcaccaagggcuuccuggagaagaacaacgaccugcuguacagacaccugaaggaggugcugugcaagagcaagaacaucauccugagagagugcuuccugcuggccgagcuggagaacagaagaagaccccccaccgugggcacccaguucaagaacagccugagcagccugcuggagacccugaucagcaaggagcccagcuacaucagaugcaucaagcccaacgacagaaaggagcccagcaaguucgacgacuuccugaucagacaccagaucaaguaccugggccugauggagcaccugagagugagaagagccggcuucgccuacagaagaaaguacgagcacuuccugcagagauacaagagccugugccccgacaccuggccccacuggcacggcccccccgccgagggcguggagagacugaucaaguacaucggcuacaagcccgaggaguacaagcugggcaagaccaagaucuucaucagauuccccagaacccuguucgccaccgaggacgccuucgaguucagcaagcaccagcugguggccagaauccaggccaccuacaagagaugccugggcagaagagaguacgugaagaagagacaggccgccaucaagcuggaggcccacuggagaggcgcccuggccagaaaggccauccagagaagaaagugggccgugagaaucaucagaaaguucaucaagggcuucaucagcagaaacaagccccugugccccgacaacgaggaguucaucguguucgugagaaagaacuacauccugaaccugagauaccaccugcccaagaccgugcuggacaagagcuggcugagaccccccggcauccuggagaacgccagcgaccugcugagaaagaugugcgugagaaaccuggugcagaaguacugcagaggcaucaccgccgagagaaaggccaugaugcagcagaagguggugaccagcgagaucuucagaggcagaaaggacggcuacaccgagagccugaaccagcccuucgugaacagcagaaucgacgagggcgacaucaaccccaaggugcugcagcugaucagccacgagaagauccaguacggcgugcccgugaucaaguacgacagaaagggcuucaaggccagacagagacagcugauccugacccagaaggccgccuacgugguggagcuggccaagaucaagcagaagaucgaguacagcgcccugaagggcgugagcaccagcaaccugagcgacggcauccuggugauccacgugagccccgaggacagcaagcagaagggcgacgccgugcugcagugcggccacguguucgaggccgugaccaagcuggugaugcuggugaagaaggagaacaucgugaacguggugcagggcagccugcaguucuucaucagccccggcaaggagggcaccaucguguucgacaccggccuggaggagcagguguacaagaacaagaacggccagcugaccguggugagcgugagaagaaagagcuga

SEQ ID NO: 2847 - RNA, 3069 nt, Artificial Sequence
  derived and/or modified sequence opt5 from MYO1H__Homo_sapiens__CCDS53826.1
auggagggcgcccugaccgcuagagacaagguggggguccaggauuucguucuccuggacgccuacacaagcgaauccgcguuuguggauaaccuucggaaacgcuucucugagaaucugaucuauacguacauuggaacccuccuggugagcgucaaccccuaucaagaacuuggcaucuacacagugucccagauggagcuguaucaggggguuaacuuuuucgaacucccuccgcacguguacgcuauugccgacaaugccuauagaaugaugugcgcugagcugaauaaccauuuuauccugauuucuggagagagcggcgccgggaagaccgaggcuuccaaaaagauccucgaguacuucgccgucacaugucccaugacccagucucugcaaaucgcgcgggaucgccuucuguuuagcaauccugugcucgaagccuucggaaacgcuagaacacugcggaaugacaacuccagccgcuuuggcaaauacauggauauucaguucgacuuucagggcauccccguugggggacacauuaucucuuaucuuauugagaaguccagaguggucuaccagaaugagggcgaacggaacuuccauaucuuuuaucaacugcucgccgggggagaggaagaacgccugagcuaccugggccucgaaagagauccucagcuguauaaguaccuuucucaggggcacugcgcuaaagaguccagcauuucugacaagaaugauuggaaaaccguguccaacgccuucagcgugaucgacuucacggaggcggaucuggaaaaucucuuuggaaucauugccuccguccugcaucuuggcaacaucggcuucgaggaagacgaccaggggugugcuaccauucccgauacacacgagaucaaguggauugccaaacugcucggaguucacccuucugugcugcuggaagcucucacccaucggaagaucgaggccaagacagaggaagugaucugcccgcugacccuugagcugagcgucuaugcccgcgacgcuauggcgaaagccguguacggcagaacguuuacauggcucguuaacaagauuaauuccagccuggugaacaaagauuucacccggaagacagucaucgggcuucuggacauuuacggauuugaaguguucgauaaaaauggcuuugagcaauucuguaucaacuauugcaaugaaaagcuccagcagcugcugauugagcgcacccucaaagcugagcaagccgaauacgagauggaagggaucgagugggagcccaucaaguauuuuaacaauaagauuaucugugaccugguugaagagagacacaaaggaauuaucucuauucuugaugaagagugcauccggccuggccccgccaccgaccuguccuuccucgaaaagcuggaggagaaagugggcaagcaugcucacuuugaaacaagaaaacuggccgggccuaagggacgcaagcggauuggcuggauggaguucagacuucuccacuacgcgggggaagucacguauuguaccaaaggauuucuggagaagaacaaugaucugcucuaccgccaucugaaagaagugcuuugcaagagcaaaaacaucauccugcgggaguguuuccuccuggcugagcuggaaaauagacgccggcccccgacagucggcacccaguucaagaacucucuuagcucccuccuggagacacugauuucuaaggaaccuagcuauaucagaugcauuaaacccaaugaccgcaaggagccuuccaaauuugaugacuuccucauccggcaccagauuaaguaccuggggcuuauggaacaucugagagugcgccgggccggcuuugccuacagacggaaauaugagcacuuccuccagcgcuacaagagccugugccccgacaccuggccccauuggcacggaccuccggcugagggcguugaaagacugaucaaguauaucggguacaaacccgaggaauauaaacuuggaaaaacgaagauuuuuauccgguucccuagaacacucuuugccaccgaggaugcuuucgaguuuucuaaacaccaacugguggcccgcauucaggcgaccuacaagcggugucugggcagacgcgaauaugucaaaaagagacaggccgcuaucaagcucgaggcccauuggcgcggggcucuggcccggaaagcgauucagagacggaagugggccgugcgcaucaucagaaaauucauuaagggauuuaucucccggaacaaaccccuuugcccugacaaugaagaguucauuguuuuugugcgcaagaacuacauccugaaccucagauaccaucugcccaagacaguccuggauaaaagcuggcuucggccgccuggcauucucgaaaaugcuucugaccugcugcgcaagaugugugugagaaaccucgugcaaaaauauugccgggggaucaccgccgagagaaaggcuaugaugcagcagaaaguugucacauccgagaucuuccgcggccggaaggauggauacacggaaagccugaaucagcccuucgugaacuccagaauugacgagggcgauaucaauccuaaggugcuucaacugauuucucacgaaaagauccaguaugggguccccgugauuaaguacgaccgcaaaggauuuaaggcccggcagagacagcucauccugacccaaaaagccgcuuauguuguggagcuggcgaagauuaagcagaaaaucgaauacagcgcccuuaagggcgucuccacaucuaaccugagcgaugggauccucgugauucacguuuccccugaggacagcaaacagaagggagaugcugugcugcaauguggccacgucuucgaggccgugaccaaacucguuaugcuggugaagaaagaaaauaucgucaacguggugcaggggucucuucaguuuuucauuucccccggcaaggagggaacaaucgucuuugacaccggccuggaggaacagguuuauaagaauaaaaacgggcaacucacgguggugagcguccgccggaagucuuga

SEQ ID NO: 2848 - protein, 792 aa, Artificial Sequence
  NA17__Homo_sapiens__Q3V5L5
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKLQGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 2849 - RNA, 2379 nt, Artificial Sequence
  NA17__Homo_sapiens__BAC84969
augaucaccgucaaccccgaugggaagauaauggucagaagaugccuggucacccugagacccuuucggcuuuuuguccugggcaucggcuucuucacucucugcuuccugaugacgucucugggaggccaguucucggcccggcgccugggggacucgccauucaccauccgcacagaagugauggggggccccgagucccgcggcguccugcgcaagaugagcgaccugcuggagcugauggugaagcgcauggacgcacuggccaggcuggagaacagcagugagcugcaccgggccggcggcgaccugcacuuucccgcagacaggaugcccccuggggccggccucauggagcggauccaggcuauugcccagaacgucuccgacaucgcugugaagguggaccagauccugcgccacagucugcuccugcacagcaaggugucagaaggccggcgggaccagugugaggcacccagugaccccaaguucccugacugcucagggaagguggaguggaugcgugcccgcuggaccucugaccccugcuacgccuucuuugggguggacggcaccgagugcuccuuccucaucuaccucagugaggucgagugguucugccccccgcugcccuggaggaaccagacggcugcccagagggcacccaagccccuccccaaaguccaggcaguuuuccgaagcaaccugucccaccuucuggaccugaugggcagcgggaaggagucccugaucuucaugaagaagcggaccaagaggcucacagcccagugggcgcuggcugcccagcgccuggcacagaagcugggggccacccagagggaccagaagcagauccugguccacaucggcuuccugacggaggaguccggggacguguucagcccucggguccugaagggcgggccccuaggggagauggugcagugggcggacauucugacugcacucuauguccugggccauggccugcgggucacagucucccugaaggagcugcagaguaacuuagggguaccgccaggccggggaagcugcccgcucaccaugccccugcccuucgaccucaucuacaccgacuaccacggccugcagcagaugaagcggcacaugggacucuccuucaagaaguaccggugccgaaucagggucaucgacaccuucgggacggaaccugcguacaaccacgaggaguacgccacgcugcacggcuaccggaccaacuggggcuacuggaaccucaaccccaagcaguucaugaccauguuuccucauacccccgacaacuccuucaugggcuucguguccgaggagcucaacgagacggagaagcggcucaucaaaggcggcaaggccagcaacauggccgugguguacggcaaggaggcgagcaucuggaagcuccaggggaaggagaaguuccugggcauccugaacaaauacauggagauccauggcaccguguacuacgagagccagcggccccccgaggugccagccuuugugaagaaccacggccucuuaccgcagccugaguuucagcagcugcugcgcaaggccaaacucuucaucggguuuggcuuccccuacgagggccccgccccccuggaggccaucgccaaugguugcaucuuccugcagucccgcuucagcccgccccacagcucccucaaccacgaguucuuccgaggcaagcccaccuccagagagguguucucccagcaucccuacgcggagaacuucaucggcaagccccacguguggacagucgacuacaacaacucagaggaguuugaagcagccaucaaggccauuaugagaacucagguagaccccuaccuacccuaugaguacaccugcgaggggaugcuggagcggauccacgccuacauccagcaccaggacuucugcagagcuccagacccugcccuaccagaggcccacgccccgcagagccccuuuguccuggcccccaaugccacccaccucgagugggcucggaacaccagcuuggcuccuggggccuggccccccgcgcacgcccugcgggccuggcuggccgugccugggagggccugcaccgacaccugccuggaccacgggcuaaucugugagcccuccuucuuccccuuccugaacagccaggacgccuuccucaagcugcaggugcccugugacagcaccgagucggagaugaaccaccuguacccggcguucgcccagccuggccaggagugcuaccugcagaaggagccucugcucuucagcugcgccggcuccaacaccaaguaccgccggcucugccccugccgcgacuuccgcaagggccagguggccuugugccagggcugucuguga

SEQ ID NO: 2850 - RNA, 2379 nt, Artificial Sequence
  derived and/or modified sequence opt1 from NA17__Homo_sapiens__BAC84969
augaucaccgugaaccccgacggcaagaucaugguccgccggugccuggugacccuccgcccguuccggcuguucgugcuggggaucggcuucuucacgcucugcuuccugaugaccagccucgggggccaguucuccgcccgccggcugggggacagccccuucaccauccgcaccgaggucaugggcggccccgagucccgcggggugcugcgcaagaugagcgaccugcucgagcugauggugaagcggauggacgcccuggcgcgccucgagaacuccagcgagcugcaccgggccggcggggaccugcacuuccccgccgaccgcaugccgcccggcgccgggcucauggagcggauccaggccaucgcgcagaacgucuccgacaucgccgugaagguggaccagauccugcgccacagccugcuccugcacuccaaggucagcgagggccggcgcgaccagugcgaggcccccuccgaccccaaguucccggacugcagcggcaagguggaguggaugcgggcccgcuggacguccgaccccugcuacgcguucuucgggguggacggcaccgagugcagcuuccugaucuaccucuccgaggucgagugguucugcccgccccugcccuggcggaaccagaccgccgcccagcgcgcccccaagccccugcccaaggugcaggccguguuccggagcaaccucucccaccuccuggaccugauggggagcggcaaggagucccugaucuucaugaagaagcgcaccaagcgccugacggcgcagugggcccucgccgcccagcggcuggcccagaagcugggcgcgacccagcgcgaccagaagcagauccucguccacaucggguuccugaccgaggagagcggcgacguguucagcccgcgggugcugaagggcgggccccucggggagaugguccagugggccgacauccugaccgcccuguacgugcucggccacggccugcgcgugacggucucccugaaggagcuccagagcaaccugggggugccgcccggccggggguccugcccccugaccaugccccuccccuucgaccugaucuacaccgacuaccacggccugcagcagaugaagcgccacauggggcucagcuucaagaaguaccggugccgcauccgggugaucgacaccuucggcacggagcccgccuacaaccacgaggaguacgccacccugcacggcuaccgcaccaacuggggguacuggaaccugaacccgaagcaguucaugaccauguucccccacacgcccgacaacuccuucaugggcuucgucagcgaggagcugaacgagaccgagaagcggcucaucaagggcgggaaggcguccaacauggccguggucuacgggaaggaggccagcaucuggaagcugcagggcaaggagaaguuccugggcauccucaacaaguacauggagauccacgggaccguguacuacgagucccagcggcccccggaggugcccgccuucgucaagaaccacggccugcugccccagccggaguuccagcagcuccugcggaaggccaagcuguucaucggguucggcuuccccuacgagggccccgcgccccucgaggccaucgccaacgggugcaucuuccugcagagccgcuucuccccgccccacagcucccugaaccacgaguucuuccggggcaagcccaccagccgcgagguguucucccagcaccccuacgccgagaacuucaucgggaagccgcacguguggacggucgacuacaacaacagcgaggaguucgaggcggccaucaaggccaucaugcggacccagguggaccccuaccuccccuacgaguacacgugcgagggcaugcuggagcgcauccacgccuacauccagcaccaggacuucugccgggcccccgacccggcgcugcccgaggcccacgcgccccagucccccuucgugcucgccccgaacgccacccaccuggagugggcccgcaacaccagccuggcccccggggccuggccgcccgcccacgcccuccgcgcguggcuggccguccccggccgggccugcaccgacacgugccuggaccacggccucaucugcgagcccuccuucuuccccuuccugaacagccaggacgccuuccugaagcuccaggugcccugcgacagcaccgaguccgagaugaaccaccuguacccggcguucgcccagcccgggcaggagugcuaccugcagaaggagccccuccuguucagcugcgccggcuccaacaccaaguaccgccggcugugcccgugccgcgacuuccggaagggccagguggcccucugccaggggugccuguga

SEQ ID NO: 2851 - RNA, 2379 nt, Artificial Sequence
  derived and/or modified sequence opt2 from NA17__Homo_sapiens__BAC84969
augaucaccgucaaccccgacggcaagaucaugguccgccgcugccucgucacccuccgccccuuccgccucuucguccucggcaucggcuucuucacccucugcuuccucaugaccucccucggcggccaguucuccgcccgccgccucggcgacucccccuucaccauccgcaccgaggucaugggcggccccgagucccgcggcguccuccgcaagauguccgaccuccucgagcucauggucaagcgcauggacgcccucgcccgccucgagaacuccuccgagcuccaccgcgccggcggcgaccuccacuuccccgccgaccgcaugccccccggcgccggccucauggagcgcauccaggccaucgcccagaacgucuccgacaucgccgucaaggucgaccagauccuccgccacucccuccuccuccacuccaaggucuccgagggccgccgcgaccagugcgaggcccccuccgaccccaaguuccccgacugcuccggcaaggucgaguggaugcgcgcccgcuggaccuccgaccccugcuacgccuucuucggcgucgacggcaccgagugcuccuuccucaucuaccucuccgaggucgagugguucugccccccccuccccuggcgcaaccagaccgccgcccagcgcgcccccaagccccuccccaagguccaggccgucuuccgcuccaaccucucccaccuccucgaccucaugggcuccggcaaggagucccucaucuucaugaagaagcgcaccaagcgccucaccgcccagugggcccucgccgcccagcgccucgcccagaagcucggcgccacccagcgcgaccagaagcagauccucguccacaucggcuuccucaccgaggaguccggcgacgucuucuccccccgcguccucaagggcggcccccucggcgagaugguccagugggccgacauccucaccgcccucuacguccucggccacggccuccgcgucaccgucucccucaaggagcuccaguccaaccucggcgucccccccggccgcggcuccugcccccucaccaugccccuccccuucgaccucaucuacaccgacuaccacggccuccagcagaugaagcgccacaugggccucuccuucaagaaguaccgcugccgcauccgcgucaucgacaccuucggcaccgagcccgccuacaaccacgaggaguacgccacccuccacggcuaccgcaccaacuggggcuacuggaaccucaaccccaagcaguucaugaccauguucccccacacccccgacaacuccuucaugggcuucgucuccgaggagcucaacgagaccgagaagcgccucaucaagggcggcaaggccuccaacauggccgucgucuacggcaaggaggccuccaucuggaagcuccagggcaaggagaaguuccucggcauccucaacaaguacauggagauccacggcaccgucuacuacgagucccagcgcccccccgagguccccgccuucgucaagaaccacggccuccucccccagcccgaguuccagcagcuccuccgcaaggccaagcucuucaucggcuucggcuuccccuacgagggccccgccccccucgaggccaucgccaacggcugcaucuuccuccagucccgcuucucccccccccacuccucccucaaccacgaguucuuccgcggcaagcccaccucccgcgaggucuucucccagcaccccuacgccgagaacuucaucggcaagccccacgucuggaccgucgacuacaacaacuccgaggaguucgaggccgccaucaaggccaucaugcgcacccaggucgaccccuaccuccccuacgaguacaccugcgagggcaugcucgagcgcauccacgccuacauccagcaccaggacuucugccgcgcccccgaccccgcccuccccgaggcccacgccccccagucccccuucguccucgcccccaacgccacccaccucgagugggcccgcaacaccucccucgcccccggcgccuggccccccgcccacgcccuccgcgccuggcucgccguccccggccgcgccugcaccgacaccugccucgaccacggccucaucugcgagcccuccuucuuccccuuccucaacucccaggacgccuuccucaagcuccagguccccugcgacuccaccgaguccgagaugaaccaccucuaccccgccuucgcccagcccggccaggagugcuaccuccagaaggagccccuccucuucuccugcgccggcuccaacaccaaguaccgccgccucugccccugccgcgacuuccgcaagggccaggucgcccucugccagggcugccucuga

SEQ ID NO: 2852 - RNA, 2379 nt, Artificial Sequence
  derived and/or modified sequence opt3 from NA17__Homo_sapiens__BAC84969
augaucaccgugaaccccgacggcaagauuauggucagaaggugccugguuacacuccggccuuuccgccuuuuugugcuggggauaggauucuuuacuuuguguuucuuaaugacgagccuggguggccaguuuuccgcccgacgucuaggggauucuccauucaccaucagaacagagguaaugggaggcccggaaucaaggggugugcuccggaaaaugagugaccugcuugagcugauggucaagcgcauggaugcuuuggcaagacucgaaaauagcuccgagcugcacagggccgggggagaccugcauuuucccgcggaucggaugccuccaggcgcuggccucauggaacgcauucaagccaucgcacagaacgugucugacauugccguuaaaguggaucagaucuuacgacacucgcugcuuuugcauucaaaggucagcgaggggagaagggaccagugcgaggcucccagugauccuaaauucccagacuguuccggaaagguggaauggaugcgggcacguuggacuucugaucccugcuacgccuuuuucgguguagacggcaccgaguguagcuuucugauauaucuauccgaaguugagugguucugcccuccacucccguggcgcaaucaaacagcugcccagagagcgcccaagccucugccaaaagugcaggcagucuuuaggucaaaccuuagucaccuguuggaucucauggggagcggaaaggagucucugaucuucaugaaaaagcggaccaaacgauuaacugcccagugggcucuggccgcacaacgccucgcucagaagcugggcgccacacagagagaccagaagcaaauucuggugcauaucgguuucuugaccgaagaguccggggacguguuuucacccaggguccuaaaaggaggcccucugggcgaaaugguucagugggcggauauucucacggcccuguacgugcuugggcacggacugcggguaacugugagcuugaaggagcuccagaguaaucugggugucccacccggccgcgggucuuguccguuaaccaugccucugcccuucgaccuaaucuauacagauuaccacggacuccaacagaugaaaagacauaugggccuguccuuuaagaaauauaggugccguauacgggugauugacacuuucgguaccgaaccagcauacaaccacgaggaguaugcuacacuucauggguaccgaaccaauuggggcuacuggaacuugaauccuaagcaguuuaugacgauguucccccacacuccagauaacagcuuuaugggauucguuucggaggaacugaaugaaacagagaaaagacucaucaagggcgggaaggccucuaacauggcuguggucuauggaaaagaagccuccauuuggaagcugcaggguaaagagaaguuucuuggcauccugaauaaauacauggagauccacgggaccguguauuacgaaucacaaaggcccccugagguaccagcauucguuaagaaccauggauugcucccgcagcccgaauuucagcagcuguuacgcaaggccaaacuguucauuggcuuugguuucccuuaugaggggccagcuccccuagaagcgauagcaaauggcuguaucuuccuccaaagucgguuuagcccuccacacuccucucugaaccaugaguucuuuagaggaaagcccacuagcagggagguguucucacagcacccguacgccgaaaacuuuauuggcaaaccucaugucuggacaguggacuauaauaacagugaggaauuugaggcugccaucaaggcaauaaugcgcacccaggucgauccauaccuucccuacgaguauacgugcgaagggauguuggagcggauucacgccuacauccagcaccaagacuuuugucgagcuccugaucccgcccugccagaagcacaugcgccucagucccccuucgugcucgcuccaaaugccacccaccuggagugggcacguaacacaagccuggccccgggagcuuggccucccgcccaugcacugagagcuuggcuugccguuccagguagggcgugcacugauaccugcuuggaccacggccucaucugugaacccucuuucuucccuuuucuuaauucacaggacgccuuccuaaaauuacaggugccaugcgacaguacagagagcgagaugaaccaccucuaucccgcuuuugcacaaccugggcaggaauguuaccugcagaaggagccgcuuuuguucuccugcgccggaucuaauacuaaguaucgccggcuguguccaugcagagauuucaggaaaggccaaguagcuuuaugucaggguugccucuga

SEQ ID NO: 2853 - RNA, 2379 nt, Artificial Sequence
  derived and/or modified sequence opt4 from NA17__Homo_sapiens__BAC84969
augaucaccgugaaccccgacggcaagaucauggugagaagaugccuggugacccugagacccuucagacuguucgugcugggcaucggcuucuucacccugugcuuccugaugaccagccugggcggccaguucagcgccagaagacugggcgacagccccuucaccaucagaaccgaggugaugggcggccccgagagcagaggcgugcugagaaagaugagcgaccugcuggagcugauggugaagagaauggacgcccuggccagacuggagaacagcagcgagcugcacagagccggcggcgaccugcacuuccccgccgacagaaugccccccggcgccggccugauggagagaauccaggccaucgcccagaacgugagcgacaucgccgugaagguggaccagauccugagacacagccugcugcugcacagcaaggugagcgagggcagaagagaccagugcgaggcccccagcgaccccaaguuccccgacugcagcggcaagguggaguggaugagagccagauggaccagcgaccccugcuacgccuucuucggcguggacggcaccgagugcagcuuccugaucuaccugagcgagguggagugguucugccccccccugcccuggagaaaccagaccgccgcccagagagcccccaagccccugcccaaggugcaggccguguucagaagcaaccugagccaccugcuggaccugaugggcagcggcaaggagagccugaucuucaugaagaagagaaccaagagacugaccgcccagugggcccuggccgcccagagacuggcccagaagcugggcgccacccagagagaccagaagcagauccuggugcacaucggcuuccugaccgaggagagcggcgacguguucagccccagagugcugaagggcggcccccugggcgagauggugcagugggccgacauccugaccgcccuguacgugcugggccacggccugagagugaccgugagccugaaggagcugcagagcaaccugggcgugccccccggcagaggcagcugcccccugaccaugccccugcccuucgaccugaucuacaccgacuaccacggccugcagcagaugaagagacacaugggccugagcuucaagaaguacagaugcagaaucagagugaucgacaccuucggcaccgagcccgccuacaaccacgaggaguacgccacccugcacggcuacagaaccaacuggggcuacuggaaccugaaccccaagcaguucaugaccauguucccccacacccccgacaacagcuucaugggcuucgugagcgaggagcugaacgagaccgagaagagacugaucaagggcggcaaggccagcaacauggccgugguguacggcaaggaggccagcaucuggaagcugcagggcaaggagaaguuccugggcauccugaacaaguacauggagauccacggcaccguguacuacgagagccagagaccccccgaggugcccgccuucgugaagaaccacggccugcugccccagcccgaguuccagcagcugcugagaaaggccaagcuguucaucggcuucggcuuccccuacgagggccccgccccccuggaggccaucgccaacggcugcaucuuccugcagagcagauucagccccccccacagcagccugaaccacgaguucuucagaggcaagcccaccagcagagagguguucagccagcaccccuacgccgagaacuucaucggcaagccccacguguggaccguggacuacaacaacagcgaggaguucgaggccgccaucaaggccaucaugagaacccagguggaccccuaccugcccuacgaguacaccugcgagggcaugcuggagagaauccacgccuacauccagcaccaggacuucugcagagcccccgaccccgcccugcccgaggcccacgccccccagagccccuucgugcuggcccccaacgccacccaccuggagugggccagaaacaccagccuggcccccggcgccuggccccccgcccacgcccugagagccuggcuggccgugcccggcagagccugcaccgacaccugccuggaccacggccugaucugcgagcccagcuucuuccccuuccugaacagccaggacgccuuccugaagcugcaggugcccugcgacagcaccgagagcgagaugaaccaccuguaccccgccuucgcccagcccggccaggagugcuaccugcagaaggagccccugcuguucagcugcgccggcagcaacaccaaguacagaagacugugccccugcagagacuucagaaagggccagguggcccugugccagggcugccuguga

SEQ ID NO: 2854 - RNA, 2379 nt, Artificial Sequence
  derived and/or modified sequence opt5 from NA17__Homo_sapiens__BAC84969
augaucaccgugaaccccgacggcaagauuauggucagacggugccugguuacacuccgcccuuucagacuguuugugcuugggaucggauucuuuacgcuguguuuccucaugaccagccugggcgggcaguuuuccgcccggcgccuuggagauucuccguucacaauuagaaccgaggugaugggcgggcccgaaagccggggaguccugcgcaaaauguccgaccuccuggagcugauggugaagagaauggaugcucucgcccggcuggaaaauucuagcgagcuucaccgcgcgggcggcgaccugcauuuuccugcugauagaaugcccccuggggccggacucauggaacggauccaagccauugcucagaacguuuccgacaucgccgugaaagucgaucagauccugcgccacucucuucugcuccauagcaagguguccgagggcagacgggaccagugcgaggcucccagcgauccuaaauucccggacuguucugggaagguugaauggaugcgcgccagauggacauccgaucccugcuacgcguuuuucggaguggacggcaccgaguguagcuuucugauuuaucugucugaagucgagugguucugcccuccccucccuuggcggaaucaaacagccgcucagagagcccccaagccgcugccuaaagugcaggcuguguuucgcuccaaccuuagccaucugcucgaucugauggggucuggaaaggagucccuuaucuucaugaaaaagcggaccaaaagacugacggcccagugggcgcucgccgcucaacgccuggcccagaagcugggcgcuacccagcgggaccagaagcaaauucucguccacaucggcuuccugacagaagagagcggggacguuuucucccccagagugcuuaaaggaggcccucugggggaaauggugcagugggccgauauucucaccgcccuguacguccuuggacacggccugcgcgugacaguuucucucaaggagcugcagagcaaucugggggugccucccggacggggcuccuguccccucaccaugccgcugcccuucgaccuuaucuauacggauuaccacggccugcaacagaugaaaagacauauggggcucagcuuuaagaaauaucgcugccggauuagagucaucgacacauucggaaccgaaccugcuuacaaccacgaggaguaugcgacacugcauggcuaccgcaccaauuggggguacuggaaccugaaucccaagcaguuuaugaccauguucccucacacacccgauaacucuuuuaugggauucguguccgaggaacuuaaugaaacggagaaacggcucaucaagggcgggaaggccagcaacauggcuguuguguauggcaaagaagccucuauuuggaagcugcagggaaaagagaaguuucugggcauccucaauaaauacauggagauucacgggaccgucuauuacgaaagccaaagaccgccugaggugcccgccuucgucaagaaccauggacugcuuccucagcccgaauuucagcagcugcuccggaaggcuaaacuguucaucggcuuuggguucccuuaugagggacccgccccgcuggaagcgauugcuaauggcuguaucuuccuucaaucccgcuuuucuccuccccacagcucccucaaccaugaguucuuuagagggaagcccacaagccgggagguguucucucagcacccuuacgccgaaaacuuuaucggcaaaccgcauguuuggaccguggacuauaauaacuccgaggaauuugaggccgcuauuaaggccaucaugagaacacaggucgaucccuaccugccuuacgaguauaccugcgaaggaaugcuggagcgcauucacgcuuacauccagcaccaagacuuuugucgggcccccgauccugcgcuccccgaagcccaugcuccucagagccccuucgugcuggccccgaaugcuacgcaccuugagugggccagaaacacaucucuggcgccuggcgccuggcccccugcucaugcccuccgcgcuuggcuggccguucccgggagagccugcaccgauaccugccuggaccacggacuuauuugugaaccguccuuuuucccuuuucucaauagccaggacgcuuuccugaaacuccaggugcccugcgacuccacagagucugagaugaaccaccuguauccugcguuugcccaacccggccaggaauguuaccugcagaaggagccccuucuguucagcugcgcuggguccaauaccaaguaucggcgccucuguccuugcagagauuuccggaaaggacaagucgcccugugucagggcugccuguga

SEQ ID NO: 2855 - protein, 11 aa, Artificial Sequence
  NA88-A__Homo_sapiens__10790436
MTQGQHFLQKV

SEQ ID NO: 2856 - RNA, 36 nt, Artificial Sequence
  NA88-A__Homo_sapiens__AF164963.1
augacucaaggacagcacuuccugcagaaagucuag

SEQ ID NO: 2857 - RNA, 36 nt, Artificial Sequence
  derived and/or modified sequence opt1 from NA88-A__Homo_sapiens__AF164963.1
augacccagggccagcacuuccugcagaagguguga

SEQ ID NO: 2858 - RNA, 36 nt, Artificial Sequence
  derived and/or modified sequence opt2 from NA88-A__Homo_sapiens__AF164963.1
augacccagggccagcacuuccuccagaaggucuga

SEQ ID NO: 2859 - RNA, 36 nt, Artificial Sequence
  derived and/or modified sequence opt3 from NA88-A__Homo_sapiens__AF164963.1
augacccagggccaacacuuccugcagaagguguga

SEQ ID NO: 2860 - RNA, 36 nt, Artificial Sequence; identical to SEQ ID NO: 2857
  derived and/or modified sequence opt4 from NA88-A__Homo_sapiens__AF164963.1

SEQ ID NO: 2861 - RNA, 36 nt, Artificial Sequence; identical to SEQ ID NO: 2859
  derived and/or modified sequence opt5 from NA88-A__Homo_sapiens__AF164963.1

SEQ ID NO: 2862 - protein, 736 aa, Artificial Sequence
  Neo-PAP__Homo_sapiens__Q9BWT3
MKEMSANTVLDSQRQQKHYGITSPISLASPKEIDHIYTQKLIDAMKPFGVFEDEEELNHRLVVLGKLNNLVKEWISDVSESKNLPPSVVATVGGKIFTFGSYRLGVHTKGADIDALCVAPRHVERSDFFQSFFEKLKHQDGIRNLRAVEDAFVPVIKFEFDGIEIDLVFARLAIQTISDNLDLRDDSRLRSLDIRCIRSLNGCRVTDEILHLVPNKETFRLTLRAVKLWAKRRGIYSNMLGFLGGVSWAMLVARTCQLYPNAAASTLVHKFFLVFSKWEWPNPVLLKQPEESNLNLPVWDPRVNPSDRYHLMPIITPAYPQQNSTYNVSTSTRTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKFIRLESTFKDPRTAEERKRKSVDAIGGESMPIPTIDTSRKKRLPSKELPDSSSPVPANNIRVIKNSIRLTLNR

SEQ ID NO: 2863 - RNA, 2211 nt, Artificial Sequence
  Neo-PAP__Homo_sapiens__AAI11702
augaaagagaugucugcaaacaccgugcuggacagccagcgucaacaaaagcauuauggaauuaccuccccaauuaguuuggcaucuccuaaagaaauugaucauauuuacacacagaaauuaauugacgccaugaaaccauuuggaguguuugaagaugaggaagaauugaaccacaggcuggugguucuugguaaauugaacaauuuaguaaaagaauggauuucugaugucagcgagaguaagaaccucccaccuucuguuguggcuacuguuggugguaaaauuuucacauuuggauccuauaggcuuggaguacacaccaaaggagcugacauugaugcacuuuguguagcuccaagacauguggaaagaucugauuuuuuucagucuuuuuuugaaaaauugaaacaucaagauggcauuagaaacuuaagagcuguagaagaugccuuuguaccuguuauaaaauuugaauuugaugguauugaaauugaucuagucuuugcaagacuggcaauacaaaccauaucagauaauuuagaucuaagagacgacucucgccugagaagccuugauauaagguguauucgcagcuuaaaugguuguagaguuacugaugaaauuuugcauuuagugccaaauaaagaaacuuuuagacucacccuaagagcugucaaauuaugggcaaaacgacgugguauuuauuccaacaugcuaggauuccuugguggugucuccugggcaaugcuaguugcaagaacuugccaauuguauccaaaugcagcagcaucuacuuuaguucauaaguucuuuuuaguuuuuuccaagugggaauggccaaauccugugcugcugaagcaaccagaagaaagcaauuugaauuugccugucugggauccucggguaaauccaucagauagguaucaucucaugcccauaaucaccccugccuacccacaacagaauucuacguauaauguguccacaucaacucgaacaguaaugguagaagaauuuaaacaaggucuugcagucacagaugaaauucuucaaggaaagucagauugguccaaacuacuugagccaccgaauuucuuucaaaaguauagacauuauauaguauugacugccagcgcaucaacagaagaaaaccaucuagaguggguuggauuaguagaaucuaaaauccguguacuuguuggaaacuuggaacggaaugaauuuauuacucuugcccaugugaauccccagucauucccagggaauaaggaacaucauaaagacaacaauuacguaucaaugugguuccuugggauaauuuuucggagaguagaaaaugcagaaagugucaacauagacuugacauaugauauacagucauuuacugauacaguguacagacaggcaaacaauauaaauaugcuaaaggagggaaugaaaauugaagcaacucauguaaagaaaaaacaacuucaccacuaccuuccugcagaaauucuucaaaagaagaaaaagcaaagucucucugaugucaaucgaagcucgggcggacuucaauccaaaagauugucucuggauagcaguugucuggauagcuccagagacacugauaauggaacaccuuuuaauucuccagcguccaagucugauagcccuucuguaggagaaacagaaaggaauagugcugagccugcugcuguaauuguggagaagccacugaguguaccaccagcccaaggacuuuccauuccagugauuggcgcaaaaguugacucuacaguaaaaacuguaucaccccccacuguguguaccauuccuaccguaguaggacgaaaugucauuccuagaaucacaacaccucacaacccugcccagggacaaccgcaucugaauggaaugucaaauauaacuaagacuguuacaccuaagagaucccauuccccauccauagaugggacuccuaagagguugaaagacguagaaaaguuuauucgacuugaaucaacauuuaaggacccccgcacugcugaagaaagaaaaagaaaaucaguggaugccauuggaggagaaucuaugccuauuccaacuauugauacaucacgcaaaaagagacuacccaguaaagaacuaccagauucaucaucuccaguuccagcaaacaacauccgugucaucaaaaauuccauucgacugacccuuaaucgguaa

SEQ ID NO: 2864 - RNA, 2211 nt, Artificial Sequence
  derived and/or modified sequence opt1 from Neo-PAP__Homo_sapiens__AAI11702
augaaggagaugagcgccaacaccgugcuggacucccagcgccagcagaagcacuacggcaucaccagccccaucucccucgccagcccgaaggagaucgaccacaucuacacgcagaagcugaucgacgcgaugaagcccuucggggucuucgaggacgaggaggagcugaaccaccggcucguggugcugggcaagcugaacaaccucgucaaggaguggaucuccgacgugagcgaguccaagaaccugccgcccagcguggucgccaccgucgggggcaagaucuucaccuucggguccuaccgccugggcgugcacaccaagggcgccgacaucgacgcccucugcgucgccccgcggcacguggagcgcagcgacuucuuccaguccuucuucgagaagcugaagcaccaggacgggauccggaaccugcgcgcgguggaggacgccuucguccccgugaucaaguucgaguucgacggcaucgagaucgaccucguguucgcccggcuggccauccagacgaucagcgacaaccuggaccuccgcgacgacucccggcugcgcagccuggacauccggugcauccgcucccucaacgggugccgggucaccgacgagauccugcaccuggugcccaacaaggagaccuuccgccucacccugcgggcggugaagcugugggccaagcgccggggcaucuacagcaacaugcucggguuccugggcggcgucuccugggccaugcugguggcccgcacgugccagcucuaccccaacgccgcggccagcacccuggugcacaaguucuuccuggucuucuccaagugggaguggccgaaccccgugcuccugaagcagcccgaggagagcaaccugaaccuccccgugugggacccgcgggucaaccccagcgaccgcuaccaccugaugcccaucaucacccccgccuacccgcagcagaacuccaccuacaacgugagcacguccacccggaccgucaugguggaggaguucaagcaggggcuggccgugaccgacgagauccuccagggcaagagcgacugguccaagcugcuggagccgcccaacuucuuccagaaguaccgccacuacaucguccucacggccagcgcguccaccgaggagaaccaccuggaguggguggggcugguggagagcaagauccgcguccucgugggcaaccuggagcggaacgaguucaucacccuggcccacgugaacccccaguccuuccccggcaacaaggagcaccacaaggacaacaacuacgucagcaugugguuccucgggaucaucuuccgccggguggagaacgccgaguccgugaacaucgaccugaccuacgacauccagagcuucacggacaccgucuaccgccaggccaacaacaucaacaugcugaaggagggcaugaagaucgaggccacccacgugaagaagaagcagcuccaccacuaccugcccgcggagauccugcagaagaagaagaagcagucccugagcgacgugaaccgguccagcgggggccuccaguccaagcgccugagccuggacuccagcugccucgacagcucccgggacaccgacaacgggacgcccuucaacagccccgccuccaagagcgacuccccgagcgucggcgagaccgagcgcaacuccgccgagcccgccgccgugaucguggagaagccccugagcgugcccccggcgcagggccuguccauccccgugaucggggccaagguggacagcaccgucaagaccguguccccgcccacggugugcaccauccccaccgucgugggccggaacgugaucccccgcaucaccacgccccacaaccccgcccaggggcagccccaccucaacggcaugagcaacaucaccaagaccgucacccccaagcggucccacagccccuccaucgacgggacgccgaagcgccugaaggacguggagaaguucauccggcuggagagcaccuucaaggacccccgcaccgccgaggagcggaagcgcaaguccguggacgcgaucggcggcgagagcaugcccauccccaccaucgacaccagccggaagaagcgccucccguccaaggagcugcccgacagcuccagccccguccccgccaacaacauccgggugaucaagaacuccauccgccugacgcucaaccgcuga

SEQ ID NO: 2865 - RNA, 2211 nt, Artificial Sequence
  derived and/or modified sequence opt2 from Neo-PAP__Homo_sapiens__AAI11702
augaaggagauguccgccaacaccguccucgacucccagcgccagcagaagcacuacggcaucaccucccccaucucccucgccucccccaaggagaucgaccacaucuacacccagaagcucaucgacgccaugaagcccuucggcgucuucgaggacgaggaggagcucaaccaccgccucgucguccucggcaagcucaacaaccucgucaaggaguggaucuccgacgucuccgaguccaagaaccucccccccuccgucgucgccaccgucggcggcaagaucuucaccuucggcuccuaccgccucggcguccacaccaagggcgccgacaucgacgcccucugcgucgccccccgccacgucgagcgcuccgacuucuuccaguccuucuucgagaagcucaagcaccaggacggcauccgcaaccuccgcgccgucgaggacgccuucguccccgucaucaaguucgaguucgacggcaucgagaucgaccucgucuucgcccgccucgccauccagaccaucuccgacaaccucgaccuccgcgacgacucccgccuccgcucccucgacauccgcugcauccgcucccucaacggcugccgcgucaccgacgagauccuccaccucguccccaacaaggagaccuuccgccucacccuccgcgccgucaagcucugggccaagcgccgcggcaucuacuccaacaugcucggcuuccucggcggcgucuccugggccaugcucgucgcccgcaccugccagcucuaccccaacgccgccgccuccacccucguccacaaguucuuccucgucuucuccaagugggaguggcccaaccccguccuccucaagcagcccgaggaguccaaccucaaccuccccgucugggacccccgcgucaaccccuccgaccgcuaccaccucaugcccaucaucacccccgccuacccccagcagaacuccaccuacaacgucuccaccuccacccgcaccgucauggucgaggaguucaagcagggccucgccgucaccgacgagauccuccagggcaaguccgacugguccaagcuccucgagccccccaacuucuuccagaaguaccgccacuacaucguccucaccgccuccgccuccaccgaggagaaccaccucgagugggucggccucgucgaguccaagauccgcguccucgucggcaaccucgagcgcaacgaguucaucacccucgcccacgucaacccccaguccuuccccggcaacaaggagcaccacaaggacaacaacuacgucuccaugugguuccucggcaucaucuuccgccgcgucgagaacgccgaguccgucaacaucgaccucaccuacgacauccaguccuucaccgacaccgucuaccgccaggccaacaacaucaacaugcucaaggagggcaugaagaucgaggccacccacgucaagaagaagcagcuccaccacuaccuccccgccgagauccuccagaagaagaagaagcagucccucuccgacgucaaccgcuccuccggcggccuccaguccaagcgccucucccucgacuccuccugccucgacuccucccgcgacaccgacaacggcacccccuucaacucccccgccuccaaguccgacucccccuccgucggcgagaccgagcgcaacuccgccgagcccgccgccgucaucgucgagaagccccucuccgucccccccgcccagggccucuccauccccgucaucggcgccaaggucgacuccaccgucaagaccgucuccccccccaccgucugcaccauccccaccgucgucggccgcaacgucaucccccgcaucaccaccccccacaaccccgcccagggccagccccaccucaacggcauguccaacaucaccaagaccgucacccccaagcgcucccacucccccuccaucgacggcacccccaagcgccucaaggacgucgagaaguucauccgccucgaguccaccuucaaggacccccgcaccgccgaggagcgcaagcgcaaguccgucgacgccaucggcggcgaguccaugcccauccccaccaucgacaccucccgcaagaagcgccuccccuccaaggagcuccccgacuccuccucccccguccccgccaacaacauccgcgucaucaagaacuccauccgccucacccucaaccgcuga

SEQ ID NO: 2866 - RNA, 2211 nt, Artificial Sequence
  derived and/or modified sequence opt3 from Neo-PAP__Homo_sapiens__AAI11702
augaaggagaugagcgccaacaccgugcuggacucccagagacaacagaaacacuacggcaucacaucucccauuucacucgcuaguccuaaggaaauagaucauaucuauacucagaaacuuauugacgcaaugaagccauucggggucuuugaggaugaagaggaacugaaucacagguugguuguguuaggaaaacugaacaaucuaguaaaggaguggaucagcgacguguccgagucuaagaaccucccgcccucggucguggccacgguugguggcaaaauuuucaccuuugggucauaccggcugggagugcauacaaagggcgcggauaucgacgcucuuugcgucgccccucgccacguggaacgaagcgauuucuuucagaguuucuuugagaaacugaagcaucaagacgguauacguaauuugagagcaguagaagaugccuucguuccagugaucaaauuugaguucgacgggauugagaucgaucucgucuuugcuaggcuggcaauucagacuaucuccgacaaccuggaucuccgggacgacucucgcuuaagaagccuggauauaagguguauucggucccuuaauggaugccgcgugaccgacgaaaucuugcaccuggugcccaacaaggagacauuccgacuaacccucagagccgucaagcugugggcuaaaaggcggggcauuuauucaaauaugcuuggcuuucugggagggguuaguugggccauguugguggcgcguacuugucagcucuacccuaacgcagccgcuagcacacugguacacaaguucuucuuaguguuuucuaaaugggaauggccaaaucccguccugcucaagcagccugaggaauccaaccuuaaucugccagugugggauccgcgcguuaaccccucagacagauaucauuugaugccuaucaucaccccagccuacccccaacagaauagcacguauaacgugaguacuucuaccaggacagucaugguggaggaguucaaacagggucuagcaguaacugaugaaauucugcagggcaaguccgacuggagcaaacuccuggagccuccaaacuuuuuccaaaaguaccggcacuacauaguucuuaccgcuucggccucuacagaagagaaucaucuggaaugggugggguuggucgaguccaagauccgagugcucgucggaaaccuggagcgcaaugaauuuauuaccuuagcgcacgugaacccccagucauucccgggcaauaaagagcaccauaaggauaacaauuauguuaguaugugguuucuggguaucauauucagaaggguggaaaacgccgagagcguaaauauugaccuaacguacgauauccaguccuuuacugacacagucuaucggcaagcaaacaauaucaacaugcucaaagaagggaugaagauugaggcuacccacgugaaaaagaagcagcugcaucacuaccuuccugccgagaucuugcagaaaaagaaaaagcagucucugagcgauguuaaucgcucaaguggaggccuccaauccaaaagacugagccuugacucuucaugccuggacaguagcagggauacugacaacggcacacccuucaauuccccagcuucuaagucggauagcccuuccgugggggaaaccgagcguaacucagccgaacccgcagccgucauuguggagaagccauugaguguacccccugcucagggacucucuauaccagugaucggugcgaaaguugacagcacggucaagaccguguccccgcccacaguguguacuauuccuaccgucguuggccggaacgugaucccacgaaucacaacuccccauaauccugcacaggggcagccacaccugaacggaaugucaaauauuaccaaaacagugacccccaagagaagccacucuccguccauagauggcacuccuaaaagguuaaaggacguagagaaguuuauccgccuggaaaguacguucaaagauccacggacagccgaggaaagaaagaggaaaagcgucgacgcuauugguggggagucuaugcccaucccuaccauugauacuucccgcaagaaacgacuacccucaaaggaacucccagacaguagcucgccugugcccgccaacaauauccggguuaucaaaaacuccauacgucugacccuuaauagauga

SEQ ID NO: 2867 - RNA, 2211 nt, Artificial Sequence
  derived and/or modified sequence opt4 from Neo-PAP__Homo_sapiens__AAI11702
augaaggagaugagcgccaacaccgugcuggacagccagagacagcagaagcacuacggcaucaccagccccaucagccuggccagccccaaggagaucgaccacaucuacacccagaagcugaucgacgccaugaagcccuucggcguguucgaggacgaggaggagcugaaccacagacugguggugcugggcaagcugaacaaccuggugaaggaguggaucagcgacgugagcgagagcaagaaccugccccccagcgugguggccaccgugggcggcaagaucuucaccuucggcagcuacagacugggcgugcacaccaagggcgccgacaucgacgcccugugcguggcccccagacacguggagagaagcgacuucuuccagagcuucuucgagaagcugaagcaccaggacggcaucagaaaccugagagccguggaggacgccuucgugcccgugaucaaguucgaguucgacggcaucgagaucgaccugguguucgccagacuggccauccagaccaucagcgacaaccuggaccugagagacgacagcagacugagaagccuggacaucagaugcaucagaagccugaacggcugcagagugaccgacgagauccugcaccuggugcccaacaaggagaccuucagacugacccugagagccgugaagcugugggccaagagaagaggcaucuacagcaacaugcugggcuuccugggcggcgugagcugggccaugcugguggccagaaccugccagcuguaccccaacgccgccgccagcacccuggugcacaaguucuuccugguguucagcaagugggaguggcccaaccccgugcugcugaagcagcccgaggagagcaaccugaaccugcccgugugggaccccagagugaaccccagcgacagauaccaccugaugcccaucaucacccccgccuacccccagcagaacagcaccuacaacgugagcaccagcaccagaaccgugaugguggaggaguucaagcagggccuggccgugaccgacgagauccugcagggcaagagcgacuggagcaagcugcuggagccccccaacuucuuccagaaguacagacacuacaucgugcugaccgccagcgccagcaccgaggagaaccaccuggagugggugggccugguggagagcaagaucagagugcuggugggcaaccuggagagaaacgaguucaucacccuggcccacgugaacccccagagcuuccccggcaacaaggagcaccacaaggacaacaacuacgugagcaugugguuccugggcaucaucuucagaagaguggagaacgccgagagcgugaacaucgaccugaccuacgacauccagagcuucaccgacaccguguacagacaggccaacaacaucaacaugcugaaggagggcaugaagaucgaggccacccacgugaagaagaagcagcugcaccacuaccugcccgccgagauccugcagaagaagaagaagcagagccugagcgacgugaacagaagcagcggcggccugcagagcaagagacugagccuggacagcagcugccuggacagcagcagagacaccgacaacggcacccccuucaacagccccgccagcaagagcgacagccccagcgugggcgagaccgagagaaacagcgccgagcccgccgccgugaucguggagaagccccugagcgugccccccgcccagggccugagcauccccgugaucggcgccaagguggacagcaccgugaagaccgugagcccccccaccgugugcaccauccccaccguggugggcagaaacgugauccccagaaucaccaccccccacaaccccgcccagggccagccccaccugaacggcaugagcaacaucaccaagaccgugacccccaagagaagccacagccccagcaucgacggcacccccaagagacugaaggacguggagaaguucaucagacuggagagcaccuucaaggaccccagaaccgccgaggagagaaagagaaagagcguggacgccaucggcggcgagagcaugcccauccccaccaucgacaccagcagaaagaagagacugcccagcaaggagcugcccgacagcagcagccccgugcccgccaacaacaucagagugaucaagaacagcaucagacugacccugaacagauga

SEQ ID NO: 2868 - RNA, 2211 nt, Artificial Sequence
  derived and/or modified sequence opt5 from Neo-PAP__Homo_sapiens__AAI11702
augaaggagaugagcgccaacaccgugcuggacucccagagacaacagaaacacuacggcaucacaucucccauuagccucgcuuccccuaaggaaaucgaucauauuuauacgcagaaacugaucgacgccaugaagccguucggggucuuugaggaugaagaggaacuuaaucaccggcugguugugcucggaaaacugaacaaucuugugaaggaguggauuucugacgucagcgaguccaagaaccugcccccuucugugguugcgaccgugggcgggaaaaucuucacauuuggaagcuaccgccucggcguccauaccaagggggcugauaucgacgcccugugcguggcccccagacacguugaacgguccgauuucuuucagagcuucuuugagaaacugaagcaucaagacggcauucgcaaucucagagcuguggaagaugccuucgucccugugaucaaauuugaguucgacggaauugagaucgaucugguguuugcucggcuugccauucagacaaucucugacaaccuggaucuccgcgacgacuccagacugcggagccuugauauucgcuguaucagaucucugaauggcugccgggucaccgacgaaauccuccaccugguucccaacaaggagacauuccgccugacccucagagcggugaagcugugggccaaacggcgcgggauuuauuccaauaugcuuggauuucugggcggggugagcugggcuaugcucgucgccagaacgugucagcuguacccuaacgcugccgcgucuacccuugugcacaaguucuuccugguguuuuccaaaugggaauggccgaaucccguucuccugaagcagccugaggaaagcaaccugaaucuccccgucugggauccucgggugaaccccuccgacagauaucaucugaugccgaucauuaccccugccuacccccaacaaaauucuacauauaacguuagcacauccacccgcacggugauggucgaggaguucaaacagggacuugcugugacagaugaaauccugcagggcaagagcgacuggucuaaacuccuggagccucccaacuuuuuccagaaguaccggcacuacauuguccuuaccgccuccgcuagcacagaagagaaucaucuggaauggguggggcucguugagucuaagaucagagugcuggucggaaaccuggagcgcaaugaauuuaucacccucgcccacgugaacccccagagcuucccuggcaauaaagagcaccauaaggauaacaauuauguuuccaugugguuucugggcauuaucuuccggagaguggaaaacgccgagucugucaauauugaccuuaccuacgauauccagagcuuuacagacacgguguaucgccaagcuaacaauauuaacaugcugaaagaagggaugaagaucgaggcgacccacgugaaaaagaagcagcuccaucacuaccugccggccgagauccugcagaaaaagaaaaagcagucccuuagcgauguuaaucggucuuccggaggccuccaaagcaaaagacugucucuggacuccagcugccucgacuccucucgcgauacagacaacgggacccccuucaauagcccugcuuccaagucugauagccccuccgucggagaaacagagcggaacagcgccgaaccugccgcugugauuguggagaagccccugucugucccgccugcccagggccuuuccauccccgugauuggggcgaaaguugacagcaccgugaagacggucucuccucccacaguguguaccaucccuaccguugugggaagaaacgucauuccccgcaucacaaccccgcauaauccugcucagggccagccccaccugaacggcauguccaauauuacaaaaacggugacccccaagcggagccacucuccuagcaucgaugggacaccgaaaagacucaaggacguugagaaguuuauccggcuggaauccaccuucaaagauccccgcacagccgaggaaagaaagcggaaaagcguggacgccauuggaggcgagucuaugccuauccccaccauugauacguccagaaagaaacgccugccuagcaaggaacuucccgacuccucuagcccuguccccgcuaacaauauccgggugauuaaaaacuccaucagacucacccugaaucgcuga

SEQ ID NO: 2869 - protein, 458 aa, Artificial Sequence
  NFYC/m__Homo_sapiens__Q13952
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 2870 - RNA, 1377 nt, Artificial Sequence
  NFYC/m__Homo_sapiens__AAG28389
auguccacagaaggaggauuuggugguacuagcagcagugaugcccagcaaagucuacagucguucuggccucgggucauggaagaaauccggaauuuaacagugaaagacuuccgagugcaggaacucccacuggcucguauuaagaagauuaugaaacuggaugaagaugugaagaugaucagugcagaagcgccuguacucuuugccaaggcagcccagauuuuuaucacagaguugacucuucgagccuggauucacacagaagauaacaagcgccggacucuacagagaaaugauaucgccauggcaauuacaaaauuugaucaguuugauuuucucaucgauauuguuccaagagaugaacugaaaccuccaaagcgucaggaggaggugcgccagucuguaacuccugccgagccaguccaguacuauuucacgcuggcucagcaacccaccgcuguccaaguccagggccagcagcaaggccagcagaccaccagcuccacgaccaccauccagccugggcagaucaucaucgcacagccucagcagggccagaccacaccugugacaaugcagguuggagaaggucagcaggugcagauuguccaggcucagccacagggucaagcccaacaggcccagaguggcacuggacagaccaugcaggugaugcagcagaucaucacuaacacaggagagauccagcagaucccggugcagcugaaugccggccagcugcaguauauccgcuuagcccagccuguaucaggcacucaaguugugcagggacagauccagacacuugccaccaaugcucaacaggggcaaagaaaugcaagucaggggaagccucgaaggugccugaaagaaaccuuacagauuacacagacagagguccagcaaggacagcagcaguucagccaguucacagauggacagaggaacagcgugcagcaagcucgagucucugagcuaacgggagaggcagagcccagagaagugaaagccacaggaaauucaacucccugcaccucuucccugcccaccacacacccccccucacaccgggcuggugccuccugugucugcugcucccaaccccagcagagcuccacuuccccuccuccuucugacgccuugcaguggguggugguugagguaucugggacccccaaccagcucgagacccauagggagcugcaugccccucucccagggaugaccucacucucuccucuccaccccucgcagcagcucuaccagauccagcaagucaccaugccugcgggccaggaccucgcccagcccauguucauccagucagccaaccagcccuccgacgggcaggccccccaggugaccggcgacuga

SEQ ID NO: 2871 - RNA, 1377 nt, Artificial Sequence
  derived and/or modified sequence opt1 from NFYC/m__Homo_sapiens__AAG28389
augagcaccgagggcggguucggcgggaccuccagcuccgacgcccagcagagccugcaguccuucuggccccgcgugauggaggagauccggaaccucacggucaaggacuuccgcgugcaggagcugccgcuggcccggaucaagaagaucaugaagcucgacgaggacgugaagaugaucagcgccgaggcccccguccuguucgccaaggccgcccagaucuucaucaccgagcugacccuccgcgcguggauccacaccgaggacaacaagcggcgcacgcugcagcggaacgacaucgccauggccaucaccaaguucgaccaguucgacuuccugaucgacaucgugccccgcgacgagcucaagcccccgaagcggcaggaggaggugcgccaguccgucacccccgccgagcccgugcaguacuacuucacccuggcgcagcagcccacggccgugcagguccagggccagcagcaggggcagcagaccaccagcuccaccacgaccauccagccgggccagaucaucaucgcccagccccagcagggccagaccacccccgugacgaugcaggucggggagggccagcagguccagaucgugcaggcccagccccaggggcaggcccagcaggcgcagagcggcaccgggcagaccaugcaggucaugcagcagaucaucaccaacacgggcgagauccagcagaucccggugcagcugaacgccggccagcuccaguacauccggcuggcccagcccguguccgggacccagguggugcagggccagauccagacccuggccaccaacgcccagcaggggcagcgcaacgcgagccagggcaagccccggcgcugccucaaggagacgcugcagaucacccagaccgaggugcagcagggccagcagcaguucucccaguucaccgacgggcagcggaacagcgugcagcaggcccgcgucuccgagcugacgggcgaggccgagccccgggaggugaaggccaccgggaacagcaccccgugcaccuccagccuccccacgacccacccgcccucccaccgcgccggcgcgagcugcgugugcugcagccagccccagcaguccagcaccuccccgccgcccagcgacgcccugcagugggucguggucgagguguccgggacccccaaccagcuggagacgcaccgggagcuccacgcgccccugcccggcaugaccagccugagcccccuccaccccucccagcagcuguaccagauccagcaggucaccaugcccgccggccaggaccuggcccagcccauguucauccaguccgccaaccagccgagcgacgggcaggcgccccaggugaccggcgacuga

SEQ ID NO: 2872 - RNA, 1377 nt, Artificial Sequence
  derived and/or modified sequence opt2 from NFYC/m__Homo_sapiens__AAG28389
auguccaccgagggcggcuucggcggcaccuccuccuccgacgcccagcagucccuccaguccuucuggccccgcgucauggaggagauccgcaaccucaccgucaaggacuuccgcguccaggagcucccccucgcccgcaucaagaagaucaugaagcucgacgaggacgucaagaugaucuccgccgaggcccccguccucuucgccaaggccgcccagaucuucaucaccgagcucacccuccgcgccuggauccacaccgaggacaacaagcgccgcacccuccagcgcaacgacaucgccauggccaucaccaaguucgaccaguucgacuuccucaucgacaucgucccccgcgacgagcucaagccccccaagcgccaggaggagguccgccaguccgucacccccgccgagcccguccaguacuacuucacccucgcccagcagcccaccgccguccagguccagggccagcagcagggccagcagaccaccuccuccaccaccaccauccagcccggccagaucaucaucgcccagccccagcagggccagaccacccccgucaccaugcaggucggcgagggccagcagguccagaucguccaggcccagccccagggccaggcccagcaggcccaguccggcaccggccagaccaugcaggucaugcagcagaucaucaccaacaccggcgagauccagcagauccccguccagcucaacgccggccagcuccaguacauccgccucgcccagcccgucuccggcacccaggucguccagggccagauccagacccucgccaccaacgcccagcagggccagcgcaacgccucccagggcaagccccgccgcugccucaaggagacccuccagaucacccagaccgagguccagcagggccagcagcaguucucccaguucaccgacggccagcgcaacuccguccagcaggcccgcgucuccgagcucaccggcgaggccgagccccgcgaggucaaggccaccggcaacuccacccccugcaccuccucccuccccaccacccacccccccucccaccgcgccggcgccuccugcgucugcugcucccagccccagcaguccuccaccucccccccccccuccgacgcccuccagugggucgucgucgaggucuccggcacccccaaccagcucgagacccaccgcgagcuccacgccccccuccccggcaugaccucccucuccccccuccaccccucccagcagcucuaccagauccagcaggucaccaugcccgccggccaggaccucgcccagcccauguucauccaguccgccaaccagcccuccgacggccaggccccccaggucaccggcgacuga

SEQ ID NO: 2873 - RNA, 1377 nt, Artificial Sequence
  derived and/or modified sequence opt3 from NFYC/m__Homo_sapiens__AAG28389
augagcaccgagggcggguucggagguacauccucuucagacgcccagcaaagucugcagagcuuuuggcccagagugauggaagagaucaggaaccucacugucaaggauuuccggguucaggaacuuccucuggcucgcauuaaaaagauaaugaaauuggacgaggaugugaagaugaucuccgcagaagccccaguauuauuugcgaaagcugcccagauuuucaucacggagcugacccuacgagcauggauucacacagaggacaauaagcguagaacucuccaaaggaacgauaucgccauggcuauaaccaaguuugaccaguucgauuuucugaucgacauugugccgcgggaugaacuuaaacccccuaagcgccaggaggaagucagacagucugugacaccagcagagcccguucaauacuauuucacccuggcccagcagccuacugcugugcagguccaaggccagcagcaagggcagcagacaaccucgucaacgacuaccauccagccaggacaaauuaucauagcccagccccagcagggccaaacaacuccugugaccaugcagguaggugaggggcagcagguucaaauugugcaggcgcagccacagggacaagcacagcaggcccaaagcggcacaggccagaccaugcaggucaugcagcaaaucauuacgaauacuggggaaauccagcagaucccggugcaguugaacgcuggacaacuccaguacauuaggcuggcccagcccgugagugguacacaggucguucaaggccagauacagacccuggcaacuaaugcucaacaggggcagcggaacgccucccagggaaaaccucgccgaugccucaaggagacauuacaaaucacccagacggaagugcagcagggccaacagcaguuuucucaguucaccgacggucaaagaaauagcguacagcaggcgaggguguccgagcugacaggggaagccgagccacgggaggucaaagcaacuggaaacucaacccccuguacaaguagccuuccuacuacccauccacccucucaccgugcuggcgccuccugcguguguugcucacagccgcaacagagcaguacaucuccucccccauccgaugcuuugcaguggguuguggucgaagugagcggcaccccuaaucaacuggagacucaucgcgaacuacacgcaccccucccagggaugacgucgcugucuccccuucauccuucccagcagcuguaucagauucaacagguaacaaugccagccggacaggacuuggcccagccgauguuuauccaaucagcuaaccagcccagugauggucaggcgccucagguuaccggcgacuga

SEQ ID NO: 2874 - RNA, 1377 nt, Artificial Sequence
  derived and/or modified sequence opt4 from NFYC/m__Homo_sapiens__AAG28389
augagcaccgagggcggcuucggcggcaccagcagcagcgacgcccagcagagccugcagagcuucuggcccagagugauggaggagaucagaaaccugaccgugaaggacuucagagugcaggagcugccccuggccagaaucaagaagaucaugaagcuggacgaggacgugaagaugaucagcgccgaggcccccgugcuguucgccaaggccgcccagaucuucaucaccgagcugacccugagagccuggauccacaccgaggacaacaagagaagaacccugcagagaaacgacaucgccauggccaucaccaaguucgaccaguucgacuuccugaucgacaucgugcccagagacgagcugaagccccccaagagacaggaggaggugagacagagcgugacccccgccgagcccgugcaguacuacuucacccuggcccagcagcccaccgccgugcaggugcagggccagcagcagggccagcagaccaccagcagcaccaccaccauccagcccggccagaucaucaucgcccagccccagcagggccagaccacccccgugaccaugcaggugggcgagggccagcaggugcagaucgugcaggcccagccccagggccaggcccagcaggcccagagcggcaccggccagaccaugcaggugaugcagcagaucaucaccaacaccggcgagauccagcagauccccgugcagcugaacgccggccagcugcaguacaucagacuggcccagcccgugagcggcacccagguggugcagggccagauccagacccuggccaccaacgcccagcagggccagagaaacgccagccagggcaagcccagaagaugccugaaggagacccugcagaucacccagaccgaggugcagcagggccagcagcaguucagccaguucaccgacggccagagaaacagcgugcagcaggccagagugagcgagcugaccggcgaggccgagcccagagaggugaaggccaccggcaacagcacccccugcaccagcagccugcccaccacccacccccccagccacagagccggcgccagcugcgugugcugcagccagccccagcagagcagcaccagccccccccccagcgacgcccugcaguggguggugguggaggugagcggcacccccaaccagcuggagacccacagagagcugcacgccccccugcccggcaugaccagccugagcccccugcaccccagccagcagcuguaccagauccagcaggugaccaugcccgccggccaggaccuggcccagcccauguucauccagagcgccaaccagcccagcgacggccaggccccccaggugaccggcgacuga

SEQ ID NO: 2875 - RNA, 1377 nt, Artificial Sequence
  derived and/or modified sequence opt5 from NFYC/m__Homo_sapiens__AAG28389
augagcaccgagggcggguucggaggcacauccucuagcgacgcccagcaaucccugcagucuuuuuggcccagagugauggaagagauccggaaccucacggucaaggauuuccgcguucaggaacugccucuugcuagaauuaaaaagaucaugaaacuggacgaggaugugaagaugauuagcgccgaagcgccggugcucuuugcuaaagccgcccagaucuucauuaccgagcugacacuucgggcuuggauccacaccgaggacaauaagcgcagaacacugcaacggaacgauaucgccauggcuauuaccaaguuugaccaguucgauuuucucaucgacauugucccccgcgaugaacugaaaccucccaagagacaggaggaagugcggcaguccguuacgccugccgagcccgugcaauacuauuucacccuggcgcagcagccuacggccguccaggugcaagggcagcagcaaggacagcagaccacaucuagcaccacaaccauccagccgggccaaauuaucauugcucagccccagcaggggcaaacgacaccuguuaccaugcaagugggagagggccagcagguccagaucgugcaggcccagccccagggccaagcucagcaggcccaauccgggacaggacagaccaugcaagugaugcagcagaucauuaccaauacaggcgaaauccagcagauuccuguccagcucaacgcggggcaacugcaguacauccgccuugcccagcccguuagcggaacacagguggugcaaggccagauucagacccuggcuacaaaugcccaacaggggcagagaaacgcuucucagggaaaaccgcggcgcugccucaaggagacccugcaaaucacacagaccgaaguccagcagggccaacagcaguuuucccaguucacggacggccaaagaaauagcgugcagcaggcccggguuucugagcuuacaggggaagccgagccucgcgaggugaaagcuaccggaaacuccacccccuguacaagcucucugccuaccacacauccucccucccacagagcgggcgccagcugcgucuguugcucccagccccaacagucuagcacguccccgcccccuagcgaugcucuccagugggugguuguggaagucucugggacccccaaucaacuggagacacaucgggaacugcacgccccucuccccggaaugaccucccugagcccgcuucauccuucucagcagcuguaucagauccaacaggugacaaugcccgccggccaggaccucgcucagccuauguuuauucaaagcgccaaccagcccuccgaugggcaggcgccucaggucaccggagacuga

SEQ ID NO: 2876 - protein, 933 aa, Artificial Sequence
  NGEP__Homo_sapiens__Q6IWH7
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIADFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEHVVFSVGRLLDLLVPDIPESVEIKVKREYYLAKQALAENEVLFGTNGTKDEQPEGSELSSHWTPFTVPKASQLQQ

SEQ ID NO: 2877 - RNA, 2802 nt, Artificial Sequence
  NGEP__Homo_sapiens__CCDS33423.1
augcgaauggcugccacugccugggcggggcuccaagggccaccccuccccacccucugucccgcagugaggacgggacucuacugccgagaccaggcucacgcugagaggugggccaugaccuccgagaccucuuccggaagccacugugccaggagcaggaugcugcggcgacgggcccaggaagaggacagcaccguccugaucgaugugagccccccugaggcagagaagaggggcucuuacgggagcacagcccacgccucggagccagguggacagcaagcggccgccugcagagcugggaguccugccaagccccggaucgcagacuucguccucguuugggaggaggaccugaagcuagacaggcagcaggacagugccgcccgggacagaacagacaugcacaggaccuggcgggagacuuuucuggauaaucuucgugcggcugggcuguguguagaccagcaggacguccaggacgggaacaccacagugcacuacgcccuccucagcgccuccugggcugugcucugcuacuacgccgaagaccugcgccugaagcugcccuugcaggaguuacccaaccaggccuccaacuggucggccggccugcuggcauggcugggcauccccaacguccugcuggagguugugccagacguaccccccgaguacuacuccugccgguucagagugaacaagcugccacgcuuccucgggagugacaaccaggacaccuucuucacaagcaccaagaggcaccaaauucuguuugagauccuggccaagaccccguauggccacgagaagaaaaaccugcuugggauccaccagcugcuggcagaggguguccucagugccgccuucccccugcaugacggccccuucaagacgcccccagagggcccgcaggcuccacgccucaaccagcgccaaguccuuuuccagcacugggcgcgcuggggcaaguggaacaaguaccagccccuggaccacgugcgcagguacuucggggagaagguggcccucuacuucgccuggcucggguuuuacacaggcuggcuccugccagcggcaguggugggcacacugguguuccuggugggcugcuuccugguguucucagacauacccacgcaggaacuguguggcagcaaggacagcuucgagaugugcccacuuugccucgacugcccuuucuggcugcucuccagcgccugugcccuggcccaggccggccggcuguucgaccacggcggcaccguguucuucagcuuguucauggcacugugggccgugcugcugcuggaguacuggaagcggaagagcgccacgcuggccuaccgcugggacugcucugacuacgaggacacugaggagaggccucggccccaguuugccgccucagcccccaugacagccccgaaccccaucacgggugaggacgagcccuacuucccugagaggagccgcgcgcgccgcaugcuggccggcucuguggugaucguggugaugguggccgugguggucaugugccucgugucuaucauccuguaccgugccaucauggccaucgugguguccaggucgggcaacacccuucucgcagccugggccucucgcaucgccagccucacggggucuguagugaaccucgucuucauccucauccucuccaagaucuauguaucccuggcccacguccugacacgaugggaaaugcaccgcacccagaccaaguucgaggacgccuucacccucaagguguucaucuuccaguucgucaacuucuacuccucacccgucuacauugccuucuucaagggcagguuugugggauacccaggcaacuaccacaccuuguuuggaguccgcaaugaggagugcgcggcuggaggcugccugaucgagcuggcacaggagcuccuggucaucauggugggcaagcaggucaucaacaacaugcaggagguccucaucccgaagcuaaagggcugguggcagaaguuccggcuucgcuccaagaagaggaaggcgggagcuucugcaggggcuagccaggggcccugggaggacgacuaugagcuugugcccugugagggucuguuugacgaguaccuggaaauggugcugcaguucggcuucgucaccaucuucguggccgccuguccgcucgcgccgcucuucgcccugcucaacaacuggguggagauccgcuuggacgcgcgcaaguucgucugcgaguaccggcgcccgguggccgagcgcgcccaggacaucggcaucugguuccacauccuggcgggccucacgcaccuggcggucaucagcaacgccuuccuccuggccuucucguccgacuuccugccgcgcgccuacuaccgguggacccgcgcccacgaccugcgcggcuuccucaacuucacgcuggcgcgagccccguccuccuucgccgccgcgcacaaccgcacgugcagguaucgggcuuuccgggaugacgauggacauuauucccagaccuacuggaaucuucuugccauccgccuggccuucgucauuguguuugagcaugugguuuucuccguuggccgccuccuggaccuccuggugccugacaucccagagucuguggagaucaaagugaagcgggaguacuaccuggcuaagcaggcacuggcugagaaugagguucuuuuuggaacgaacggaacaaaggaugagcagcccgagggcucagagcucagcucccacuggacacccuucacgguucccaaggccagccagcugcagcaguga

SEQ ID NO: 2878 - RNA, 2802 nt, Artificial Sequence
  derived and/or modified sequence opt1 from NGEP__Homo_sapiens__CCDS33423.1
augcgcauggccgccaccgcgugggccggccugcaggggcccccgcuccccacccugugccccgccgugcggacgggccuguacugccgcgaccaggcccacgccgagcggugggcgaugaccagcgagaccuccagcgggucccacugcgcccgcagccggaugcuccgccggcgcgcccaggaggaggacuccaccguccugaucgacgugagcccgcccgaggccgagaagcggggcuccuacgggagcacggcgcacgccuccgagcccggcggccagcaggccgccgccugccgcgcggggagccccgccaagccccggaucgccgacuucgugcuggucugggaggaggaccucaagcuggaccgccagcaggacuccgccgcccgggaccgcaccgacaugcaccggaccuggcgcgagaccuuccuggacaaccuccgggcggccggccugugcguggaccagcaggacgugcaggacgggaacacgaccguccacuacgcccugcucagcgccuccugggccgugcugugcuacuacgcggaggaccugcgccucaagcugccgcugcaggagcuccccaaccaggccagcaacugguccgccggccugcuggccuggcucgggauccccaacgugcugcuggaggucgugcccgacgugccgcccgaguacuacagcugccgguuccgcgucaacaagcucccccgguuccugggcuccgacaaccaggacaccuucuucaccagcacgaagcgccaccagauccuguucgagauccucgccaagacccccuacggccacgagaagaagaaccugcuggggauccaccagcuccuggcggagggcgugcuguccgccgccuucccgcuccacgacgggcccuucaagaccccgcccgagggcccccaggcgccccgccugaaccagcgccaggugcuguuccagcacugggcccgguggggcaaguggaacaaguaccagccccucgaccacguccggcgcuacuucggggagaagguggcccuguacuucgccuggcugggcuucuacaccggguggcuccugcccgccgccguggucggcacgcugguguuccucguggggugcuuccuggucuucagcgacaucccgacccaggagcugugcggcagcaaggacuccuucgagaugugcccccucugccuggacugccccuucuggcugcucagcuccgcgugcgcccuggcccaggccggccggcuguucgaccacgggggcaccguguucuucagccuguucauggcccucugggcggugcugcugcucgaguacuggaagcgcaaguccgccacccuggccuaccggugggacugcagcgacuacgaggacacggaggagcgcccccggccgcaguucgccgccuccgcgcccaugaccgcccccaacccgaucaccggggaggacgagcccuacuuccccgagcgcagccgggcccgccggaugcuggccggcuccgucgugaucgucgugaugguggcggucguggugaugugccucgucagcaucauccuguaccgcgccaucauggccaucguggugucccggagcgggaacacccugcucgccgccugggcgucccgcaucgccagccugacgggcuccgucgugaaccugguguucauccucauccugagcaagaucuacgucucccuggcccacgugcucacccggugggagaugcaccgcacccagaccaaguucgaggacgccuucacgcugaagguguucaucuuccaguucgucaacuucuacagcucccccguguacaucgccuucuucaagggccgguucgugggguacccgggcaacuaccacacccuguucgggguccgcaacgaggagugcgcggccggcgggugccucaucgagcuggcccaggagcugcucgugaucauggugggcaagcaggucaucaacaacaugcaggaggugcugauccccaagcugaagggcugguggcagaaguuccgccuccggagcaagaagcgcaaggccggggccagcgcgggcgccucccaggggcccugggaggacgacuacgagcuggugcccugcgagggccuguucgacgaguaccucgagaugguccugcaguucggcuucgugaccaucuucguggccgccugcccgcuggcgccccucuucgcccugcugaacaacugggucgagauccggcucgacgcccgcaaguucgugugcgaguaccggcgccccguggccgagcgggcccaggacaucgggaucugguuccacauccuggcgggccugacccaccucgccgucaucagcaacgccuuccugcuggccuucuccagcgacuuccucccccgcgccuacuaccgguggacgcgcgcgcacgaccugcggggguuccugaacuucacccucgcccgcgccccguccagcuucgccgccgcgcacaaccggaccugccgcuaccgggccuuccgcgacgacgacggccacuacucccagaccuacuggaaccugcuggccauccggcucgccuucgugaucguguucgagcacgucguguucagcguggggcgccugcuggaccuccugguccccgacauccccgaguccguggagaucaaggugaagcgggaguacuaccuggccaagcaggcgcucgccgagaacgagguccuguucggcacgaacggcaccaaggacgagcagcccgaggggagcgagcuguccagccacuggaccccguucaccgugcccaaggccucccagcuccagcaguga

SEQ ID NO: 2879 - RNA, 2802 nt, Artificial Sequence
  derived and/or modified sequence opt2 from NGEP__Homo_sapiens__CCDS33423.1
augcgcauggccgccaccgccugggccggccuccagggccccccccuccccacccucugccccgccguccgcaccggccucuacugccgcgaccaggcccacgccgagcgcugggccaugaccuccgagaccuccuccggcucccacugcgcccgcucccgcaugcuccgccgccgcgcccaggaggaggacuccaccguccucaucgacgucuccccccccgaggccgagaagcgcggcuccuacggcuccaccgcccacgccuccgagcccggcggccagcaggccgccgccugccgcgccggcucccccgccaagccccgcaucgccgacuucguccucgucugggaggaggaccucaagcucgaccgccagcaggacuccgccgcccgcgaccgcaccgacaugcaccgcaccuggcgcgagaccuuccucgacaaccuccgcgccgccggccucugcgucgaccagcaggacguccaggacggcaacaccaccguccacuacgcccuccucuccgccuccugggccguccucugcuacuacgccgaggaccuccgccucaagcucccccuccaggagcuccccaaccaggccuccaacugguccgccggccuccucgccuggcucggcauccccaacguccuccucgaggucguccccgacgucccccccgaguacuacuccugccgcuuccgcgucaacaagcucccccgcuuccucggcuccgacaaccaggacaccuucuucaccuccaccaagcgccaccagauccucuucgagauccucgccaagacccccuacggccacgagaagaagaaccuccucggcauccaccagcuccucgccgagggcguccucuccgccgccuucccccuccacgacggccccuucaagaccccccccgagggcccccaggccccccgccucaaccagcgccagguccucuuccagcacugggcccgcuggggcaaguggaacaaguaccagccccucgaccacguccgccgcuacuucggcgagaaggucgcccucuacuucgccuggcucggcuucuacaccggcuggcuccuccccgccgccgucgucggcacccucgucuuccucgucggcugcuuccucgucuucuccgacauccccacccaggagcucugcggcuccaaggacuccuucgagaugugcccccucugccucgacugccccuucuggcuccucuccuccgccugcgcccucgcccaggccggccgccucuucgaccacggcggcaccgucuucuucucccucuucauggcccucugggccguccuccuccucgaguacuggaagcgcaaguccgccacccucgccuaccgcugggacugcuccgacuacgaggacaccgaggagcgcccccgcccccaguucgccgccuccgcccccaugaccgcccccaaccccaucaccggcgaggacgagcccuacuuccccgagcgcucccgcgcccgccgcaugcucgccggcuccgucgucaucgucgucauggucgccgucgucgucaugugccucgucuccaucauccucuaccgcgccaucauggccaucgucgucucccgcuccggcaacacccuccucgccgccugggccucccgcaucgccucccucaccggcuccgucgucaaccucgucuucauccucauccucuccaagaucuacgucucccucgcccacguccucacccgcugggagaugcaccgcacccagaccaaguucgaggacgccuucacccucaaggucuucaucuuccaguucgucaacuucuacuccucccccgucuacaucgccuucuucaagggccgcuucgucggcuaccccggcaacuaccacacccucuucggcguccgcaacgaggagugcgccgccggcggcugccucaucgagcucgcccaggagcuccucgucaucauggucggcaagcaggucaucaacaacaugcaggagguccucauccccaagcucaagggcugguggcagaaguuccgccuccgcuccaagaagcgcaaggccggcgccuccgccggcgccucccagggccccugggaggacgacuacgagcucguccccugcgagggccucuucgacgaguaccucgagaugguccuccaguucggcuucgucaccaucuucgucgccgccugcccccucgccccccucuucgcccuccucaacaacugggucgagauccgccucgacgcccgcaaguucgucugcgaguaccgccgccccgucgccgagcgcgcccaggacaucggcaucugguuccacauccucgccggccucacccaccucgccgucaucuccaacgccuuccuccucgccuucuccuccgacuuccucccccgcgccuacuaccgcuggacccgcgcccacgaccuccgcggcuuccucaacuucacccucgcccgcgcccccuccuccuucgccgccgcccacaaccgcaccugccgcuaccgcgccuuccgcgacgacgacggccacuacucccagaccuacuggaaccuccucgccauccgccucgccuucgucaucgucuucgagcacgucgucuucuccgucggccgccuccucgaccuccucguccccgacauccccgaguccgucgagaucaaggucaagcgcgaguacuaccucgccaagcaggcccucgccgagaacgagguccucuucggcaccaacggcaccaaggacgagcagcccgagggcuccgagcucuccucccacuggacccccuucaccguccccaaggccucccagcuccagcaguga

SEQ ID NO: 2880 - RNA, 2802 nt, Artificial Sequence
  derived and/or modified sequence opt3 from NGEP__Homo_sapiens__CCDS33423.1
augagaauggccgcuaccgcaugggccggccugcaggggcccccucucccaacacuuugcccggcggugaggacuggacuguacugucgggaccaagcucacgccgagcgcugggcaaugacgagcgaaaccuccucugguucacauugcgcccgaagucguauguugagaaggcgggcucaggaggaagauagcacagucuuaaucgacguuucacccccugaggcagaaaagcgcggcucuuaugggucgacugcccacgcuucagagccaggaggccagcaggccgcggcauguagagccgguagccccgcuaaaccuaggauugccgauuucgugcugguaugggaggaagaccuaaagcucgaucggcaacaggacagugcagcucgcgaucgaaccgacaugcauagaacauggagggagaccuuucuggauaaccuucgggccgcggggcugugcguggaccagcaggauguccaagacggaaauacuacagugcacuacgccuugcucuccgcaucuugggcuguucuguguuauuacgccgaagaucugcgucucaaauuaccacugcaggagcuucccaaccaggcuagcaauugguccgccggcuugcuggcauggcuaggcauaccuaacgugcuccuggaggucgugccagacguaccgcccgaauauuacucaugccgcuucagaguuaauaaacuuccuagguuucuggggagugacaaccaggauaccuucuuuacgagcacuaagcggcaucaaaucuuguucgagauucucgccaagaccccauauggacacgaaaagaaaaaucuguuagguauccaccagcugcucgcugagggcgugcuuucugcggcauuuccccugcaugacgggccuuucaagacaccacccgaaggaccgcaggccccucgauugaaccaacgccagguccuauuucagcacugggcuagauggggcaaauggaauaaguaccagccccuggaucaugugaggcgguacuucggugagaaaguggcccucuauuuugcauggcugggguucuacacuggauggcuucugccagccgcugucguuggcaccuugguguuucucguaggcuguuuccugguguucuccgacauuccuacacaagaguuaugcgggucaaaggauagcuuugaaauguguccccugugccuagacuguccauucuggcuccugaguucugccugcgcacuugcgcaggcuggacgcuuguuugaucacgguggcaccgucuucuuuucccuguucauggcccucugggcagugcugcuucuggaguauuggaagagaaaaagcgccacguuggcuuacaggugggacugcucggauuaugaagacacugaggaacguccccggccucaguuugccgcaucugcuccaaugacagccccgaaccccaucaccggggaggaugagccuuacuucccagaacgauccagagcgaggcgcaugcucgccggaucaguugugauagucgugaugguagcuguuguggucaugugucuggugaguaucauuuuauaucgggcaaucauggccauugucgugagcagauccggcaauacucugcuagcugccugggcaucuaggaucgcgagccucacagguucaguugugaaccugguauuuauacuuauuuugaguaagaucuacgucucccuggcccacgugcucacccgcugggagaugcaucgaacgcagaccaaauucgaagacgcuuuuacacugaagguuuucauuuuucaauucgugaauuucuacagcucucccgucuauaucgccuuuuucaaagggcgguuugugggcuacccuggaaacuaucacacuuuauucggcguacguaaugaggaaugcgcagcugggggaugucugaucgagcuugcccaggaguugcucgugauuaugguugguaagcaggucauaaacaacaugcaggaagugcugaucccaaaacuaaagggcugguggcaaaaguuuagacugagguccaaaaagcgcaaagcaggggccagugcuggagcgagccagggccccugggaggacgauuacgaacucgugccgugcgagggucuguucgacgaguaucuugaaauggucuugcaguuuggguucguuaccauuuuuguggccgcauguccucuggcuccauuauucgcccuccugaauaacuggguggagauccggcuugaugccagaaaguuuguaugcgaauacaggcgacccgucgcugagcgcgcacaggacauaggcauuugguuccauauccuggccggauugacacaccucgcggugaucuccaaugcuuuucugcuagccuucucuucggauuuccugccucgggcauauuacagauggacuagggcccaugaccuccguggcuuucugaacuucacccuugcucgcgcacccagcuccuuugccgcggcucacaaucggacauguagauacagggccuuccgagaugacgaugggcacuauucacaaaccuacuggaacuugcuggcaauucgguuagccuuuguuaucguguucgaacaugucguguuuaguguuggacgccuccuggaccuucuggugccagauauuccugagucuguagagauaaaagucaagagagaauauuaccuagcuaagcaggcccucgcagagaaugaagugcuguucgguacuaacggcacgaaagacgagcagcccgaagggagcgaguuguccucacacuggacaccauuuaccgugccgaaggcuagccaacugcagcaguga

SEQ ID NO: 2881 - RNA, 2802 nt, Artificial Sequence
  derived and/or modified sequence opt4 from NGEP__Homo_sapiens__CCDS33423.1
augagaauggccgccaccgccugggccggccugcagggccccccccugcccacccugugccccgccgugagaaccggccuguacugcagagaccaggcccacgccgagagaugggccaugaccagcgagaccagcagcggcagccacugcgccagaagcagaaugcugagaagaagagcccaggaggaggacagcaccgugcugaucgacgugagcccccccgaggccgagaagagaggcagcuacggcagcaccgcccacgccagcgagcccggcggccagcaggccgccgccugcagagccggcagccccgccaagcccagaaucgccgacuucgugcuggugugggaggaggaccugaagcuggacagacagcaggacagcgccgccagagacagaaccgacaugcacagaaccuggagagagaccuuccuggacaaccugagagccgccggccugugcguggaccagcaggacgugcaggacggcaacaccaccgugcacuacgcccugcugagcgccagcugggccgugcugugcuacuacgccgaggaccugagacugaagcugccccugcaggagcugcccaaccaggccagcaacuggagcgccggccugcuggccuggcugggcauccccaacgugcugcuggagguggugcccgacgugccccccgaguacuacagcugcagauucagagugaacaagcugcccagauuccugggcagcgacaaccaggacaccuucuucaccagcaccaagagacaccagauccuguucgagauccuggccaagacccccuacggccacgagaagaagaaccugcugggcauccaccagcugcuggccgagggcgugcugagcgccgccuucccccugcacgacggccccuucaagaccccccccgagggcccccaggcccccagacugaaccagagacaggugcuguuccagcacugggccagauggggcaaguggaacaaguaccagccccuggaccacgugagaagauacuucggcgagaagguggcccuguacuucgccuggcugggcuucuacaccggcuggcugcugcccgccgccguggugggcacccugguguuccuggugggcugcuuccugguguucagcgacauccccacccaggagcugugcggcagcaaggacagcuucgagaugugcccccugugccuggacugccccuucuggcugcugagcagcgccugcgcccuggcccaggccggcagacuguucgaccacggcggcaccguguucuucagccuguucauggcccugugggccgugcugcugcuggaguacuggaagagaaagagcgccacccuggccuacagaugggacugcagcgacuacgaggacaccgaggagagacccagaccccaguucgccgccagcgcccccaugaccgcccccaaccccaucaccggcgaggacgagcccuacuuccccgagagaagcagagccagaagaaugcuggccggcagcguggugaucguggugaugguggccgugguggugaugugccuggugagcaucauccuguacagagccaucauggccaucguggugagcagaagcggcaacacccugcuggccgccugggccagcagaaucgccagccugaccggcagcguggugaaccugguguucauccugauccugagcaagaucuacgugagccuggcccacgugcugaccagaugggagaugcacagaacccagaccaaguucgaggacgccuucacccugaagguguucaucuuccaguucgugaacuucuacagcagccccguguacaucgccuucuucaagggcagauucgugggcuaccccggcaacuaccacacccuguucggcgugagaaacgaggagugcgccgccggcggcugccugaucgagcuggcccaggagcugcuggugaucauggugggcaagcaggugaucaacaacaugcaggaggugcugauccccaagcugaagggcugguggcagaaguucagacugagaagcaagaagagaaaggccggcgccagcgccggcgccagccagggccccugggaggacgacuacgagcuggugcccugcgagggccuguucgacgaguaccuggagauggugcugcaguucggcuucgugaccaucuucguggccgccugcccccuggccccccuguucgcccugcugaacaacuggguggagaucagacuggacgccagaaaguucgugugcgaguacagaagacccguggccgagagagcccaggacaucggcaucugguuccacauccuggccggccugacccaccuggccgugaucagcaacgccuuccugcuggccuucagcagcgacuuccugcccagagccuacuacagauggaccagagcccacgaccugagaggcuuccugaacuucacccuggccagagcccccagcagcuucgccgccgcccacaacagaaccugcagauacagagccuucagagacgacgacggccacuacagccagaccuacuggaaccugcuggccaucagacuggccuucgugaucguguucgagcacgugguguucagcgugggcagacugcuggaccugcuggugcccgacauccccgagagcguggagaucaaggugaagagagaguacuaccuggccaagcaggcccuggccgagaacgaggugcuguucggcaccaacggcaccaaggacgagcagcccgagggcagcgagcugagcagccacuggacccccuucaccgugcccaaggccagccagcugcagcaguga

SEQ ID NO: 2882 - RNA, 2802 nt, Artificial Sequence
  derived and/or modified sequence opt5 from NGEP__Homo_sapiens__CCDS33423.1
augagaauggccgcuaccgccugggcgggccugcaggggcccccucucccgacacugugccccgcugugcggacgggacuuuacugucgcgaccaagcccacgccgagagaugggcuaugaccagcgaaacauccucuggcagccauugcgcccggucccgcaugcugagacggcgcgcucaggaggaagauucuaccguccucaucgacguuagcccucccgaggccgaaaagagaggguccuauggaucuacagcgcacgccagcgagccuggcgggcagcaggcugccgcuugucgggccggaucccccgcgaaaccucgcauugccgauuucgugcuggugugggaggaagaccuuaagcuggauagacaacaggacagcgcugcccgggaucgcaccgacaugcauagaacauggcgggagaccuuucucgauaaccugcgcgcugccggccugugcgucgaccagcaggaugugcaagacggcaauacgaccguucacuacgcccuccugucugcuuccugggcggugcuuuguuauuacgccgaagaucugagacucaaacugccgcuucaggagcugcccaaccaggcuagcaauuggucugccgggcuccuggccuggcugggaaucccuaacguccuccuggaggugguucccgacgugccucccgaauauuacuccugccgguucagagucaauaaacuuccgcgcuuucugggcagcgacaaccaggauacauucuuuaccucuacaaagcggcaucaaauucucuucgagauccuggcuaagaccccuuaugggcacgaaaagaaaaaucuucugggcauucaccagcuccuggccgagggagugcuguccgcggcuuuuccccuccaugacgggccuuucaagacgccucccgaaggaccccaggccccgagacugaaccaacgccaggugcuuuuucagcacugggcccgguggggcaaauggaauaaguaccagccccuggaucaugucagacgcuacuucggcgagaaaguugcucucuauuuugccuggcugggguucuacacaggauggcuucugccugcugccguggugggcacccucgucuuucuggugggguguuuccugguuuucagcgacauccccacacaagagcucugcggauccaaggauucuuuugaaauguguccucugugccuugacugucccuucuggcugcucagcuccgcgugcgcccuggcucaggccggccggcuguuugaucacgggggaaccguguucuuuagccuuuucauggcucucugggccguccugcugcucgaguauuggaagagaaaaucugcgacccuggccuaccgcugggacugcuccgauuaugaagacacagaggaacggccgagaccucaguuugcugccagcgcucccaugacggccccuaaccccaucaccggcgaggaugagccuuacuuccccgaacgcucucgggccagacggaugcuugcuggcagcgugguuauuguggucaugguggcggucgugguuaugugucugguguccaucauucucuaucgcgccaucauggcuauugucgugucuagaagcgggaauacacugcuggccgccugggcuucccggaucgccagccuuaccggaucuguugugaaccucgucuuuauucugauccuguccaagaucuacgugagccucgcgcacgugcugacaagaugggagaugcaucgcacccagacgaaauucgaagacgcuuuuacacuuaagguuuucauuuuucaauucgucaauuucuacucuuccccgguguauaucgccuuuuucaaaggccgguuugugggguacccuggaaacuaucacacccuguucggcgucagaaaugaggaaugcgccgcugggggcugucucauugagcuggcccaggagcugcuugugaucaugguuggaaagcagguuauuaacaacaugcaggaaguccucauccccaaacugaagggcugguggcaaaaguuucgccugagaagcaaaaagcggaaagcgggggcuuccgccggagccucucagggccccugggaggacgauuacgaacucgugccuugcgaggggcuguucgacgaguaucuugaaaugguucugcaguuuggauucgugaccaucuuugucgcugccuguccgcucgcuccccuguucgcccugcuuaauaacuggguggagauucgccucgaugcgagaaaguuuguuugcgaauaccggcgcccuguggccgagagagcucaggacaucggcauuugguuccauauccuggccgggcugacacaccucgcugucauuagcaaugccuuucugcuugccuucuccucugauuuccugccccgggcuuauuaccgcuggaccagagcgcaugaccuccggggcuuucugaacuucacacuggcccgcgcuccuagcuccuuugccgccgcucacaauagaacgugucgguacagagccuuccgcgaugacgauggacacuauagccaaaccuacuggaaccuucuggcgauccggcucgcuuuugugaucguguucgaacaugucguguuuucugugggcagacugcucgaccugcuugugcccgauauuccugaguccgucgagaucaaagugaagcgcgaauauuaccuggccaagcaggcccucgcugagaaugaaguucuguucgggacaaacggaaccaaagacgagcagcccgaaggcagcgagcugucuucccacuggacaccguuuaccgugccuaaggccagccaacuucagcaguga

SEQ ID NO: 2883 - protein, 294 aa, Artificial Sequence
  NPM__Homo_sapiens__P06748
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKSIRDTPAKNAQKSNQNGKDSKPSSTPRSKGQESFKKQEKTPKTPKGPSSVEDIKAKMQASIEKGGSLPKVEAKFINYVKNCFRMTDQEAIQDLWQWRKSL

SEQ ID NO: 2884 - RNA, 885 nt, Artificial Sequence
  NPM__Homo_sapiens__AAA36380
auggaagauucgauggacauggacaugagcccccugaggccccagaacuaucuuuucgguugugaacuaaaggccgacaaagauuaucacuuuaagguggauaaugaugaaaaugagcaccaguuaucuuuaagaacggucaguuuaggggcuggugcaaaggaugaguugcacauuguugaagcagaggcaaugaauuacgaaggcaguccaauuaaaguaacacuggcaacuuugaaaaugucuguacagccaacgguuucccuugggggcuuugaaauaacaccaccaguggucuuaagguugaagugugguucagggccagugcauauuaguggacagcacuuaguagcuguggaggaagaugcagagucagaagaugaagaggaggaggaugugaaacucuuaaguauaucuggaaagcggucugccccuggaggugguagcaagguuccacagaaaaaaguaaaacuugcugcugaugaagaugaugacgaugaugaugaagaggaugaugaugaagaugaugaugaugaugauuuugaugaugaggaagcugaagaaaaagcgccagugaagaaaucuauacgagauacuccagccaaaaaugcacaaaagucaaaucagaauggaaaagacucaaaaccaucaucaacaccaagaucaaaaggacaagaauccuucaagaaacaggaaaaaacuccuaaaacaccaaaaggaccuaguucuguagaagacauuaaagcaaaaaugcaagcaaguauagaaaaaggugguucucuucccaaaguggaagccaaauucaucaauuaugugaagaauugcuuccggaugacugaccaagaggcuauucaagaucucuggcaguggaggaagucucuuuaa

SEQ ID NO: 2885 - RNA, 885 nt, Artificial Sequence
  derived and/or modified sequence opt1 from NPM__Homo_sapiens__AAA36380
auggaggacagcauggacauggacaugagcccccugcggccgcagaacuaccucuucggcugcgagcugaaggccgacaaggacuaccacuucaagguggacaacgacgagaacgagcaccagcugagccuccggaccgucucccugggggccggcgcgaaggacgagcugcacaucguggaggccgaggccaugaacuacgaggggagccccaucaaggugacccucgccacgcugaagauguccguccagcccaccgugagccugggcggguucgagaucaccccgcccgugguccuccgccugaagugcggcuccggccccgugcacaucagcgggcagcaccugguggccgucgaggaggacgcggaguccgaggacgaggaggaggaggacgugaagcuccugagcaucuccggcaagcggagcgcccccgggggcggguccaaggugccccagaagaaggucaagcuggccgccgacgaggacgacgacgacgacgacgaggaggacgacgacgaggacgacgacgacgacgacuucgacgacgaggaggcggaggagaaggccccggugaagaaguccauccgcgacacccccgccaagaacgcccagaaguccaaccagaacggcaaggacagcaagcccuccagcacgccccgguccaagggccaggagagcuucaagaagcaggagaagaccccgaagacccccaaggggcccagcuccguggaggacaucaaggccaagaugcaggcgagcaucgagaagggcgggucccuccccaaggucgaggccaaguucaucaacuacgugaagaacugcuuccgcaugaccgaccaggaggccauccaggaccuguggcaguggcgcaagagccuguga

SEQ ID NO: 2886 - RNA, 885 nt, Artificial Sequence
  derived and/or modified sequence opt2 from NPM__Homo_sapiens__AAA36380
auggaggacuccauggacauggacauguccccccuccgcccccagaacuaccucuucggcugcgagcucaaggccgacaaggacuaccacuucaaggucgacaacgacgagaacgagcaccagcucucccuccgcaccgucucccucggcgccggcgccaaggacgagcuccacaucgucgaggccgaggccaugaacuacgagggcucccccaucaaggucacccucgccacccucaagauguccguccagcccaccgucucccucggcggcuucgagaucaccccccccgucguccuccgccucaagugcggcuccggccccguccacaucuccggccagcaccucgucgccgucgaggaggacgccgaguccgaggacgaggaggaggaggacgucaagcuccucuccaucuccggcaagcgcuccgcccccggcggcggcuccaaggucccccagaagaaggucaagcucgccgccgacgaggacgacgacgacgacgacgaggaggacgacgacgaggacgacgacgacgacgacuucgacgacgaggaggccgaggagaaggcccccgucaagaaguccauccgcgacacccccgccaagaacgcccagaaguccaaccagaacggcaaggacuccaagcccuccuccaccccccgcuccaagggccaggaguccuucaagaagcaggagaagacccccaagacccccaagggccccuccuccgucgaggacaucaaggccaagaugcaggccuccaucgagaagggcggcucccuccccaaggucgaggccaaguucaucaacuacgucaagaacugcuuccgcaugaccgaccaggaggccauccaggaccucuggcaguggcgcaagucccucuga

SEQ ID NO: 2887 - RNA, 885 nt, Artificial Sequence
  derived and/or modified sequence opt3 from NPM__Homo_sapiens__AAA36380
auggaggacagcauggauauggacaugucuccccugagaccucagaacuaccucuucggcugcgaacuuaaggccgauaaagacuaucacuuuaagguggauaaugacgagaacgaacaucaacuguccuugaggaccgucucauuaggggcuggagcaaaagaugagcugcacaucguugaagccgaggcgaugaauuacgaggguaguccaauuaaggugacacuagcuacucucaaaaugagcguacagccgacggugucccugggcggguucgaaauaacacccccugucgugcuucggcugaaguguggaucuggcccaguucauaucucgggucagcacuugguggccgucgaggaagacgcagagucagaggaugaagaggaagaggacgugaagcuccugagcauuagugggaaacgcuccgcccccggaggcggcucuaagguaccucagaaaaagguuaaacuggcugcagaugaagacgaugacgacgaugacgaggaggaugacgaugaagacgaugacgaugacgauuuugacgacgaggaagccgaggaaaaggcuccagugaagaaaagcauccgagauacccccgccaagaacgcgcaaaaauccaaucagaacgggaaggacucaaaaccuaguagcacuccacguucuaagggacaggaguccuucaaaaagcaggagaagaccccgaaaacacccaaggguccuucaagcgucgaagauauuaaagcaaagaugcaagccaguaucgagaaaggcgggucucucccaaagguggaagcuaaguuuauaaauuaugugaaaaacugcuucagaaugaccgaccaggaggccauccaggauuuauggcaguggaggaagucccuguga

SEQ ID NO: 2888 - RNA, 885 nt, Artificial Sequence
  derived and/or modified sequence opt4 from NPM__Homo_sapiens__AAA36380
auggaggacagcauggacauggacaugagcccccugagaccccagaacuaccuguucggcugcgagcugaaggccgacaaggacuaccacuucaagguggacaacgacgagaacgagcaccagcugagccugagaaccgugagccugggcgccggcgccaaggacgagcugcacaucguggaggccgaggccaugaacuacgagggcagccccaucaaggugacccuggccacccugaagaugagcgugcagcccaccgugagccugggcggcuucgagaucaccccccccguggugcugagacugaagugcggcagcggccccgugcacaucagcggccagcaccugguggccguggaggaggacgccgagagcgaggacgaggaggaggaggacgugaagcugcugagcaucagcggcaagagaagcgcccccggcggcggcagcaaggugccccagaagaaggugaagcuggccgccgacgaggacgacgacgacgacgacgaggaggacgacgacgaggacgacgacgacgacgacuucgacgacgaggaggccgaggagaaggcccccgugaagaagagcaucagagacacccccgccaagaacgcccagaagagcaaccagaacggcaaggacagcaagcccagcagcacccccagaagcaagggccaggagagcuucaagaagcaggagaagacccccaagacccccaagggccccagcagcguggaggacaucaaggccaagaugcaggccagcaucgagaagggcggcagccugcccaagguggaggccaaguucaucaacuacgugaagaacugcuucagaaugaccgaccaggaggccauccaggaccuguggcaguggagaaagagccuguga

SEQ ID NO: 2889 - RNA, 885 nt, Artificial Sequence
  derived and/or modified sequence opt5 from NPM__Homo_sapiens__AAA36380
auggaggacagcauggauauggacaugagcccccugagaccucagaacuaccucuucggcugcgaacugaaggccgauaaagacuaucacuuuaagguggauaaugacgagaacgaacaucaacuuucucugcggaccgucagccucggggcuggagccaaagaugagcugcacaucguugaagcggaggcuaugaauuacgagggcuccccgauuaaggugacacuugccacgcugaaaaugucugugcagcccaccgucagccucgggggauucgaaaucacaccucccgugguucugcgccugaaguguggcuccgggccugugcauauuucuggacagcaccucgucgccguggaggaagacgcugagagcgaggaugaagaggaagaggacguuaagcugcuuuccaucagcggcaaaagaucugcccccggcgggggauccaaggugccucagaaaaaggucaaacuggcugccgaugaagacgaugacgacgaugacgaggaggaugacgaugaagacgaugacgaugacgauuuugacgacgaggaagcggaggaaaaggccccggugaagaaaagcauucgggauacccccgcuaagaacgcccaaaaaucuaaucagaacggcaaggacuccaaaccuagcucuacaccccgcuccaaggggcaggagagcuucaaaaagcaggagaagaccccuaaaacacccaagggaccguccucuguggaagauaucaaagcuaagaugcaagccagcaucgagaaaggcgggucccucccuaaggucgaagcgaaguuuauuaauuauguuaaaaacugcuucagaaugaccgaccaggaggccauccaggaucuguggcaguggcggaagucccuuuga

SEQ ID NO: 2890 - protein, 1304 aa, Artificial Sequence
  NRCAM__Homo_sapiens__Q92823
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 2891 - RNA, 3915 nt, Artificial Sequence
  NRCAM__Homo_sapiens__CCDS47686.1
augcagcuuaaaauaaugccgaaaaagaagcgcuuaucugcgggcagagugccccugauucucuuccugugccagaugauuagugcacuggaaguaccucuugauccaaaacuucuugaagacuugguacagccuccaaccaucacccaacagucuccaaaagauuacauuauugacccucgggagaauauuguaauccagugugaagccaaagggaaaccgcccccaagcuuuuccuggacccguaaugggacucauuuugacaucgauaaagacccucuggucaccaugaagccuggcacaggaacgcucauaauuaacaucaugagcgaagggaaagcugagaccuaugaaggagucuaucaguguacagcaaggaacgaacgcggagcugcaguuucuaauaacauuguuguccgcccauccagaucaccauuguggaccaaagaaaaacuugaaccaaucacacuucaaaguggucagucuuuaguacuucccugcagacccccaauuggauuaccaccaccuauaauauuuuggauggauaauuccuuucaaagacuuccacaaagugagagaguuucucaagguuugaauggggaccuuuauuuuuccaauguccucccagaggacacccgcgaagacuauaucuguuaugcuagauuuaaucauacucaaaccauacagcagaagcaaccuauuucugugaaggugauuucaguggaugaauugaaugacacuauagcugcuaauuugagugacacugaguuuuauggugcuaaaucaaguagagagaggccaccaacauuuuuaacuccagaaggcaaugcaaguaacaaagaggaauuaagaggaaaugugcuuucacuggagugcauugcagaaggacugccuaccccaauuauuuacugggcaaaggaagauggaaugcuacccaaaaacaggacaguuuauaagaacuuugagaaaaccuugcagaucauucauguuucagaagcagacucuggaaauuaccaauguauagcaaaaaacgcauuaggagccauccaccauaccauuucuguuagaguuaaagcggcuccauacuggaucacagccccucaaaaucuugugcuguccccaggagaggaugggaccuugaucugcagagcuaauggcaaccccaaacccagaauuagcugguuaacaaauggagucccaauagaaauugccccugaugaccccagcagaaaaauagauggcgauaccauuauuuuuucaaauguucaagaaagaucaagugcagucuaucagugcaaugccucuaaugaauauggauauuuacuggcaaacgcauuuguaaaugugcuggcugagccaccacgaauccucacaccugcaaacacacucuaccaggucauugcaaacaggccugcuuuacuagacugugccuucuuugggucuccucucccaaccaucgagugguuuaaaggagcuaaaggaagugcucuucaugaagauauuuauguuuuacaugaaaauggaacuuuggaaauuccuguggcccaaaaggacaguacaggaacuuauacguguguugcaaggaauaaauuagggauggcgaagaaugaaguucacuuagaaaucaaagauccuacauggaucguuaaacagcccgaauaugcaguugugcaaagagggagcaugguguccuuugaaugcaaagugaaacaugaucacaccuuaucccucacuguccuguggcugaaggacaacagggaacugcccagugaugaaagguucacuguugacaaggaucaucuagugguagcugaugucagugacgaugacagcgggaccuacacguguguggccaacaccacucuggacagcgucuccgccagcgcugugcuuagcguuguugcuccuacuccaacuccagcucccguuuacgaugucccaaauccucccuuugacuuagaacugacagaucaacuugacaaaaguguucagcugucauggaccccaggcgaugacaacaauagccccauuacaaaauucaucaucgaauaugaagaugcaaugcacaagccagggcuguggcaccaccaaacugaaguuucuggaacacagaccacagcccagcugaagcugucuccuuacgugaacuacuccuuccgcgugauggcagugaacagcauugggaagagcuugcccagcgaggcgucugagcaguauuugacgaaagccucagaaccagauaaaaaccccacagcuguggaaggacugggaucagagccugauaauuuggugauuacguggaagcccuugaaugguuucgaaucuaaugggccaggccuucaguacaaaguuagcuggcgccagaaagauggugaugaugaauggacaucugugguuguggcaaauguauccaaauauauugucucaggcacgccaaccuuuguuccauaccugaucaaaguucaggcccugaaugacaugggguuugcccccgagccagcuguagucaugggacauucuggagaagaccucccaaugguggcuccugggaacgugcgugugaauguggugaacaguaccuuagccgaggugcacugggacccaguaccucugaaaagcauccgaggacaccuacaaggcuaucggauuuacuauuggaagacccagaguucaucuaaaagaaacagacgucacauugagaaaaagauccucaccuuccaaggcagcaagacucauggcauguugccggggcuagagcccuuuagccacuacacacugaauguccgaguggucaaugggaaaggggagggcccagccagcccugacagagucuuuaauacuccagaaggaguccccagugcucccucgucuuugaagauugugaauccaacacuggacucucucacuuuggaaugggauccaccgagccacccgaauggcauuuugacagaguacaccuuaaaguaucagccaauuaacagcacacaugaauuaggcccucugguagauuugaaaauuccugccaacaagacacgguggacuuuaaaaaauuuaaauuucagcacucgauauaaguuuuauuucuaugcacaaacaucagcaggaucaggaagucaaauuacagaggaagcaguaacaacuguggaugaagcugguauucuuccaccugauguaggugcaggcaaaguucaagcaguaaaucccaggaucagcaaucuuacugcugcagcugcugagaccuaugccaauaucaguugggaauaugagggaccagagcaugugaacuuuuauguugaauaugguguagcaggcagcaaagaagaauggagaaaagaaauuguaaaugguucucggagcuucuuuggguuaaagggucuaaugccaggaacagcauacaaaguucgaguuggugcugugggggacucugguuuugugaguucagaggauguguuugagacaggcccagcgauggcaagccggcagguggauauugcaacucagggcugguucauuggucugaugugugcuguugcucuccuuaucuuaauuuugcugauuguuugcuucaucagaagaaacaagggugguaaauauccaguuaaagaaaaggaagaugcccaugcugacccugaaauccagccuaugaaggaagaugaugggacauuuggagaauacagugaugcagaagaccacaagccuuugaaaaaaggaagucgaacuccuucagacaggacugugaaaaaagaagauagugacgacagccuaguugacuauggagaagggguuaauggccaguucaaugaggauggcuccuuuauuggacaauacagugguaagaaagagaaagagccggcugaaggaaacgaaagcucagaggcaccuucuccugucaacgccaugaauuccuuuguuuaa

SEQ ID NO: 2892 - RNA, 3915 nt, Artificial Sequence
  derived and/or modified sequence opt1 from NRCAM__Homo_sapiens__CCDS47686.1
augcagcugaagaucaugcccaagaagaagcgccucagcgccggccgggugccgcugauccuguuccucugccagaugaucuccgcccuggaggucccccuggaccccaagcuccuggaggaccuggugcagcccccgaccaucacccagcagagccccaaggacuacaucaucgacccccgcgagaacaucgugauccagugcgaggcgaaggggaagcccccgcccuccuucagcuggacgcggaacggcacccacuucgacaucgacaaggacccccucgucaccaugaagcccgggaccggcacgcugaucaucaacaucauguccgaggggaaggccgagaccuacgagggcguguaccagugcaccgcccgcaacgagcggggcgccgccgugagcaacaacaucgucgugcgcccgucccggagcccccuguggaccaaggagaagcucgagcccaucacgcugcaguccgggcagagccuggugcuccccugccgcccgcccaucggccugcccccgcccaucaucuucuggauggacaacuccuuccagcggcugccccagagcgagcgcgucucccaggggcucaacggcgaccuguacuucagcaacgugcugcccgaggacacccgggaggacuacaucugcuacgcgcgcuucaaccacacccagaccauccagcagaagcagcccaucuccgugaaggucaucagcguggacgagcucaacgacacgaucgccgccaaccuguccgacaccgaguucuacggggccaagagcucccgggagcgcccgcccaccuuccugacccccgagggcaacgcgagcaacaaggaggagcuccggggcaacgugcugagccuggagugcaucgccgaggggcuccccacgccgaucaucuacugggccaaggaggacggcaugcugcccaagaaccgcaccgucuacaagaacuucgagaagacccugcagaucauccacguguccgaggccgacagcgggaacuaccagugcaucgccaagaacgcgcucggcgccauccaccacaccaucuccgugcgggucaaggccgcccccuacuggaucacggccccgcagaaccuggugcugagccccggcgaggacgggacccucaucugccgcgcgaacggcaaccccaagccccggaucuccuggcugaccaacggggugccgaucgagaucgcccccgacgaccccagccgcaagaucgacggcgacaccaucaucuucuccaacguccaggagcggagcuccgccguguaccagugcaacgccagcaacgaguacggguaccugcucgccaacgcguucgugaacguccuggccgagcccccgcgcauccugacgcccgccaacacccucuaccaggugaucgccaaccgccccgcccugcuggacugcgcguucuucggcagcccccucccgaccaucgagugguucaagggcgccaaggggagcgcccugcacgaggacaucuacguccugcacgagaacggcacccucgagauccccguggcccagaaggacuccacggggaccuacacgugcguggcgcggaacaagcugggcauggccaagaacgagguccaccuggagaucaaggaccccaccuggaucgugaagcagcccgaguacgccgugguccagcgcgggagcaugguguccuucgagugcaaggugaagcacgaccacacccucagccugaccguccuguggcugaaggacaaccgggagcucccguccgacgagcgcuucaccguggacaaggaccaccugguggucgccgacgugagcgacgacgacuccggcaccuacacgugcguggccaacaccacccuggacagcgucagcgcguccgccgugcucagcguggucgcccccacccccacccccgccccgguguacgacgugcccaacccgcccuucgaccuggagcugacggaccagcucgacaaguccguccagcugagcuggacccccggcgacgacaacaacucccccaucaccaaguucaucaucgaguacgaggacgccaugcacaagcccgggcuguggcaccaccagaccgaggugagcggcacgcagaccaccgcgcagcucaagcuguccccguacgugaacuacagcuuccgggucauggccgugaacuccaucgggaagucccugcccuccgaggccagcgagcaguaccucaccaaggccuccgagcccgacaagaaccccacggccguggagggccuggggagcgagccggacaaccuggucaucaccuggaagccccucaacggcuucgaguccaacggccccgggcugcaguacaaggugagcuggcgccagaaggacggcgacgacgaguggaccuccguggucguggcgaacgugagcaaguacaucgucagcgggacccccacguucgugccguaccugaucaaggugcaggcccucaacgacaugggcuucgcccccgagcccgccgucgugaugggccacuccggggaggaccugcccaugguggcgccgggcaacguccgggugaacguggucaacagcacccuggccgaggugcacugggaccccgugccccucaaguccauccgcgggcaccuccagggcuaccggaucuacuacuggaagacccagagcuccagcaagcgcaaccggcgccacaucgagaagaagauccugaccuuccagggguccaagacgcacggcaugcugcccggccuggagccguucagccacuacacccugaacguccggguggugaacgggaagggcgaggggcccgccucccccgaccgcgucuucaacacccccgagggcgugccgagcgcccccuccagccucaagaucgugaaccccacccuggacucccugacgcucgagugggacccgcccagccaccccaacgggauccugaccgaguacacccugaaguaccagcccaucaacuccacccacgagcucggcccccuggucgaccugaagaucccggccaacaagacgcgguggacccucaagaaccugaacuucagcacccgcuacaaguucuacuucuacgcgcagaccuccgccggcagcgggucccagaucacggaggaggccgugaccaccgucgacgaggccggcauccugccgcccgacgugggggccggcaaggugcaggcggucaacccccggaucagcaaccucaccgccgccgccgccgagacguacgcgaacaucagcugggaguacgaggggcccgagcacgugaacuucuacguggaguacggcgucgccggcuccaaggaggaguggcgcaaggagaucgugaacgggagccgguccuucuucggccugaaggggcugaugcccggcaccgccuacaaggugcgcgucggggccgugggcgacagcggcuucguguccagcgaggacgucuucgagaccgggcccgcgauggccucccgccagguggacaucgccacccagggcugguucaucgggcucaugugcgccguggcccugcugauccucauccugcugaucgucugcuucauccggcgcaacaagggcggcaaguacccggugaaggagaaggaggacgcgcacgccgaccccgagauccagcccaugaaggaggacgacgggacguucggcgaguacagcgacgccgaggaccacaagccccucaagaaggggucccggaccccgagcgaccgcaccgugaagaaggaggacuccgacgacagccuggucgacuacggcgagggggugaacggccaguucaacgaggacggcuccuucaucgggcaguacagcggcaagaaggagaaggagcccgccgaggggaacgaguccagcgaggcccccucccccgugaacgcgaugaacagcuucgucuga

SEQ ID NO: 2893 - RNA, 3915 nt, Artificial Sequence
  derived and/or modified sequence opt2 from NRCAM__Homo_sapiens__CCDS47686.1
augcagcucaagaucaugcccaagaagaagcgccucuccgccggccgcgucccccucauccucuuccucugccagaugaucuccgcccucgaggucccccucgaccccaagcuccucgaggaccucguccagccccccaccaucacccagcagucccccaaggacuacaucaucgacccccgcgagaacaucgucauccagugcgaggccaagggcaagcccccccccuccuucuccuggacccgcaacggcacccacuucgacaucgacaaggacccccucgucaccaugaagcccggcaccggcacccucaucaucaacaucauguccgagggcaaggccgagaccuacgagggcgucuaccagugcaccgcccgcaacgagcgcggcgccgccgucuccaacaacaucgucguccgccccucccgcuccccccucuggaccaaggagaagcucgagcccaucacccuccaguccggccagucccucguccuccccugccgcccccccaucggccuccccccccccaucaucuucuggauggacaacuccuuccagcgccucccccaguccgagcgcgucucccagggccucaacggcgaccucuacuucuccaacguccuccccgaggacacccgcgaggacuacaucugcuacgcccgcuucaaccacacccagaccauccagcagaagcagcccaucuccgucaaggucaucuccgucgacgagcucaacgacaccaucgccgccaaccucuccgacaccgaguucuacggcgccaaguccucccgcgagcgcccccccaccuuccucacccccgagggcaacgccuccaacaaggaggagcuccgcggcaacguccucucccucgagugcaucgccgagggccuccccacccccaucaucuacugggccaaggaggacggcaugcuccccaagaaccgcaccgucuacaagaacuucgagaagacccuccagaucauccacgucuccgaggccgacuccggcaacuaccagugcaucgccaagaacgcccucggcgccauccaccacaccaucuccguccgcgucaaggccgcccccuacuggaucaccgccccccagaaccucguccucucccccggcgaggacggcacccucaucugccgcgccaacggcaaccccaagccccgcaucuccuggcucaccaacggcguccccaucgagaucgcccccgacgaccccucccgcaagaucgacggcgacaccaucaucuucuccaacguccaggagcgcuccuccgccgucuaccagugcaacgccuccaacgaguacggcuaccuccucgccaacgccuucgucaacguccucgccgagcccccccgcauccucacccccgccaacacccucuaccaggucaucgccaaccgccccgcccuccucgacugcgccuucuucggcuccccccuccccaccaucgagugguucaagggcgccaagggcuccgcccuccacgaggacaucuacguccuccacgagaacggcacccucgagauccccgucgcccagaaggacuccaccggcaccuacaccugcgucgcccgcaacaagcucggcauggccaagaacgagguccaccucgagaucaaggaccccaccuggaucgucaagcagcccgaguacgccgucguccagcgcggcuccauggucuccuucgagugcaaggucaagcacgaccacacccucucccucaccguccucuggcucaaggacaaccgcgagcuccccuccgacgagcgcuucaccgucgacaaggaccaccucgucgucgccgacgucuccgacgacgacuccggcaccuacaccugcgucgccaacaccacccucgacuccgucuccgccuccgccguccucuccgucgucgcccccacccccacccccgcccccgucuacgacguccccaacccccccuucgaccucgagcucaccgaccagcucgacaaguccguccagcucuccuggacccccggcgacgacaacaacucccccaucaccaaguucaucaucgaguacgaggacgccaugcacaagcccggccucuggcaccaccagaccgaggucuccggcacccagaccaccgcccagcucaagcucucccccuacgucaacuacuccuuccgcgucauggccgucaacuccaucggcaagucccuccccuccgaggccuccgagcaguaccucaccaaggccuccgagcccgacaagaaccccaccgccgucgagggccucggcuccgagcccgacaaccucgucaucaccuggaagccccucaacggcuucgaguccaacggccccggccuccaguacaaggucuccuggcgccagaaggacggcgacgacgaguggaccuccgucgucgucgccaacgucuccaaguacaucgucuccggcacccccaccuucguccccuaccucaucaagguccaggcccucaacgacaugggcuucgcccccgagcccgccgucgucaugggccacuccggcgaggaccuccccauggucgcccccggcaacguccgcgucaacgucgucaacuccacccucgccgagguccacugggaccccgucccccucaaguccauccgcggccaccuccagggcuaccgcaucuacuacuggaagacccaguccuccuccaagcgcaaccgccgccacaucgagaagaagauccucaccuuccagggcuccaagacccacggcaugcuccccggccucgagcccuucucccacuacacccucaacguccgcgucgucaacggcaagggcgagggccccgccucccccgaccgcgucuucaacacccccgagggcguccccuccgcccccuccucccucaagaucgucaaccccacccucgacucccucacccucgagugggacccccccucccaccccaacggcauccucaccgaguacacccucaaguaccagcccaucaacuccacccacgagcucggcccccucgucgaccucaagauccccgccaacaagacccgcuggacccucaagaaccucaacuucuccacccgcuacaaguucuacuucuacgcccagaccuccgccggcuccggcucccagaucaccgaggaggccgucaccaccgucgacgaggccggcauccucccccccgacgucggcgccggcaagguccaggccgucaacccccgcaucuccaaccucaccgccgccgccgccgagaccuacgccaacaucuccugggaguacgagggccccgagcacgucaacuucuacgucgaguacggcgucgccggcuccaaggaggaguggcgcaaggagaucgucaacggcucccgcuccuucuucggccucaagggccucaugcccggcaccgccuacaagguccgcgucggcgccgucggcgacuccggcuucgucuccuccgaggacgucuucgagaccggccccgccauggccucccgccaggucgacaucgccacccagggcugguucaucggccucaugugcgccgucgcccuccucauccucauccuccucaucgucugcuucauccgccgcaacaagggcggcaaguaccccgucaaggagaaggaggacgcccacgccgaccccgagauccagcccaugaaggaggacgacggcaccuucggcgaguacuccgacgccgaggaccacaagccccucaagaagggcucccgcacccccuccgaccgcaccgucaagaaggaggacuccgacgacucccucgucgacuacggcgagggcgucaacggccaguucaacgaggacggcuccuucaucggccaguacuccggcaagaaggagaaggagcccgccgagggcaacgaguccuccgaggcccccucccccgucaacgccaugaacuccuucgucuga

SEQ ID NO: 2894 - RNA, 3915 nt, Artificial Sequence
  derived and/or modified sequence opt3 from NRCAM__Homo_sapiens__CCDS47686.1
augcagcugaagaucaugcccaaaaagaaaagacucagcgccggcagggugccucuuauucuguucuugugccaaaugauauccgcuuuagaggucccacuggacccgaagcuacucgaagaucugguucagcccccuaccaucacacagcagucuccaaaagacuacauuaucgauccccgggagaauauugugauccaaugugaagcaaaggggaagccuccacccucauuuaguuggacucgcaauggaacgcacuucgacauagauaaagacccucuuguaaccaugaagccagguacaggcacucugaucauuaacaucaugagcgaggggaaagccgaaaccuaugagggaguguaccagugcacagcgcgaaaugagcguggcgcugccgucuccaacaauauugugguuagaccgucuaggucgcccuuguggaccaaggaaaaacucgagccuaucacucugcagucaggucagagccuggugcucccaugucggcccccuauaggguuaccacccccgauuaucuuuuggauggauaacaguuuccaacgccugccucaguccgaaagagucucucagggacuuaauggcgacuuguauuuuagcaacgugcugcccgaggauacaagggaggacuacauuugcuaugcacgguucaaucauacccagacgauccaacagaagcagccaaucuccguaaagguuauuucaguggaugaacuaaacgacacuauagccgcuaaucucagugauaccgaguuuuacggcgcaaaaagcucucgcgaacgaccucccacauuccugacuccagaggggaacgccuccaauaaggaggaacuuagaggaaacguccugucauuggaguguaucgcugaaggucuccccaccccuauuaucuauugggccaaagaggacggcaugcugccaaagaauaggacaguguacaaaaacuuugaaaagaccuuacaaauaauucacgugagcgaggcggacagugggaacuaccagugcaucgcuaaaaaugcccugggagcuauccaucacacgauuucuguccggguuaaggccgcaccguauuggaucacugcuccccagaaccucgugcuuuccccuggcgaagaugguacacugauuugucgugccaaugggaacccaaagccccgcauaagcugguugaccaauggaguaccuaucgagauugcgccagacgaucccucgagaaaaaucgacggcgauacuaucauuuucucuaacgugcaggagagguccucagccgucuaccaaugcaaugcaaguaacgaauauggcuaccuacuggcuaaugccuuugugaacguucucgcugagccgccucggauacugacaccagccaauacccuuuaucaggugaucgcaaaccgacccgcccuguuggacugugcuuucuuugggagcccucuccccacgauugaaugguucaagggagcgaaagguuccgcacugcaugaggauaucuacgucuuacacgaaaauggcacccuggagauuccaguggcccagaaggacucuacagggacuuauaccugcguagcucgcaacaaacuaggaauggccaagaaugagguucaccucgaaaucaaggauccuacauggauagugaaacagcccgaguacgcagucgugcaaagaggcagcauggucucauucgaauguaaggugaaacaugaccacacucugagucuuaccguuuuguggcugaaggauaacagggagcucccauccgacgagcgguuuacaguggacaaagaucaucugguagucgccgacgugagcgaugacgauucugguaccuacacuugcguugcuaacacgacacuugacucagugagugccagcgcaguccuguccgugguagcgccgaccccuacucccgcuccaguguaugauguucccaauccuccauucgacuuggaacucaccgaucagcuggacaagucuguccaguuaucguggacacccggggaugacaacaauagcccuaucaccaaguuuauuaucgaguacgaagaugccaugcacaaaccgggccuguggcaccaucagacugagguguccggaacacaaacgaccgcacagcuaaagcucucaccauaugugaacuacaguuuccgcgucauggccguuaauucuauuggcaaaagccugcccuccgaagcaucagagcaguaucuuacuaaggccagcgagccugacaaaaacccaacagcaguggaaggguugggaucugagcccgacaaucuggugaucaccuggaagccucucaacgguuuugaauccaauggcccggggcugcaguacaagguaaguuggagacaaaaagauggagacgaugaguggacaagcgucgugguugcuaacgugucuaaguauauagucuccggcacucccaccuucgugccauacuuaauuaaaguucaggcccugaaugacauggguuuugcgccugaacccgccgugguaauggggcacucaggcgaggaucuuccaauggucgcuccuggaaacgugagggugaaugucguuaacaguacguuggcagaggugcauugggaccccguaccacucaagagcauccguggccaucugcagggguaccggauuuauuacuggaaaacccaaucguccucuaagcgaaauagaaggcacaucgaaaagaagauacuaacauuccagggaagcaagacucacgguaugcugccgggccucgagccuuuuucacacuauacccugaacgugcgcgucgugaacgggaaaggagaaggccccgccaguccagaucggguuuucaauacacccgagggugugccuuccgcuccaucuagccuuaagaucgucaaccccacuuuggacucccugaccuuagaaugggauccuccgucacauccaaaugggauucucacggaguacacacugaaauaucagcccaucaacagcacccacgagcuuggcccucugguggacuugaagauucccgccaauaaaacuagauggacacucaagaaccugaauuuuaguaccagguacaaguucuauuuuuacgcacagacuucugcgggauccggcagccaaaucaccgaagaggccguuacaacgguggaugaagcugggauacuaccaccugacgucggagccggcaaaguacaggcagugaacccccgcauuucgaaucugaccgcugccgcagccgagacuuacgcuaacaucucaugggaguaugaagguccagagcauguuaauuucuacguggaauauggggucgcgggaucuaaggaggaauggcgaaaagagaucgugaacggcagucgguccuucuuuggucucaagggccugaugccugggacagccuacaaaguacgugugggagcagucggcgauagcggguucguuucuagcgaggacguguuugaaaccggaccggcuauggccuccagacagguggacauugccacacagggcugguucaucggucuuaugugcgcugucgcauugcugauuuuaauacuccugaucguguguuuuauuaggcgcaauaaagggggaaaguaucccguuaaagagaaggaagaugcccacgcggacccagagauccaaccuaugaaagaagaugacggcacuuucggugaguacucagaugcugaggaccacaagccccuuaaaaagggcagucggaccccaagcgauagaacgguaaagaaagaagacucugaugacucccugguggauuauggggagggagucaacggccaguuuaaugaagacgggucauucauuggacaguacaguggcaagaaagagaaggaaccugccgaggguaacgagagcuccgaagcacccucuccggugaacgccaugaacucguuuguuuga

SEQ ID NO: 2895 - RNA, 3915 nt, Artificial Sequence
  derived and/or modified sequence opt4 from NRCAM__Homo_sapiens__CCDS47686.1
augcagcugaagaucaugcccaagaagaagagacugagcgccggcagagugccccugauccuguuccugugccagaugaucagcgcccuggaggugccccuggaccccaagcugcuggaggaccuggugcagccccccaccaucacccagcagagccccaaggacuacaucaucgaccccagagagaacaucgugauccagugcgaggccaagggcaagcccccccccagcuucagcuggaccagaaacggcacccacuucgacaucgacaaggacccccuggugaccaugaagcccggcaccggcacccugaucaucaacaucaugagcgagggcaaggccgagaccuacgagggcguguaccagugcaccgccagaaacgagagaggcgccgccgugagcaacaacaucguggugagacccagcagaagcccccuguggaccaaggagaagcuggagcccaucacccugcagagcggccagagccuggugcugcccugcagaccccccaucggccugcccccccccaucaucuucuggauggacaacagcuuccagagacugccccagagcgagagagugagccagggccugaacggcgaccuguacuucagcaacgugcugcccgaggacaccagagaggacuacaucugcuacgccagauucaaccacacccagaccauccagcagaagcagcccaucagcgugaaggugaucagcguggacgagcugaacgacaccaucgccgccaaccugagcgacaccgaguucuacggcgccaagagcagcagagagagaccccccaccuuccugacccccgagggcaacgccagcaacaaggaggagcugagaggcaacgugcugagccuggagugcaucgccgagggccugcccacccccaucaucuacugggccaaggaggacggcaugcugcccaagaacagaaccguguacaagaacuucgagaagacccugcagaucauccacgugagcgaggccgacagcggcaacuaccagugcaucgccaagaacgcccugggcgccauccaccacaccaucagcgugagagugaaggccgcccccuacuggaucaccgccccccagaaccuggugcugagccccggcgaggacggcacccugaucugcagagccaacggcaaccccaagcccagaaucagcuggcugaccaacggcgugcccaucgagaucgcccccgacgaccccagcagaaagaucgacggcgacaccaucaucuucagcaacgugcaggagagaagcagcgccguguaccagugcaacgccagcaacgaguacggcuaccugcuggccaacgccuucgugaacgugcuggccgagccccccagaauccugacccccgccaacacccuguaccaggugaucgccaacagacccgcccugcuggacugcgccuucuucggcagcccccugcccaccaucgagugguucaagggcgccaagggcagcgcccugcacgaggacaucuacgugcugcacgagaacggcacccuggagauccccguggcccagaaggacagcaccggcaccuacaccugcguggccagaaacaagcugggcauggccaagaacgaggugcaccuggagaucaaggaccccaccuggaucgugaagcagcccgaguacgccguggugcagagaggcagcauggugagcuucgagugcaaggugaagcacgaccacacccugagccugaccgugcuguggcugaaggacaacagagagcugcccagcgacgagagauucaccguggacaaggaccaccuggugguggccgacgugagcgacgacgacagcggcaccuacaccugcguggccaacaccacccuggacagcgugagcgccagcgccgugcugagcgugguggcccccacccccacccccgcccccguguacgacgugcccaacccccccuucgaccuggagcugaccgaccagcuggacaagagcgugcagcugagcuggacccccggcgacgacaacaacagccccaucaccaaguucaucaucgaguacgaggacgccaugcacaagcccggccuguggcaccaccagaccgaggugagcggcacccagaccaccgcccagcugaagcugagccccuacgugaacuacagcuucagagugauggccgugaacagcaucggcaagagccugcccagcgaggccagcgagcaguaccugaccaaggccagcgagcccgacaagaaccccaccgccguggagggccugggcagcgagcccgacaaccuggugaucaccuggaagccccugaacggcuucgagagcaacggccccggccugcaguacaaggugagcuggagacagaaggacggcgacgacgaguggaccagcguggugguggccaacgugagcaaguacaucgugagcggcacccccaccuucgugcccuaccugaucaaggugcaggcccugaacgacaugggcuucgcccccgagcccgccguggugaugggccacagcggcgaggaccugcccaugguggcccccggcaacgugagagugaacguggugaacagcacccuggccgaggugcacugggaccccgugccccugaagagcaucagaggccaccugcagggcuacagaaucuacuacuggaagacccagagcagcagcaagagaaacagaagacacaucgagaagaagauccugaccuuccagggcagcaagacccacggcaugcugcccggccuggagcccuucagccacuacacccugaacgugagaguggugaacggcaagggcgagggccccgccagccccgacagaguguucaacacccccgagggcgugcccagcgcccccagcagccugaagaucgugaaccccacccuggacagccugacccuggagugggacccccccagccaccccaacggcauccugaccgaguacacccugaaguaccagcccaucaacagcacccacgagcugggcccccugguggaccugaagauccccgccaacaagaccagauggacccugaagaaccugaacuucagcaccagauacaaguucuacuucuacgcccagaccagcgccggcagcggcagccagaucaccgaggaggccgugaccaccguggacgaggccggcauccugccccccgacgugggcgccggcaaggugcaggccgugaaccccagaaucagcaaccugaccgccgccgccgccgagaccuacgccaacaucagcugggaguacgagggccccgagcacgugaacuucuacguggaguacggcguggccggcagcaaggaggaguggagaaaggagaucgugaacggcagcagaagcuucuucggccugaagggccugaugcccggcaccgccuacaaggugagagugggcgccgugggcgacagcggcuucgugagcagcgaggacguguucgagaccggccccgccauggccagcagacagguggacaucgccacccagggcugguucaucggccugaugugcgccguggcccugcugauccugauccugcugaucgugugcuucaucagaagaaacaagggcggcaaguaccccgugaaggagaaggaggacgcccacgccgaccccgagauccagcccaugaaggaggacgacggcaccuucggcgaguacagcgacgccgaggaccacaagccccugaagaagggcagcagaacccccagcgacagaaccgugaagaaggaggacagcgacgacagccugguggacuacggcgagggcgugaacggccaguucaacgaggacggcagcuucaucggccaguacagcggcaagaaggagaaggagcccgccgagggcaacgagagcagcgaggcccccagccccgugaacgccaugaacagcuucguguga

SEQ ID NO: 2896 - RNA, 3915 nt, Artificial Sequence
  derived and/or modified sequence opt5 from NRCAM__Homo_sapiens__CCDS47686.1
augcagcugaagaucaugcccaaaaagaaaagacucagcgccggccgggugccucugauucuuuuccugugccaaaugaucuccgcucucgaggucccgcuggaccccaaacuucuggaagaucucguucagccucccaccauuacacagcagucuccuaaagacuacaucauugauccccgcgagaacaucgugauccaaugugaagccaaggggaagccuccgcccagcuuuuccuggacgagaaauggaacccacuucgacauugauaaagacccucuggugacaaugaagcccggcaccgggacacugaucauuaacaucaugucugagggaaaagcggaaaccuaugagggcgucuaccagugcacagcucggaaugagcgcggggccgccgugagcaacaauauuguugugagaccuucccggucuccccucuggaccaaggaaaaacuggagccgaucacgcuucagagcggacagucccugguccucccuuguagacccccuauuggccugcccccucccaucaucuuuuggauggauaacagcuuccaacgccuuccgcagucugaacgggugucccagggccugaauggggaccucuauuuuagcaacguucugcccgaggauacccgcgaggacuacauuugcuaugcuagauucaaucauacacagaccauccaacagaagcagccuauuucugugaaggucaucuccguggaugaacugaacgacacaauugccgcuaaucucagcgauaccgaguuuuacggagccaaaucuucccgggaaagacccccuacguuccugacacccgagggcaacgcgagcaauaaggaggaacuucgcgggaacgugcugucccucgaguguaucgccgaaggacugccgaccccuaucauuuauugggcuaaagaggacggcaugcuucccaagaaucggacagucuacaaaaacuuugaaaagacccugcaaaucauucacguuucugaggccgacagcgggaacuaccagugcaucgcuaaaaaugcccucggagcgauucaucacaccaucuccgugcgcgugaaggccgcuccuuauuggaucacagcuccccagaaccugguccugagcccuggcgaagauggcacgcucauuuguagagcuaaugggaaccccaagccgcggaucucuuggcugaccaauggagugccuauugagaucgcccccgacgaucccuccagaaaaauugacggcgauacaaucauuuucagcaacguucaggagcgcucuagcgccguguaccaaugcaaugcuuccaacgaauauggguaccuucuggcgaaugccuuugucaacgugcucgcugagccuccgcggauccugacccccgccaauacacuuuaucagguuaucgccaacagaccugcucugcucgacugugccuucuuuggaucuccccugccuaccauugaaugguucaagggcgcgaaagggagcgcucugcaugaggauaucuacgugcuccacgaaaauggaacgcuggagauucccgucgcccagaaggacuccacaggcaccuauaccugcguggcccgcaacaaacuuggcauggcuaagaaugagguccaccuggaaaucaaggauccuacauggauugugaaacagcccgaguacgccguugugcaacgggggagcauggucucuuucgaauguaaggugaaacaugaccacacccucucccugacaguucuguggcuuaaggauaacagagagcucccgagcgacgagcgcuuuacgguggacaaagaucaucuggucguggcugacgugucugaugacgauuccggaaccuacacaugcguugccaacaccacacuggacagcgucuccgcgucugccgugcucagcguggucgcuccuacccccacgccugcccccguguaugauguuccgaauccucccuucgaccuggaacuuaccgaucagcuggacaaguccgugcagcucucuuggacaccuggcgaugacaacaauagccccaucaccaaguuuaucauugaguacgaagaugcuaugcacaaacccgggcuguggcaccaucagacagaggucuccggaacccaaacgacagcccagcugaaacuuagcccuuaugugaacuacucuuuccggguuauggcggucaauuccaucggcaagagccucccgucugaagccuccgagcaguaucugaccaaggcuagcgagcccgacaaaaacccuacagccguggaagggcugggcucugagcccgacaaucucgugauuaccuggaagccucugaacggauuugaaagcaauggccccgggcuucaguacaagguuuccuggagacaaaaagauggagacgaugaguggaccagcguggucguggcuaacgugucuaaguauaucgucuccggcacaccuacguucguuccguaccugauuaaagugcaggcccucaaugacaugggguuugcccccgaaccugcuguggucaugggacacagcggcgaggaucugcccaugguggcgccugggaacguucgcgugaaugucgugaacuccacccuggccgagguucauugggaccccgugccgcuuaagucuauccggggccaccuccagggauacagaaucuauuacuggaaaacacaaagcuccucuaagcgcaaucggagacauauugaaaagaagauccugaccuuccagggcagcaagacacacgggaugcugccuggacucgagcccuuuucccacuauacccugaacguccgggugguuaacggcaaaggggaaggacccgcuucuccugaucgcguguucaauacgcccgagggcgucccuagcgccccguccagccuuaagauugugaaccccacacuggacucucucacccuggaaugggauccucccucccauccuaaugggauccugaccgaguacacacuuaaauaucagcccauuaacagcacccacgagcucggcccgcugguggaccugaagaucccugccaauaaaacaagauggacgcucaagaaccugaauuuuucuacccgguacaaguucuauuuuuacgcucagacauccgccggaagcggcucucaaaucaccgaagaggcggucacaaccguugaugaagcugggauucuucccccugacgugggagccggcaaagugcaggccgucaaccccagaaucuccaaucugacggcugccgcggcugagaccuacgccaacauuagcugggaguaugaagggccugagcaugugaauuucuacguugaauauggaguggccggcuccaaggaggaauggcgcaaagagaucgucaacgggagccggucuuucuuuggccucaagggacugaugcccggcacagcuuacaaagugagaguuggggccgugggagauagcggcuucgucuccucugaggacguguuugaaaccgggccggcuauggccagccgccaggucgacauugcgacacagggaugguucaucggccugaugugcgccguggcccuucugauucucauccugcucaucguuuguuuuauuagacggaauaagggcgggaaguauccugugaaagagaaggaagaugcccacgcugaccccgagauccaacccaugaaagaagaugacggaaccuucggcgaguacuccgaugccgaggaccacaagccucugaaaaaggggucucgcacaccgagcgauagaaccgucaagaaagaagacuccgaugacucucuuguggauuauggagagggcguuaacgggcaguuuaaugaagacggcagcuucauuggacaguacuccggcaagaaagagaaggaacccgccgaggggaacgagagcucugaagcuccuucccccgugaacgcgaugaauagcuuugucuga

SEQ ID NO: 2897 - protein, 434 aa, Artificial Sequence
  NSE__Homo_sapiens__P09104
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 2898 - RNA, 1305 nt, Artificial Sequence
  NSE__Homo_sapiens__AAB51320
auguccauagagaagaucugggcccgggagauccuggacucccgcgggaaccccacaguggagguggaucucuauacugccaaaggucuuuuccgggcugcagugcccaguggagccucuacgggcaucuaugaggcccuggagcugagggauggagacaaacagcguuacuuaggcaaagguguccugaaggcaguggaccacaucaacuccaccaucgcgccagcccucaucagcucaggucucucugugguggagcaagagaaacuggacaaccugaugcuggaguuggaugggacugagaacaaauccaaguuuggggccaaugccauccugggugugucucuggccguguguaaggcaggggcagcugagcgggaacugccccuguaucgccacauugcucagcuggccgggaacucagaccucauccugccugugccggccuucaacgugaucaaugguggcucucaugcuggcaacaagcuggccaugcaggaguucaugauccucccagugggagcugagagcuuucgggaugccaugcgacuaggugcagaggucuaccauacacucaagggagucaucaaggacaaauacggcaaggaugccaccaaugugggggaugaagguggcuuugcccccaauauccuggagaacagugaagccuuggagcuggugaaggaagccaucgacaaggcuggcuacacggaaaagaucguuauuggcauggauguugcugccucagaguuuuaucgugauggcaaauaugacuuggacuucaagucucccacugauccuucccgauacaucacuggggaccagcugggggcacucuaccaggacuuugucagggacuauccuguggucuccauugaggacccauuugaccaggaugauugggcugccugguccaaguucacagccaauguagggauccagauugugggugaugaccugacagugaccaacccaaaacguauugagcgggcaguggaagaaaaggccugcaacugucugcugcucaaggucaaccagaucggcucggucacugaagccauccaagcgugcaagcuggcccaggagaauggcuggggggucauggugagucaucgcucaggagagacugaggacacauucauugcugaccuggugguggggcugugcacaggccagaucaagacuggugccccgugccguucugaacgucuggcuaaauacaaccagcucaugagaauugaggaagagcugggggaugaagcucgcuuugccggacauaacuuccguaaucccagugugcuguga

SEQ ID NO: 2899 - RNA, 1305 nt, Artificial Sequence
  derived and/or modified sequence opt1 from NSE__Homo_sapiens__AAB51320
augagcaucgagaagaucugggcccgcgagauccuggacucccggggcaaccccaccguggaggucgaccucuacaccgccaaggggcuguuccgcgcggccgugccgagcggcgccuccacggggaucuacgaggcccuggagcuccgggacggcgacaagcagcgcuaccuggggaagggcgugcugaaggccgucgaccacaucaacagcaccaucgcgcccgcccucaucuccagcggccuguccgugguggagcaggagaagcuggacaaccucaugcuggagcuggacgggaccgagaacaagagcaaguucggcgccaacgccauccucggggucucccuggcggugugcaaggccggcgccgccgagcgggagcugccccucuaccgccacaucgcccagcuggcggggaacagcgaccugauccuccccgugccggccuucaacgucaucaacggcggcucccacgccgggaacaagcuggccaugcaggaguucaugauccugcccgugggcgccgagagcuuccgggacgcgaugcgccucggggccgagguguaccacacccugaagggcgucaucaaggacaaguacggcaaggacgccacgaacgugggggacgagggcggguucgcccccaacauccuggagaacuccgaggcccucgagcuggugaaggaggcgaucgacaaggccggcuacaccgagaagaucgucaucgggauggacguggccgccagcgaguucuaccgggacggcaaguacgaccuggacuucaagucccccaccgacccgagccgcuacaucaccggcgaccagcucggggcccuguaccaggacuucgugcgggacuaccccgucguguccaucgaggaccccuucgaccaggacgacugggcggccuggagcaaguucacggccaacgugggcauccagaucgucggggacgaccugaccgugaccaaccccaagcgcaucgagcgggccguggaggagaaggcgugcaacugccuccugcugaaggucaaccagaucggcuccgugaccgaggccauccaggccugcaagcucgcccaggagaacggguggggcgucauggugagccaccgcagcggcgagacggaggacaccuucaucgccgaccugguggucgggcugugcaccggccagaucaagaccggggcgccgugccgguccgagcgccucgccaaguacaaccagcugaugcggaucgaggaggagcugggcgacgaggcccgcuucgccgggcacaacuuccggaaccccagcgugcucuga

SEQ ID NO: 2900 - RNA, 1305 nt, Artificial Sequence
  derived and/or modified sequence opt2 from NSE__Homo_sapiens__AAB51320
auguccaucgagaagaucugggcccgcgagauccucgacucccgcggcaaccccaccgucgaggucgaccucuacaccgccaagggccucuuccgcgccgccguccccuccggcgccuccaccggcaucuacgaggcccucgagcuccgcgacggcgacaagcagcgcuaccucggcaagggcguccucaaggccgucgaccacaucaacuccaccaucgcccccgcccucaucuccuccggccucuccgucgucgagcaggagaagcucgacaaccucaugcucgagcucgacggcaccgagaacaaguccaaguucggcgccaacgccauccucggcgucucccucgccgucugcaaggccggcgccgccgagcgcgagcucccccucuaccgccacaucgcccagcucgccggcaacuccgaccucauccuccccguccccgccuucaacgucaucaacggcggcucccacgccggcaacaagcucgccaugcaggaguucaugauccuccccgucggcgccgaguccuuccgcgacgccaugcgccucggcgccgaggucuaccacacccucaagggcgucaucaaggacaaguacggcaaggacgccaccaacgucggcgacgagggcggcuucgcccccaacauccucgagaacuccgaggcccucgagcucgucaaggaggccaucgacaaggccggcuacaccgagaagaucgucaucggcauggacgucgccgccuccgaguucuaccgcgacggcaaguacgaccucgacuucaagucccccaccgaccccucccgcuacaucaccggcgaccagcucggcgcccucuaccaggacuucguccgcgacuaccccgucgucuccaucgaggaccccuucgaccaggacgacugggccgccugguccaaguucaccgccaacgucggcauccagaucgucggcgacgaccucaccgucaccaaccccaagcgcaucgagcgcgccgucgaggagaaggccugcaacugccuccuccucaaggucaaccagaucggcuccgucaccgaggccauccaggccugcaagcucgcccaggagaacggcuggggcgucauggucucccaccgcuccggcgagaccgaggacaccuucaucgccgaccucgucgucggccucugcaccggccagaucaagaccggcgcccccugccgcuccgagcgccucgccaaguacaaccagcucaugcgcaucgaggaggagcucggcgacgaggcccgcuucgccggccacaacuuccgcaaccccuccguccucuga

SEQ ID NO: 2901 - RNA, 1305 nt, Artificial Sequence
  derived and/or modified sequence opt3 from NSE__Homo_sapiens__AAB51320
augagcaucgagaagauuugggccagagaaauacuggacuccaggggcaaccccaccguggaggucgaucucuacacagcuaaagggcuuuuccgggcagccguuccuucuggagcgucaacugguaucuaugaagcucuggaguugcgcgacggcgauaagcagcgauacuuagggaaaggagugcugaaggccguagaccacauuaauaguacgaucgcaccagcccuaauuagcuccggccucucuguggucgaacaagagaaacuggauaaccuuaugcuggaguuggacgguaccgaaaauaagucgaaguuuggggcuaacgcaauccucggagugucacuggccguuugcaaagcuggcgccgcggagcgugaacugccgcucuauagacauauagcacaguuagccggcaauagcgaucugauccuucccgugccugcuuucaacgucauuaaugggggaagucacgccgguaacaaguuggcaaugcaggaguuuaugauccugccagugggcgcugaguccuucagggacgccaugcggcuaggggcggaaguauaccauacacucaaaggaguuauuaaggauaaauauggcaaggacgccacuaaugugggugaugaagggggauuugcacccaacauccuggaaaauucugaggcucuugaacuggucaaggaggccauagacaaagcuggcuacaccgagaagauugugaucggcauggauguggccgcaagcgaguucuaucgcgacgggaaauacgacuuggauuuuaaguccccuacagacccaucaagauacauuaccggagaucagcucggugcccuguaucaagacuucgucagggauuaccccguugugaguaucgaggacccuuuugaucaggacgauugggcugcguggagcaaauucacugcaaacguaggcauccagauugugggggacgauuuaacagucaccaauccaaagcggauagaacgcgccguggaggaaaaggcuuguaacugccugcuccuuaaaguuaaucagaucggaucugugacggaggccauucaagcauguaagcuggcccaggagaacggcuggggugucauggugucccaccgaucaggggaaacugaggacaccuuuaucgcugacuugguaguuggccuaugcacaggacagauaaaaacuggcgccccguguagaagcgaaaggcuggcaaaguauaaccagcucaugcggauugaggaggaacugggggaugaggcgcguuucgcuggacauaauuuucgcaaccccagugugcuuuga

SEQ ID NO: 2902 - RNA, 1305 nt, Artificial Sequence
  derived and/or modified sequence opt4 from NSE__Homo_sapiens__AAB51320
augagcaucgagaagaucugggccagagagauccuggacagcagaggcaaccccaccguggagguggaccuguacaccgccaagggccuguucagagccgccgugcccagcggcgccagcaccggcaucuacgaggcccuggagcugagagacggcgacaagcagagauaccugggcaagggcgugcugaaggccguggaccacaucaacagcaccaucgcccccgcccugaucagcagcggccugagcgugguggagcaggagaagcuggacaaccugaugcuggagcuggacggcaccgagaacaagagcaaguucggcgccaacgccauccugggcgugagccuggccgugugcaaggccggcgccgccgagagagagcugccccuguacagacacaucgcccagcuggccggcaacagcgaccugauccugcccgugcccgccuucaacgugaucaacggcggcagccacgccggcaacaagcuggccaugcaggaguucaugauccugcccgugggcgccgagagcuucagagacgccaugagacugggcgccgagguguaccacacccugaagggcgugaucaaggacaaguacggcaaggacgccaccaacgugggcgacgagggcggcuucgcccccaacauccuggagaacagcgaggcccuggagcuggugaaggaggccaucgacaaggccggcuacaccgagaagaucgugaucggcauggacguggccgccagcgaguucuacagagacggcaaguacgaccuggacuucaagagccccaccgaccccagcagauacaucaccggcgaccagcugggcgcccuguaccaggacuucgugagagacuaccccguggugagcaucgaggaccccuucgaccaggacgacugggccgccuggagcaaguucaccgccaacgugggcauccagaucgugggcgacgaccugaccgugaccaaccccaagagaaucgagagagccguggaggagaaggccugcaacugccugcugcugaaggugaaccagaucggcagcgugaccgaggccauccaggccugcaagcuggcccaggagaacggcuggggcgugauggugagccacagaagcggcgagaccgaggacaccuucaucgccgaccugguggugggccugugcaccggccagaucaagaccggcgcccccugcagaagcgagagacuggccaaguacaaccagcugaugagaaucgaggaggagcugggcgacgaggccagauucgccggccacaacuucagaaaccccagcgugcuguga

SEQ ID NO: 2903 - RNA, 1305 nt, Artificial Sequence
  derived and/or modified sequence opt5 from NSE__Homo_sapiens__AAB51320
augagcaucgagaagauuugggccagagaaauccuggacucccggggcaaccccaccguggaggucgaucucuacacagcuaaagggcuguuccgcgccgcgguuccuucuggagcuagcacgggcauuuaugaagcccuugagcugagagacggggauaagcagcgguaccucggaaaaggcgugcugaaggccguggaccacaucaauuccaccauugcuccggcccuuaucucuagcgggcuguccgucguggaacaagagaaacucgauaaccugaugcuggagcucgacggaacagaaaauaagucuaaguuuggcgcuaacgccauccugggcguuagccuugcggugugcaaagccggggcugccgagcgcgaacugccccucuauagacauauugcucagcuggccggaaauuccgaucuuauccugccuguccccgcguucaacgugauuaauggcgggagccacgccggaaacaagcucgcuaugcaggaguuuaugauccugccuguuggcgccgagucuuuccgggacgcuaugcgccugggggccgaaguguaccauacccucaaaggagucauuaaggauaaauauggcaaggacgccacaaaugugggcgaugagggaggauuugcucccaacauccuggaaaauuccgaggcgcuugaacuggugaaggaggccauugacaaagcuggcuacaccgagaagaucgucaucgggauggauguugccgccagcgaguucuauagagacggaaaauacgaccucgauuuuaagucuccuacagacccgucccgguacauuaccggcgaucagcugggggcucuuuaucaagacuucgugcgcgauuaccccguggucagcaucgaggacccuuuugaucaggacgauugggccgcguggucuaaauucacggcuaacguggggauucagaucguuggcgacgaucugaccgugacaaaucccaagagaauugaacgggccgucgaggaaaaagccuguaacugccuccugcugaaggugaaucagaucggcuccguuaccgaggcuauccaagccuguaagcucgcucaggagaacggguggggagugauggucagccaccgcuccggcgaaacagaggacaccuuuauugccgaccugguggucgggcuuugcacgggacagaucaaaacaggcgcgccuuguagaucugaacggcuggccaaguauaaccagcucaugcgcauugaggaagaacugggggaugaggcuagauucgccggccauaauuuucggaaccccagcgugcuuuga

SEQ ID NO: 2904 - protein, 464 aa, Artificial Sequence
  NUF2__Homo_sapiens__Q9BZD4
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 2905 - RNA, 1395 nt, Artificial Sequence
  NUF2__Homo_sapiens__AAH08489
auggaaacuuugucuuuccccagauauaauguagcugagauugugauucauauucgcaauaagaucuuaacaggagcugaugguaaaaaccucaccaagaaugaucuuuauccaaauccaaagccugaagucuugcacaugaucuacaugagagccuuacaaauaguauauggaauucgacuggaacauuuuuacaugaugccagugaacucugaagucauguauccacauuuaauggaaggcuucuuaccauucagcaauuuaguuacucaucuggacucauuuuugccuaucugccgggugaaugacuuugagacugcugauauucuauguccaaaagcaaaacggacaagucgguuuuuaaguggcauuaucaacuuuauucacuucagagaagcaugccgugaaacguauauggaauuucuuuggcaauauaaauccucugcggacaaaaugcaacaguuaaacgccgcacaccaggaggcauuaaugaaacuggagagacuugauucuguuccaguugaagagcaagaagaguucaagcagcuuucagauggaauucaggagcuacaacaaucacuaaaucaggauuuucaucaaaaaacgauagugcugcaagagggaaauucccaaaagaagucaaauauuucagagaaaaccaagcguuugaaugaacuaaaauugucggugguuucuuugaaagaaauacaagagaguuugaaaacaaaaauuguggauucuccagagaaguuaaagaauuauaaagaaaaaaugaaagauacgguccagaagcuuaaaaaugccagacaagaagugguggagaaauaugaaaucuauggagacucaguugacugccugccuucaugucaguuggaagugcaguuauaucaaaagaaaauacaggaccuuucagauaauagggaaaaauuagccaguaucuuaaaggagagccugaacuuggaggaccaaauugagagugaugagucagaacugaagaaauugaagacugaagaaaauucguucaaaagacugaugauugugaagaaggaaaaacuugccacagcacaauucaaaauaaauaagaagcaugaagauguuaagcaauacaaacgcacaguaauugaggauugcaauaaaguucaagaaaaaagaggugcugucuaugaacgaguaaccacaauuaaucaagaaauccaaaaaauuaaacuuggaauucaacaacuaaaagaugcugcugaaagggagaaacugaagucccaggaaauauuucuaaacuugaaaacugcuuuggagaaauaccacgacgguauugaaaaggcagcagaggacuccuaugcuaagauagaugagaagacagcugaacugaagaggaagauguucaaaaugucaaccuga

SEQ ID NO: 2906 - RNA, 1395 nt, Artificial Sequence
  derived and/or modified sequence opt1 from NUF2__Homo_sapiens__AAH08489
auggagacccugagcuucccccgcuacaacguggccgagaucgucauccacauccggaacaagauccucaccggcgccgacgggaagaaccugacgaagaacgaccuguacccgaaccccaagcccgaggugcuccacaugaucuacaugcgcgcgcugcagaucguguacggcauccggcuggagcacuucuacaugaugcccgucaacuccgaggugauguacccgcaccucauggagggguuccugcccuucagcaaccuggugacccaccucgacuccuuccugcccaucugccgcgucaacgacuucgagaccgccgacauccugugccccaaggccaagcggaccagccgcuuccucuccggcaucaucaacuucauccacuuccgggaggccugccgcgagacguacauggaguuccuguggcaguacaagagcuccgccgacaagaugcagcagcugaacgcggcccaccaggaggcccucaugaagcuggagcggcuggacagcgugccgguggaggagcaggaggaguucaagcagcucuccgacgggauccaggagcugcagcagagccugaaccaggacuuccaccagaagaccaucguccuccaggagggcaacucccagaagaaguccaacaucagcgagaagaccaagcgccugaacgagcugaagcucagcguggugucccugaaggagauccaggagagccugaagaccaagaucgucgacucccccgagaagcucaagaacuacaaggagaagaugaaggacacggugcagaagcugaagaacgcccggcaggagguggucgagaaguacgagaucuacggcgacagcguggacugccugcccuccugccagcucgaggugcagcuguaccagaagaagauccaggaccugagcgacaaccgcgagaagcucgcgagcauccugaaggagucccugaaccucgaggaccagaucgagagcgacgaguccgagcugaagaagcugaagaccgaggagaacagcuucaagcggcucaugaucgucaagaaggagaagcuggccaccgcccaguucaagaucaacaagaagcacgaggacgugaagcaguacaagcgcaccgugaucgaggacugcaacaagguccaggagaagcgcggggccguguacgagcgggugacgaccaucaaccaggagauccagaagaucaagcugggcauccagcagcucaaggacgccgcggagcgggagaagcugaagucccaggagaucuuccugaaccucaagaccgcccuggagaaguaccacgacgggaucgagaaggccgccgaggacagcuacgccaagaucgacgagaagaccgcggagcugaagcgcaagauguucaagauguccacguga

SEQ ID NO: 2907 - RNA, 1395 nt, Artificial Sequence
  derived and/or modified sequence opt2 from NUF2__Homo_sapiens__AAH08489
auggagacccucuccuucccccgcuacaacgucgccgagaucgucauccacauccgcaacaagauccucaccggcgccgacggcaagaaccucaccaagaacgaccucuaccccaaccccaagcccgagguccuccacaugaucuacaugcgcgcccuccagaucgucuacggcauccgccucgagcacuucuacaugaugcccgucaacuccgaggucauguacccccaccucauggagggcuuccuccccuucuccaaccucgucacccaccucgacuccuuccuccccaucugccgcgucaacgacuucgagaccgccgacauccucugccccaaggccaagcgcaccucccgcuuccucuccggcaucaucaacuucauccacuuccgcgaggccugccgcgagaccuacauggaguuccucuggcaguacaaguccuccgccgacaagaugcagcagcucaacgccgcccaccaggaggcccucaugaagcucgagcgccucgacuccguccccgucgaggagcaggaggaguucaagcagcucuccgacggcauccaggagcuccagcagucccucaaccaggacuuccaccagaagaccaucguccuccaggagggcaacucccagaagaaguccaacaucuccgagaagaccaagcgccucaacgagcucaagcucuccgucgucucccucaaggagauccaggagucccucaagaccaagaucgucgacucccccgagaagcucaagaacuacaaggagaagaugaaggacaccguccagaagcucaagaacgcccgccaggaggucgucgagaaguacgagaucuacggcgacuccgucgacugccuccccuccugccagcucgagguccagcucuaccagaagaagauccaggaccucuccgacaaccgcgagaagcucgccuccauccucaaggagucccucaaccucgaggaccagaucgaguccgacgaguccgagcucaagaagcucaagaccgaggagaacuccuucaagcgccucaugaucgucaagaaggagaagcucgccaccgcccaguucaagaucaacaagaagcacgaggacgucaagcaguacaagcgcaccgucaucgaggacugcaacaagguccaggagaagcgcggcgccgucuacgagcgcgucaccaccaucaaccaggagauccagaagaucaagcucggcauccagcagcucaaggacgccgccgagcgcgagaagcucaagucccaggagaucuuccucaaccucaagaccgcccucgagaaguaccacgacggcaucgagaaggccgccgaggacuccuacgccaagaucgacgagaagaccgccgagcucaagcgcaagauguucaagauguccaccuga

SEQ ID NO: 2908 - RNA, 1395 nt, Artificial Sequence
  derived and/or modified sequence opt3 from NUF2__Homo_sapiens__AAH08489
auggagacccugagcuuccccagauacaacguggccgaaaucgucauucacauaaggaauaagauccucacaggcgcugacgggaaaaaccuuacuaagaaugaucuguauccuaacccaaaaccggagguuuugcauaugauuuacaugcgggcauuacagaucguguaugguauucgccuggaacacuuuuacaugaugcccguaaauuccgaggugauguauccucaucuaauggaaggauuccucccauuuucuaaccuggucacgcaccuugacucauuccugcccaucugccgagugaaugauuuugagaccgccgacauauuguguccuaaggcgaaacguacaaguagauuccucagcggcaucauuaacuuuauccauuucagggaggcuugccgggaaacuuacauggaguuucuguggcaauauaaguccucugccgauaagaugcagcagcugaaugcagcccaccaggaagcucucaugaaauuagagcgccuggacucgguuccaguggaggaacaagaggaguucaagcagcuuucagaugggauucaggaguugcagcaaagccugaaccaggacuuucaccagaaaaccaucguccuacaggaaggaaauagucaaaagaaauccaacauaucugagaagacaaagagacucaaugagcugaaacuuagcgugguaucccugaaggaaauucaggagucauugaaaaccaagaucguugauagucccgaaaaacucaagaacuacaaagagaagaugaaggacacugugcagaaacugaagaaugcaaggcaagaagucguggagaaauacgagauuuauggcgauagcguggacuguuuaccuucuugccagcuggaaguccagcucuaccagaagaaaauccaagaucuuuccgacaaccgggagaagcuggccucaaucuugaaggaaagccuaaaccuggaggaccagauugaaagugaugagucugagcucaaaaagcugaaaacagaagaaaauuccuucaagcgccuuaugauaguuaaaaaggaaaagcuggcuaccgcccaguuuaaaaucaacaagaaacaugaggacgugaagcaguauaaacgaacgguaauugaggauuguaauaaggugcaagaaaagagaggugcggucuacgagagggugacuaccaucaaccaggaaauacagaaaauuaaguuggggauccagcaacucaaagacgcagccgagcgggaaaagcugaaaagccaggagaucuucuuaaaucugaagacagcucuagagaaauaucacgauggaauugaaaaggccgcagaggacucguacgcuaagaucgaugagaaaacugccgaacucaagcguaaaauguucaagaugucuaccuga

SEQ ID NO: 2909 - RNA, 1395 nt, Artificial Sequence
  derived and/or modified sequence opt4 from NUF2__Homo_sapiens__AAH08489
auggagacccugagcuuccccagauacaacguggccgagaucgugauccacaucagaaacaagauccugaccggcgccgacggcaagaaccugaccaagaacgaccuguaccccaaccccaagcccgaggugcugcacaugaucuacaugagagcccugcagaucguguacggcaucagacuggagcacuucuacaugaugcccgugaacagcgaggugauguacccccaccugauggagggcuuccugcccuucagcaaccuggugacccaccuggacagcuuccugcccaucugcagagugaacgacuucgagaccgccgacauccugugccccaaggccaagagaaccagcagauuccugagcggcaucaucaacuucauccacuucagagaggccugcagagagaccuacauggaguuccuguggcaguacaagagcagcgccgacaagaugcagcagcugaacgccgcccaccaggaggcccugaugaagcuggagagacuggacagcgugcccguggaggagcaggaggaguucaagcagcugagcgacggcauccaggagcugcagcagagccugaaccaggacuuccaccagaagaccaucgugcugcaggagggcaacagccagaagaagagcaacaucagcgagaagaccaagagacugaacgagcugaagcugagcguggugagccugaaggagauccaggagagccugaagaccaagaucguggacagccccgagaagcugaagaacuacaaggagaagaugaaggacaccgugcagaagcugaagaacgccagacaggaggugguggagaaguacgagaucuacggcgacagcguggacugccugcccagcugccagcuggaggugcagcuguaccagaagaagauccaggaccugagcgacaacagagagaagcuggccagcauccugaaggagagccugaaccuggaggaccagaucgagagcgacgagagcgagcugaagaagcugaagaccgaggagaacagcuucaagagacugaugaucgugaagaaggagaagcuggccaccgcccaguucaagaucaacaagaagcacgaggacgugaagcaguacaagagaaccgugaucgaggacugcaacaaggugcaggagaagagaggcgccguguacgagagagugaccaccaucaaccaggagauccagaagaucaagcugggcauccagcagcugaaggacgccgccgagagagagaagcugaagagccaggagaucuuccugaaccugaagaccgcccuggagaaguaccacgacggcaucgagaaggccgccgaggacagcuacgccaagaucgacgagaagaccgccgagcugaagagaaagauguucaagaugagcaccuga

SEQ ID NO: 2910 - RNA, 1395 nt, Artificial Sequence
  derived and/or modified sequence opt5 from NUF2__Homo_sapiens__AAH08489
auggagacccugagcuuccccagauacaacguggccgaaaucgucauucacauccggaauaagauucucacaggcgcugacgggaaaaaccugacgaagaaugaucuuuauccuaacccgaaacccgagguucugcauaugaucuacaugcgcgcccuccagauuguguauggaaucagacuggaacacuuuuacaugaugccugucaauuccgaggugauguauccccaucuuauggaaggcuuccugccuuuuucuaaccucgugacccaccuggacagcuuccugcccaucugccggguuaaugauuuugagacagcggacauucucuguccuaaggcuaaacgcaccuccagauuccugucugggaucauuaacuuuauccauuuccgggaggccugccgcgaaacauacauggaguuucuuuggcaauauaagagcuccgccgauaagaugcagcagcugaaugcugcccaccaggaagcucucaugaaacuggagagacuugacucugugccggucgaggaacaagaggaguucaagcagcugagcgauggcauucaggaacuccagcaaucccugaaccaggacuuucaccagaaaaccaucgugcugcaggaaggaaauagccaaaagaaaucuaacauuuccgagaagacaaagcggcucaaugagcugaaacuuagcguugugucucugaaggaaauccaggagucccucaaaaccaagaucgucgauagccccgaaaaacugaagaacuacaaagagaagaugaaggacacggugcagaaacuuaagaaugcccgccaagaaguggucgagaaauacgagauuuauggggauucuguugacugucugccuuccugccagcucgaagugcagcuguaccagaagaaaauccaagaucugagcgacaacagagagaagcucgcguccauucugaaggaaucucuuaaccuggaggaccagaucgaaagcgaugaguccgagcucaaaaagcugaaaaccgaagagaauagcuucaagcggcuuaugauugugaaaaaggaaaagcuggccacagcucaguuuaaaaucaacaagaaacaugaggacgucaagcaguauaaacgcaccgugaucgaggauuguaauaagguucaagaaaagagaggagccguguacgagcgggucacaaccauuaaccaggaaauccagaaaauuaagcucggcauccagcaacugaaagacgcugccgagcgcgaaaagcugaaaucucaggagauuuuccucaaucugaagacggcgcuugagaaauaucacgauggcaucgaaaaggccgcugaggacuccuacgccaagaucgaugagaaaacagcugaacugaagagaaaaauguucaagaugagcaccuga

SEQ ID NO: 2911 - protein, 180 aa, Artificial Sequence
  NY-ESO-1__Homo_sapiens__P78358
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 2912 - RNA, 543 nt, Artificial Sequence
  NY-ESO-1__Homo_sapiens__AAB49693
augcaggccgaaggccggggcacaggggguucgacgggcgaugcugauggcccaggaggcccuggcauuccugauggcccagggggcaaugcuggcggcccaggagaggcgggugccacgggcggcagagguccccggggcgcaggggcagcaagggccucggggccgggaggaggcgccccgcgggguccgcauggcggcgcggcuucagggcugaauggaugcugcagaugcggggccagggggccggagagccgccugcuugaguucuaccucgccaugccuuucgcgacacccauggaagcagagcuggcccgcaggagccuggcccaggaugccccaccgcuucccgugccaggggugcuucugaaggaguucacuguguccggcaacauacugacuauccgacugacugcugcagaccaccgccaacugcagcucuccaucagcuccugucuccagcagcuuucccuguugauguggaucacgcagugcuuucugcccguguuuuuggcucagccucccucagggcagaggcgcuaa

SEQ ID NO: 2913 - RNA, 543 nt, Artificial Sequence
  derived and/or modified sequence opt1 from NY-ESO-1__Homo_sapiens__AAB49693
augcaggccgagggccgcgggaccggcgggagcaccggcgacgccgacgggcccggcggcccggggauccccgacggccccgggggcaacgccgggggccccggcgaggccggggccacgggcgggcggggcccgcgcggcgccggggccgcgcgggccuccggccccgggggcggggcgccccgcggcccccacggcggggccgcgagcggccugaacgggugcugccggugcggcgcccgcgggccggagucccggcuccuggaguucuaccuggccaugcccuucgccacccccauggaggccgagcucgcgcgccggagccuggcccaggacgcgcccccgcugcccgugcccggcguccuccugaaggaguucaccguguccggcaacauccugaccauccgccucacggccgccgaccaccggcagcugcagcugagcaucuccagcugccuccagcagcugucccugcucauguggaucacccagugcuuccugcccguguuccuggcccagccgcccagcgggcagcgccgguga

SEQ ID NO: 2914 - RNA, 543 nt, Artificial Sequence
  derived and/or modified sequence opt2 from NY-ESO-1__Homo_sapiens__AAB49693
augcaggccgagggccgcggcaccggcggcuccaccggcgacgccgacggccccggcggccccggcauccccgacggccccggcggcaacgccggcggccccggcgaggccggcgccaccggcggccgcggcccccgcggcgccggcgccgcccgcgccuccggccccggcggcggcgccccccgcggcccccacggcggcgccgccuccggccucaacggcugcugccgcugcggcgcccgcggccccgagucccgccuccucgaguucuaccucgccaugcccuucgccacccccauggaggccgagcucgcccgccgcucccucgcccaggacgcccccccccuccccguccccggcguccuccucaaggaguucaccgucuccggcaacauccucaccauccgccucaccgccgccgaccaccgccagcuccagcucuccaucuccuccugccuccagcagcucucccuccucauguggaucacccagugcuuccuccccgucuuccucgcccagccccccuccggccagcgccgcuga

SEQ ID NO: 2915 - RNA, 543 nt, Artificial Sequence
  derived and/or modified sequence opt3 from NY-ESO-1__Homo_sapiens__AAB49693
augcaggccgagggcagagggaccggagguagcacaggcgacgcugaugggcccggaggcccugguaucccagacgggccgggaggcaacgcaggcgggcccggagaagccggugcgacuggcgggaggggaccucggggcgcuggugccgcacgcgccuccgggccaggaggcggcgcuccccgagggccucacggaggugcagccucuggccugaaugggugcugucguugcggagcuagaggcccagagucaaggcuccuugaguucuaccuggccaugcccuuugcgacgccuauggaagcagaauuggcccggcgcaguuuagcucaagaugccccaccgcugcccgugccugguguccuacucaaggaguucaccguuagcgggaacauucugacaauaagacuuacugcagcugaccauaggcagcugcaguuguccaucucuucgugucuccagcaacugucacugcucauguggauuacccagugcuuuuuaccaguguuccuggcccagcccccuagcggccagcggcgcuga

SEQ ID NO: 2916 - RNA, 543 nt, Artificial Sequence
  derived and/or modified sequence opt4 from NY-ESO-1__Homo_sapiens__AAB49693
augcaggccgagggcagaggcaccggcggcagcaccggcgacgccgacggccccggcggccccggcauccccgacggccccggcggcaacgccggcggccccggcgaggccggcgccaccggcggcagaggccccagaggcgccggcgccgccagagccagcggccccggcggcggcgcccccagaggcccccacggcggcgccgccagcggccugaacggcugcugcagaugcggcgccagaggccccgagagcagacugcuggaguucuaccuggccaugcccuucgccacccccauggaggccgagcuggccagaagaagccuggcccaggacgcccccccccugcccgugcccggcgugcugcugaaggaguucaccgugagcggcaacauccugaccaucagacugaccgccgccgaccacagacagcugcagcugagcaucagcagcugccugcagcagcugagccugcugauguggaucacccagugcuuccugcccguguuccuggcccagccccccagcggccagagaagauga

SEQ ID NO: 2917 - RNA, 543 nt, Artificial Sequence
  derived and/or modified sequence opt5 from NY-ESO-1__Homo_sapiens__AAB49693
augcaggccgagggcagagggaccggaggcagcacaggggacgcugauggacccggcgggccuggaaucccggacggccccggcgggaacgccggaggcccuggggaagcgggagcuacgggcgggcggggaccccgcggcgccggcgccgcuagagccuccgggccuggaggcggggcuccccggggaccucacggcggggccgcgucuggacugaauggcugcugucgcugcggcgccagagggccggagagccggcuccuggaguucuaccuugcuaugcccuuugccaccccuauggaagcugaacuggcccgcagaucccucgcgcaagaugcucccccucugcccgugccgggaguccuucugaaggaguucacaguuucuggcaacauucucaccauccggcugacagccgccgaccaucgccagcugcagcucagcauuuccucuugucugcagcaacuuagccugcucauguggaucacccagugcuuucugccuguguuccuugcucagcccccuuccgggcagagacgguga

SEQ ID NO: 2918 - protein, 404 aa, Artificial Sequence
  OA1__Homo_sapiens__P51810
MASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 2919 - RNA, 1215 nt, Artificial Sequence
  OA1__Homo_sapiens__CCDS14134.2
auggccuccccgcgccuagggaccuucugcugccccacgcgggacgcagccacgcagcucgugcugagcuuccagccgcgggccuuccacgcgcucugccugggcagcggcgggcuccgcuuggcgcugggccuucugcagcugcugcccggccgccggcccgcgggccccgggucccccgcgacguccccgccggccucgguccgcauccugcgcgcugccgcugccugcgaccuucucggcugccuggguauggugauccgguccaccgugugguuaggauucccaaauuuuguugacagcgucucggauaugaaccacacggaaauuuggccugcugcuuucugcguggggagugcgauguggauccagcuguuguacagugccugcuucugguggcuguuuugcuaugcaguggaugcuuaucuggugauccggagaucggcaggacugagcaccauccugcuguaucacaucauggcguggggccuggccacccugcucuguguggagggagccgccaugcucuacuacccuuccguguccaggugugagcggggccuggaccacgccaucccccacuaugucaccauguaccugccccugcugcugguucucguggcgaaccccauccuguuccaaaagacagugacugcaguggccucuuuacuuaaaggaagacaaggcauuuacacggagaacgagaggaggaugggagccgugaucaagauccgauuuuucaaaaucaugcugguuuuaauuauuuguugguugucgaauaucaucaaugaaagccuuuuauucuaucuugagaugcaaacagauaucaauggagguucuuugaaaccugucagaacugcagccaagaccacaugguuuauuaugggaauccugaauccagcccagggauuucucuugucuuuggccuucuacggcuggacaggaugcagccuggguuuucagucucccaggaaggagauccagugggaaucacugaccaccucggcugcugagggggcucacccauccccacugaugccccaugaaaacccugcuuccgggaaggugucucaagugggugggcagacuucugacgaagcccugagcaugcugucugaagguucugaugccagcacaauugaaauucacacugcaagugaauccugcaacaaaaaugagggugacccugcucucccaacccauggagaccuauga

SEQ ID NO: 2920 - RNA, 1215 nt, Artificial Sequence
  derived and/or modified sequence opt1 from OA1__Homo_sapiens__CCDS14134.2
auggccagcccccgccugggcaccuucugcugcccgacccgggacgccgcgacgcagcucgugcuguccuuccagccccgcgccuuccacgcccugugccucgggagcggcgggcugcggcuggcccucggccugcugcagcuccugcccgggcgccggcccgccggcccgggcucccccgcgaccagcccgcccgccuccguccgcauccugcgggccgccgcggccugcgaccuccuggggugccugggcauggugauccgcagcaccguguggcucggguuccccaacuucgucgacuccgugagcgacaugaaccacaccgagaucuggcccgccgccuucugcgugggcuccgccauguggauccagcugcuguacagcgcgugcuucugguggcuguucugcuacgccgucgacgccuaccucgugauccggcgcuccgccgggcugagcacgauccuccuguaccacaucauggccuggggccuggcgacccuccugugcguggagggcgccgccaugcuguacuaccccuccgucagccggugcgagcgcgggcucgaccacgccaucccccacuacgugaccauguaccugccgcugcuccuggugcuggucgccaaccccauccucuuccagaagaccgugacggcgguggccucccugcugaagggccggcaggggaucuacaccgagaacgagcgccggaugggcgccgucaucaagauccgcuucuucaagaucaugcucgugcugaucaucugcuggcugagcaacaucaucaacgagucccuccuguucuaccuggagaugcagaccgacaucaacggcgggagccucaagcccgugcggaccgccgccaagacgaccugguucaucaugggcauccugaaccccgcgcagggguuccugcucucccuggccuucuacggcuggaccgggugcagccugggcuuccagagcccgcgcaaggagauccagugggagucccucaccacgagcgccgccgagggcgcgcaccccagcccccugaugccccacgagaacccggccuccgggaaggucucccaggugggcgggcagaccagcgacgaggcccuguccaugcugagcgagggcuccgacgccagcaccaucgagauccacaccgccuccgagagcugcaacaagaacgagggggaccccgcgcuccccacgcacggcgaccuguga

SEQ ID NO: 2921 - RNA, 1215 nt, Artificial Sequence
  derived and/or modified sequence opt2 from OA1__Homo_sapiens__CCDS14134.2
auggccuccccccgccucggcaccuucugcugccccacccgcgacgccgccacccagcucguccucuccuuccagccccgcgccuuccacgcccucugccucggcuccggcggccuccgccucgcccucggccuccuccagcuccuccccggccgccgccccgccggccccggcucccccgccaccuccccccccgccuccguccgcauccuccgcgccgccgccgccugcgaccuccucggcugccucggcauggucauccgcuccaccgucuggcucggcuuccccaacuucgucgacuccgucuccgacaugaaccacaccgagaucuggcccgccgccuucugcgucggcuccgccauguggauccagcuccucuacuccgccugcuucugguggcucuucugcuacgccgucgacgccuaccucgucauccgccgcuccgccggccucuccaccauccuccucuaccacaucauggccuggggccucgccacccuccucugcgucgagggcgccgccaugcucuacuaccccuccgucucccgcugcgagcgcggccucgaccacgccaucccccacuacgucaccauguaccucccccuccuccucguccucgucgccaaccccauccucuuccagaagaccgucaccgccgucgccucccuccucaagggccgccagggcaucuacaccgagaacgagcgccgcaugggcgccgucaucaagauccgcuucuucaagaucaugcucguccucaucaucugcuggcucuccaacaucaucaacgagucccuccucuucuaccucgagaugcagaccgacaucaacggcggcucccucaagcccguccgcaccgccgccaagaccaccugguucaucaugggcauccucaaccccgcccagggcuuccuccucucccucgccuucuacggcuggaccggcugcucccucggcuuccaguccccccgcaaggagauccagugggagucccucaccaccuccgccgccgagggcgcccaccccuccccccucaugccccacgagaaccccgccuccggcaaggucucccaggucggcggccagaccuccgacgaggcccucuccaugcucuccgagggcuccgacgccuccaccaucgagauccacaccgccuccgaguccugcaacaagaacgagggcgaccccgcccuccccacccacggcgaccucuga

SEQ ID NO: 2922 - RNA, 1215 nt, Artificial Sequence
  derived and/or modified sequence opt3 from OA1__Homo_sapiens__CCDS14134.2
auggccagccccagacugggcaccuucugcuguccuacaagggacgcugcaacucagcucgugcuuuccuuucaaccacgggccuuccacgcgcugugcuuggggucuggagguuuacgccuggcucuaggccuccugcagcuucugccggggcgacgucccgccggaccuggcucaccagcaacgagucccccugccagcgucagaaucuugagggcugcagccgcuugugaucuccuggguugccuggggaugguuauucgguccaccguguggcucggauuuccaaacuucguagacucugugucggauaugaaucauacagagauauggcccgccgcguuuugugucggcucagcaauguggauccaguuacuguacagcgccugcuucuggugguuguuuuguuaugcuguggacgccuaccuuguuauucgcagaagugcaggccuguccacuauccuacucuaucacauuauggcuugggggcuggccacccuucugugcguggaaggagcggccauguuguacuauccuucugucuccaggugugagcggggucucgaucaugcaaucccacacuacgugacaauguaucugccguuacugcucguacuuguugcuaaccccauacuguuccagaagaccgugacugccgucgcuagcuugcuaaaaggccgccaagggaucuacacagaaaaugagcgaagaaugggagccgugauuaagaucagguuuuucaaaauuaugcuggugcucaucauaugcuggcugucaaacauuaucaaugaaagucuucuguuuuacuuggagaugcagaccgacauuaacggcgguagccucaagccuguccggacggcagccaaaacuaccugguucaucauggggauccugaauccagcucagggauuuuuacugucucuagcguucuauggcuggacaggcuguucccucggguuccagucaccccguaaggagauucaaugggaaagccugacuaccagugcagccgagggagcucauccuucuccacuuaugccccacgaaaacccggccuccgguaagguuagccaggugggcgggcagacaucggaugaggcauugucuaugcuguccgagggaucagacgccaguaccauagaaauccacacggcuagcgaguccugcaauaaaaacgaaggcgauccugcccuccccacucauggugaccuguga

SEQ ID NO: 2923 - RNA, 1215 nt, Artificial Sequence
  derived and/or modified sequence opt4 from OA1__Homo_sapiens__CCDS14134.2
auggccagccccagacugggcaccuucugcugccccaccagagacgccgccacccagcuggugcugagcuuccagcccagagccuuccacgcccugugccugggcagcggcggccugagacuggcccugggccugcugcagcugcugcccggcagaagacccgccggccccggcagccccgccaccagcccccccgccagcgugagaauccugagagccgccgccgccugcgaccugcugggcugccugggcauggugaucagaagcaccguguggcugggcuuccccaacuucguggacagcgugagcgacaugaaccacaccgagaucuggcccgccgccuucugcgugggcagcgccauguggauccagcugcuguacagcgccugcuucugguggcuguucugcuacgccguggacgccuaccuggugaucagaagaagcgccggccugagcaccauccugcuguaccacaucauggccuggggccuggccacccugcugugcguggagggcgccgccaugcuguacuaccccagcgugagcagaugcgagagaggccuggaccacgccaucccccacuacgugaccauguaccugccccugcugcuggugcugguggccaaccccauccuguuccagaagaccgugaccgccguggccagccugcugaagggcagacagggcaucuacaccgagaacgagagaagaaugggcgccgugaucaagaucagauucuucaagaucaugcuggugcugaucaucugcuggcugagcaacaucaucaacgagagccugcuguucuaccuggagaugcagaccgacaucaacggcggcagccugaagcccgugagaaccgccgccaagaccaccugguucaucaugggcauccugaaccccgcccagggcuuccugcugagccuggccuucuacggcuggaccggcugcagccugggcuuccagagccccagaaaggagauccagugggagagccugaccaccagcgccgccgagggcgcccaccccagcccccugaugccccacgagaaccccgccagcggcaaggugagccaggugggcggccagaccagcgacgaggcccugagcaugcugagcgagggcagcgacgccagcaccaucgagauccacaccgccagcgagagcugcaacaagaacgagggcgaccccgcccugcccacccacggcgaccuguga

SEQ ID NO: 2924 - RNA, 1215 nt, Artificial Sequence
  derived and/or modified sequence opt5 from OA1__Homo_sapiens__CCDS14134.2
auggccagccccagacugggcaccuucugcuguccuacacgggacgcugccacgcagcucgugcuguccuuucaaccgcgcgcguuccacgcucuuugccuggggucuggaggccucagacuggcccuugggcugcuccagcugcugcccggacggcgcccugccggccccgggagcccugcuaccucucccccugccuccgucagaauccuccgggcugccgcggccugugaucugcuuggaugccugggcaugguuauucgcagcacaguguggcucggcuuuccgaacuucguggacuccgucucugauaugaaucauaccgagaucuggcccgcugccuuuuguguggggagcgcuauguggauucagcugcuuuacuccgccugcuucugguggcuguuuuguuaugcgguugacgccuaccucgugaucagacggagcgcuggacugucuacaauucugcucuaucacaucauggccuggggccuggcuacccuucugugcgucgaaggggccgccaugcucuacuauccuuccgugagccgcugugagagaggacuggaucaugcuaucccccacuacguuacaauguaucuuccucugcuccuggugcuggucgcgaaccccauucucuuccagaagaccgugacggccguggcuucucugcuuaaaggccggcaagggaucuacaccgaaaaugagcgcagaaugggagccgucauuaagauccgguuuuucaaaauuaugcugguucucaucauuugcuggcuguccaacaucaucaaugaaagccuucuguuuuaccucgagaugcagacagacauuaacggcggcucucugaagccggugcgcaccgccgcuaaaacaaccugguucaucauggggauucugaauccugcccagggauuucuccugucccuugcguucuauggcuggacgggguguagccugggauuccagucccccagaaaggagauccaaugggaaucucucacaaccagcgcugccgagggcgcccauccuagcccccugaugccccacgaaaacccugcuuccgggaaggugucucaggucggaggccagacauccgaugaggcccugagcaugcuuucugagggcagcgacgcuuccaccauugaaauccacaccgccucugagagcugcaauaaaaacgaaggggauccggcgcuccccacacauggagaccuguga

SEQ ID NO: 2925 - protein, 1046 aa, Artificial Sequence
  OGT__Homo_sapiens__O15294
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 2926 - RNA, 3141 nt, Artificial Sequence
  OGT__Homo_sapiens__AAH38180
auggcgucuuccgugggcaacguggccgacagcacagaaccaacgaaacguaugcuuuccuuccaaggguuagcugaguuggcacaucgagaauaucaggcaggagauuuugaggcagcugagagacacugcaugcagcucuggagacaagagccagacaauacuggugugcuuuuauuacuuucaucuauacacuuccagugucgaaggcuggacagaucugcucacuuuagcacucuggcaauuaaacagaacccccuucuggcagaagcuuauucgaauuuggggaauguguacaaggaaagagggcaguugcaggaggcaauugagcauuaucgacaugcauugcgucucaaaccugauuucaucgaugguuauauuaaccuggcagccgccuugguagcagcgggugacauggaaggggcaguacaagcuuacgucucugcucuucaguacaauccugauuuguacuguguucgcagugaccuggggaaccugcucaaagcccugggucgcuuggaagaagccaaggcauguuauuugaaagcaauugagacgcaaccgaacuuugcaguagcuuggaguaaucuuggcuguguuuucaaugcacaaggggaaauuuggcuugcaauucaucacuuugaaaaggcugucacccuugacccaaacuuucuggaugcuuauaucaauuuaggaaaugucuugaaagaggcacgcauuuuugacagagcuguggcagcuuaucuucgugcccuaaguuugaguccaaaucacgcaguggugcacggcaaccuggcuuguguauacuaugagcaaggccugauagaucuggcaauagacaccuacaggcgggcuaucgaacuacaaccacauuucccugaugcuuacugcaaccuagccaaugcucucaaagagaagggcaguguugcugaagcagaagauuguuauaauacagcucuccgucugugucccacccaugcagacucucugaauaaccuagccaauaucaaacgagaacagggaaacauugaagaggcaguucgcuuguaucguaaagcauuagaagucuucccagaguuugcugcugcccauucaaauuuagcaaguguacugcagcagcagggaaaacugcaggaagcucugaugcauuauaaggaggcuauucgaaucaguccuaccuuugcugaugccuacucuaauaugggaaacacucuaaaggagaugcaggauguucagggagccuugcaguguuauacgcgugccauccaaauuaauccugcauuugcagaugcacauagcaaucuggcuuccauucauaaggauucagggaauauuccagaagccauagcuucuuaccgcacggcucugaaacuuaagccugauuuuccugaugcuuauuguaacuuggcucauugccugcagauugucugugauuggacagacuaugaugagcgaaugaagaaguuggucaguauuguggcugaccaguuagagaagaauagguugccuucugugcauccucaucauaguaugcuauauccucuuucucauggcuucaggaaggcuauugcugagaggcacggcaaccugugcuuagauaagauuaauguucuucauaaaccaccauaugaacauccaaaagacuugaagcucagugauggucggcugcguguaggauaugugaguuccgacuuugggaaucauccuacuucucaccuuaugcagucuauuccaggcaugcacaauccugauaaauuugagguguucuguuaugcccugagcccagacgauggcacaaacuuccgagugaaggugauggcagaagccaaucauuucauugaucuuucucagauuccaugcaauggaaaagcagcugaucgcauccaucaggauggaauucauauccuuguaaauaugaauggcuauacuaagggcgcucgaaaugagcuuuuugcucucaggccagcuccuauucaggcaauguggcugggauacccugggacgaguggugcgcuuuucauggauuauauuaucacugaucaggaaacuucgccagcugaaguugcugagcaguauuccgagaaauuggcuuauaugccccacacuuuuuuuauuggugaucaugcuaauauguucccucaccugaagaaaaaagcagucaucgauuuuaaguccaaugggcacauuuaugacaaucggauaguucugaauggcaucgaccucaaagcauuucuugauagucuaccagaugugaaaauugucaagaugaaguguccugauggaggagacaaugcagauagcaguaacacagcucuuaauaugccuguuauuccuaugaauacuauugcagaagcaguuauugaaaugauuaaccgaggacagauucaaauaacaauuaauggauucaguauuagcaauggacuggcaacuacucagaucaacaauaaggcugcaacuggagaggagguuccccguaccauuauuguaaccacccguucucaguacggguuaccagaagaugccaucguauacuguaacuuuaaucaguuguauaaaauugacccuucuacuuugcagaugugggcaaacauucugaagcguguucccaauaguguacucuggcuguugcguuuuccagcaguaggagaaccuaauauucaacaguaugcacaaaacaugggccugccccagaaccguaucauuuuuucaccuguugcuccuaaagaggaacacgucaggagaggccagcuggcugaugucugcuuggacacuccacucuguaaugggcacaccacagggauggauguccucugggcagggacccccauggugacuaugccaggagagacucuugcuucucgaguugcagcaucccagcucacuugcuuagguugucuugagcuuauugcuaaaaacagacaagaauaugaagacauagcugugaagcugggaacugaucuagaauaccugaagaaaguucguggcaaagucuggaagcaaagaauaucuagcccucuguucaacaccaaacaauacacaauggaacuagagcggcucuaucuacagaugugggagcauuaugcagcuggcaacaaaccugaccacaugauuaagccuguugaagucacugagucagcauaa

SEQ ID NO: 2927 - RNA, 3141 nt, Artificial Sequence
  derived and/or modified sequence opt1 from OGT__Homo_sapiens__AAH38180
auggccagcuccgugggcaacgucgccgacagcaccgagcccaccaagcgcaugcuguccuuccaggggcucgcggagcuggcccaccgggaguaccaggccggcgacuucgaggccgccgagcgccacugcaugcagcuguggcggcaggagccggacaacacgggggugcuccugcugcucagcuccauccacuuccagugccgccggcuggaccgcagcgcgcacuucuccacccuggccaucaagcagaacccccuccuggccgaggccuacagcaaccugggcaacguguacaaggagcgggggcagcuccaggaggcgaucgagcacuaccgccacgcccugcggcugaagcccgacuucaucgacggcuacaucaaccucgccgccgcccuggucgcggccggcgacauggagggggccgugcaggccuacguguccgcccugcaguacaaccccgaccucuacugcguccgcagcgaccugggcaaccugcucaaggcgcuggggcggcuggaggaggccaaggccugcuaccucaaggccaucgagacccagccgaacuucgccguggcgugguccaaccugggcugcguguucaacgcccagggggagaucuggcuggccauccaccacuucgagaaggccgucacccucgaccccaacuuccuggacgccuacaucaaccugggcaacgugcucaaggaggcgcgcaucuucgaccgggccguggccgccuaccugcgcgcgcugagccucucccccaaccacgccgucgugcacggcaaccuggccugcguguacuacgagcaggggcugaucgaccucgccaucgacacguaccggcgcgccaucgagcugcagccccacuucccggacgcguacugcaaccuggccaacgcccucaaggagaagggcagcgucgccgaggccgaggacugcuacaacaccgcgcugcggcugugccccacccacgccgacucccucaacaaccuggccaacaucaagcgcgagcaggggaacaucgaggaggccgugcggcuguaccgcaaggcccucgagguguuccccgaguucgcggccgcccacagcaaccuggccuccguccugcagcagcagggcaagcuccaggaggcgcugaugcacuacaaggaggccauccggaucagccccaccuucgccgacgccuacuccaacaugggcaacacgcugaaggagaugcaggacgugcagggggcccugcagugcuacacccgcgcgauccagaucaacccggccuucgccgacgcccacagcaaccucgccagcauccacaaggacuccggcaacauccccgaggcgaucgccagcuaccgcaccgcccugaagcugaagcccgacuuccccgacgccuacugcaaccucgcccacugccugcagaucgugugcgacuggaccgacuacgacgagcggaugaagaagcuggucuccaucguggcggaccagcucgagaagaaccgccugccgagcgugcacccccaccacuccaugcuguacccccucagccacggguuccggaaggccaucgccgagcgccacggcaaccugugccuggacaagaucaacguccuccacaagcccccguacgagcaccccaaggaccugaagcuguccgacgggcggcuccgcgugggcuacgucagcuccgacuucggcaaccaccccacgagccaccugaugcaguccauccccgggaugcacaacccggacaaguucgagguguucugcuacgcccugagccccgacgacggcaccaacuuccgggugaaggucauggcggaggccaaccacuucaucgaccucucccagauccccugcaacgggaaggccgccgaccgcauccaccaggacggcauccacauccuggugaacaugaacggguacaccaagggcgcccggaacgagcuguucgcgcuccgccccgccccgauccaggccauguggcugggcuaccccgggaccagcggcgcccuguucauggacuacaucaucacggaccaggagaccucccccgccgagguggcggagcaguacagcgagaagcucgccuacaugccgcacaccuucuucaucggggaccacgccaacauguucccccaccugaagaagaaggccgucaucgacuucaaguccaacggccacaucuacgacaaccggaucgugcugaacgggaucgaccucaaggccuuccuggacagccugcccgacgugaagaucgucaagaugaagugccccgacggcggcgacaacgcggacuccagcaacaccgcccucaacaugccggugauccccaugaacacgaucgccgaggccgugaucgagaugaucaaccgcgggcagauccagaucaccaucaacggcuucagcaucuccaacgggcuggccaccacccagaucaacaacaaggcggccacgggcgaggaggucccccggaccaucaucgugaccacccgcagccaguacggccugcccgaggacgccaucguguacugcaacuucaaccagcucuacaagaucgacccguccacgcugcagaugugggccaacauccugaagcggguccccaacagcgugcucuggcugcugcgcuuccccgcggugggggagcccaacauccagcaguacgcccagaacaugggccucccgcagaaccggaucaucuucucccccgucgcccccaaggaggagcacgugcgccgggggcagcuggccgacgugugccuggacacgccccucugcaacggccacaccaccgggauggacguccugugggccggcaccccgauggugaccaugcccggcgagacccuggcgagccgcguggccgccucccagcugaccugccucgggugccuggagcucaucgccaagaaccgccaggaguacgaggacaucgccgucaagcugggcacggaccuggaguaccucaagaaggugcgggggaagguguggaagcagcgcaucagcagcccccuguucaacaccaagcaguacaccauggagcuggagcggcucuaccugcagaugugggagcacuacgcggccggcaacaagcccgaccacaugaucaagccggucgaggugaccgaguccgccuga

SEQ ID NO: 2928 - RNA, 3141 nt, Artificial Sequence
  derived and/or modified sequence opt2 from OGT__Homo_sapiens__AAH38180
auggccuccuccgucggcaacgucgccgacuccaccgagcccaccaagcgcaugcucuccuuccagggccucgccgagcucgcccaccgcgaguaccaggccggcgacuucgaggccgccgagcgccacugcaugcagcucuggcgccaggagcccgacaacaccggcguccuccuccuccucuccuccauccacuuccagugccgccgccucgaccgcuccgcccacuucuccacccucgccaucaagcagaacccccuccucgccgaggccuacuccaaccucggcaacgucuacaaggagcgcggccagcuccaggaggccaucgagcacuaccgccacgcccuccgccucaagcccgacuucaucgacggcuacaucaaccucgccgccgcccucgucgccgccggcgacauggagggcgccguccaggccuacgucuccgcccuccaguacaaccccgaccucuacugcguccgcuccgaccucggcaaccuccucaaggcccucggccgccucgaggaggccaaggccugcuaccucaaggccaucgagacccagcccaacuucgccgucgccugguccaaccucggcugcgucuucaacgcccagggcgagaucuggcucgccauccaccacuucgagaaggccgucacccucgaccccaacuuccucgacgccuacaucaaccucggcaacguccucaaggaggcccgcaucuucgaccgcgccgucgccgccuaccuccgcgcccucucccucucccccaaccacgccgucguccacggcaaccucgccugcgucuacuacgagcagggccucaucgaccucgccaucgacaccuaccgccgcgccaucgagcuccagccccacuuccccgacgccuacugcaaccucgccaacgcccucaaggagaagggcuccgucgccgaggccgaggacugcuacaacaccgcccuccgccucugccccacccacgccgacucccucaacaaccucgccaacaucaagcgcgagcagggcaacaucgaggaggccguccgccucuaccgcaaggcccucgaggucuuccccgaguucgccgccgcccacuccaaccucgccuccguccuccagcagcagggcaagcuccaggaggcccucaugcacuacaaggaggccauccgcaucucccccaccuucgccgacgccuacuccaacaugggcaacacccucaaggagaugcaggacguccagggcgcccuccagugcuacacccgcgccauccagaucaaccccgccuucgccgacgcccacuccaaccucgccuccauccacaaggacuccggcaacauccccgaggccaucgccuccuaccgcaccgcccucaagcucaagcccgacuuccccgacgccuacugcaaccucgcccacugccuccagaucgucugcgacuggaccgacuacgacgagcgcaugaagaagcucgucuccaucgucgccgaccagcucgagaagaaccgccuccccuccguccacccccaccacuccaugcucuacccccucucccacggcuuccgcaaggccaucgccgagcgccacggcaaccucugccucgacaagaucaacguccuccacaagccccccuacgagcaccccaaggaccucaagcucuccgacggccgccuccgcgucggcuacgucuccuccgacuucggcaaccaccccaccucccaccucaugcaguccauccccggcaugcacaaccccgacaaguucgaggucuucugcuacgcccucucccccgacgacggcaccaacuuccgcgucaaggucauggccgaggccaaccacuucaucgaccucucccagauccccugcaacggcaaggccgccgaccgcauccaccaggacggcauccacauccucgucaacaugaacggcuacaccaagggcgcccgcaacgagcucuucgcccuccgccccgcccccauccaggccauguggcucggcuaccccggcaccuccggcgcccucuucauggacuacaucaucaccgaccaggagaccucccccgccgaggucgccgagcaguacuccgagaagcucgccuacaugccccacaccuucuucaucggcgaccacgccaacauguucccccaccucaagaagaaggccgucaucgacuucaaguccaacggccacaucuacgacaaccgcaucguccucaacggcaucgaccucaaggccuuccucgacucccuccccgacgucaagaucgucaagaugaagugccccgacggcggcgacaacgccgacuccuccaacaccgcccucaacaugcccgucauccccaugaacaccaucgccgaggccgucaucgagaugaucaaccgcggccagauccagaucaccaucaacggcuucuccaucuccaacggccucgccaccacccagaucaacaacaaggccgccaccggcgaggaggucccccgcaccaucaucgucaccacccgcucccaguacggccuccccgaggacgccaucgucuacugcaacuucaaccagcucuacaagaucgaccccuccacccuccagaugugggccaacauccucaagcgcguccccaacuccguccucuggcuccuccgcuuccccgccgucggcgagcccaacauccagcaguacgcccagaacaugggccucccccagaaccgcaucaucuucucccccgucgcccccaaggaggagcacguccgccgcggccagcucgccgacgucugccucgacaccccccucugcaacggccacaccaccggcauggacguccucugggccggcacccccauggucaccaugcccggcgagacccucgccucccgcgucgccgccucccagcucaccugccucggcugccucgagcucaucgccaagaaccgccaggaguacgaggacaucgccgucaagcucggcaccgaccucgaguaccucaagaagguccgcggcaaggucuggaagcagcgcaucuccuccccccucuucaacaccaagcaguacaccauggagcucgagcgccucuaccuccagaugugggagcacuacgccgccggcaacaagcccgaccacaugaucaagcccgucgaggucaccgaguccgccuga

SEQ ID NO: 2929 - RNA, 3141 nt, Artificial Sequence
  derived and/or modified sequence opt3 from OGT__Homo_sapiens__AAH38180
auggccagcuccgugggcaacgucgcugacucuaccgagcccacaaagagaaugcugucauuccaggggcucgcagaacuugcccacagggaguaccaagcgggagauuuugaagcugccgagcggcauugcaugcagcuguggcgccaggaaccugacaauacugguguuuuguuacugcuaaguagcauccacuuccagugucgacgucucgauagauccgcacauuuuucuacgcuggccauuaaacaaaacccacuucuggcugaggcauauucgaauuugggcaacguguacaaggagagggggcagcuccaggaagccauagagcacuaucggcaugcucugcgccugaaaccggacuucaucgauggauacauuaaucucgccgcggcauuaguagccgcuggcgacauggaaggugccgugcaggcauaugucucagcucugcaauacaaccccgaucuuuauugcgugagaagcgacuuggggaaucugcuaaaggcccucggaaggcuggaggaggcgaaagccuguuaccuuaaggcaaucgaaacccagccuaacuuugcuguugccuggaguaaucugggcugcguguucaacgcucagggcgagauuugguuggccauccaccacuuugaaaaggcagucacacucgauccaaauuuccuggacgccuacauaaacuuagggaaugugcugaaagaggcucggaucuuugaucgcgcgguagcagccuaucuccgagcucuuucccugucucccaaccaugccguugugcacggaaauuuggcaugugucuacuaugaacagggucuaauugaccuggccaucgauacuuacagaagggcuauugagcuccaaccucauuucccagacgccuauugcaaccuggcaaacgcgcuuaaggagaaaggcagcguggcugaagccgaggacuguuacaauaccgcacugcgguugugccccacacacgccgauucccucaacaaucuggcuaacaucaagcgugaacaggggaauauagaggaagccgugcgcuuauauagaaaagcacuggaggucuuuccugaguucgcugccgcgcacucaaaccuagccaguguucuccagcaacagggaaagcugcaggaagcucuuaugcauuacaaggaggcaauuaggaucagcccaaccuuugccgacgcuuacucuaauaugggcaacacuuugaaagaaaugcaggaugugcaaggugcccugcaguguuauacacgggcaauucagaucaauccggcguucgccgacgcucacuccaaccucgccucaauccauaaggauagcgggaauauucccgaggcaauagcuaguuaccgaaccgcccugaaacuuaagccugacuucccagaugcauauugcaaccuggcccacuguuugcagaucguaugcgacuggacggauuacgacgaacgcaugaaaaagcucgugucuauugucgcugaucaacuggagaaaaauagauuacccuccgugcauccucaccacagcaugcuguauccacuaucgcauggauuuaggaaggcgaucgccgagcggcacggcaaccucugccuggacaagauaaauguucuucauaaacccccguacgaacacccuaaggacuugaaacugucugauggccgccucagagugggguaugucuccucagacuucggaaaccaccccaccagucaucugaugcagagcauuccagguaugcacaacccugauaaguuugagguguucuguuacgcauuaucccccgacgauggcacuaauuuuaggguaaaaguuauggcugaagccaaccauuucaucgaccugucucagaucccaugcaaugggaaggccgcugaucguauucaccaggacggaauccauauucuugugaacaugaauggcuacacaaagggugcacggaacgaguuguuugcccuccgacccgcgccuauacaagcuauguggcugggguauccaggcacuagcggagcccuauucauggauuacaucauuaccgaccaggagacaucaccggcagaagucgccgagcaguauagugaaaaacuggcuuacaugccccacaccuuuuucaucggcgaucacgcaaauauguuuccucaucucaagaaaaaggccgugaucgacuucaaauccaacgggcacauuuaugauaauagaauaguccugaacggaaucgaccuuaaggcguuuuuggacagccugccagaugugaagauuguuaaaaugaagugucccgacgguggcgauaaugcugacucuucaaacacggccuuaaauaugccugugaucccaaugaacacuauugcagaggccguaaucgaaaugauaaauagggggcagauccaaauuacaaucaacggauucaguauuagcaacggccucgcuaccacucagaucaauaacaaagccgcaacaggugaggaggucccccgcaccauaauugugacgacccggucccaguacgggcugccggaagaugcuaucguuuauugcaauuucaaccaacuuuacaagauugacccuucuacacugcagaugugggccaauaucuugaaaagagugccaaacucgguccucuggcugcuaagguuucccgcggugggcgagccuaauauacagcaguacgcccaaaacaugggacugccccagaaucgcaucauuuucagcccaguagcaccuaaggaggaacaugugcgacggggccagcucgcugauguuugucuggacacuccccuuugcaacgggcacaccacaggaauggaugucuugugggccgguacuccaauggugaccaugccgggcgaaacacuggcuucccguguggcagccucacaguuaaccugucucgggugccuggagcuuaucgccaagaauagacaagaguaugaagacauugcugucaaacugggaacugaucuagaguaccucaagaaaguuaggggcaagguguggaaacagcgcaucaguucuccucuguuuaacacgaagcaguauacaauggaauuggagcggcuguacuuacagaugugggaacauuaugcggcagguaauaaacccgaccacaugauaaagccaguggagguaaccgagagcgccuga

SEQ ID NO: 2930 - RNA, 3141 nt, Artificial Sequence
  derived and/or modified sequence opt4 from OGT__Homo_sapiens__AAH38180
auggccagcagcgugggcaacguggccgacagcaccgagcccaccaagagaaugcugagcuuccagggccuggccgagcuggcccacagagaguaccaggccggcgacuucgaggccgccgagagacacugcaugcagcuguggagacaggagcccgacaacaccggcgugcugcugcugcugagcagcauccacuuccagugcagaagacuggacagaagcgcccacuucagcacccuggccaucaagcagaacccccugcuggccgaggccuacagcaaccugggcaacguguacaaggagagaggccagcugcaggaggccaucgagcacuacagacacgcccugagacugaagcccgacuucaucgacggcuacaucaaccuggccgccgcccugguggccgccggcgacauggagggcgccgugcaggccuacgugagcgcccugcaguacaaccccgaccuguacugcgugagaagcgaccugggcaaccugcugaaggcccugggcagacuggaggaggccaaggccugcuaccugaaggccaucgagacccagcccaacuucgccguggccuggagcaaccugggcugcguguucaacgcccagggcgagaucuggcuggccauccaccacuucgagaaggccgugacccuggaccccaacuuccuggacgccuacaucaaccugggcaacgugcugaaggaggccagaaucuucgacagagccguggccgccuaccugagagcccugagccugagccccaaccacgccguggugcacggcaaccuggccugcguguacuacgagcagggccugaucgaccuggccaucgacaccuacagaagagccaucgagcugcagccccacuuccccgacgccuacugcaaccuggccaacgcccugaaggagaagggcagcguggccgaggccgaggacugcuacaacaccgcccugagacugugccccacccacgccgacagccugaacaaccuggccaacaucaagagagagcagggcaacaucgaggaggccgugagacuguacagaaaggcccuggagguguuccccgaguucgccgccgcccacagcaaccuggccagcgugcugcagcagcagggcaagcugcaggaggcccugaugcacuacaaggaggccaucagaaucagccccaccuucgccgacgccuacagcaacaugggcaacacccugaaggagaugcaggacgugcagggcgcccugcagugcuacaccagagccauccagaucaaccccgccuucgccgacgcccacagcaaccuggccagcauccacaaggacagcggcaacauccccgaggccaucgccagcuacagaaccgcccugaagcugaagcccgacuuccccgacgccuacugcaaccuggcccacugccugcagaucgugugcgacuggaccgacuacgacgagagaaugaagaagcuggugagcaucguggccgaccagcuggagaagaacagacugcccagcgugcacccccaccacagcaugcuguacccccugagccacggcuucagaaaggccaucgccgagagacacggcaaccugugccuggacaagaucaacgugcugcacaagccccccuacgagcaccccaaggaccugaagcugagcgacggcagacugagagugggcuacgugagcagcgacuucggcaaccaccccaccagccaccugaugcagagcauccccggcaugcacaaccccgacaaguucgagguguucugcuacgcccugagccccgacgacggcaccaacuucagagugaaggugauggccgaggccaaccacuucaucgaccugagccagauccccugcaacggcaaggccgccgacagaauccaccaggacggcauccacauccuggugaacaugaacggcuacaccaagggcgccagaaacgagcuguucgcccugagacccgcccccauccaggccauguggcugggcuaccccggcaccagcggcgcccuguucauggacuacaucaucaccgaccaggagaccagccccgccgagguggccgagcaguacagcgagaagcuggccuacaugccccacaccuucuucaucggcgaccacgccaacauguucccccaccugaagaagaaggccgugaucgacuucaagagcaacggccacaucuacgacaacagaaucgugcugaacggcaucgaccugaaggccuuccuggacagccugcccgacgugaagaucgugaagaugaagugccccgacggcggcgacaacgccgacagcagcaacaccgcccugaacaugcccgugauccccaugaacaccaucgccgaggccgugaucgagaugaucaacagaggccagauccagaucaccaucaacggcuucagcaucagcaacggccuggccaccacccagaucaacaacaaggccgccaccggcgaggaggugcccagaaccaucaucgugaccaccagaagccaguacggccugcccgaggacgccaucguguacugcaacuucaaccagcuguacaagaucgaccccagcacccugcagaugugggccaacauccugaagagagugcccaacagcgugcuguggcugcugagauuccccgccgugggcgagcccaacauccagcaguacgcccagaacaugggccugccccagaacagaaucaucuucagccccguggcccccaaggaggagcacgugagaagaggccagcuggccgacgugugccuggacaccccccugugcaacggccacaccaccggcauggacgugcugugggccggcacccccauggugaccaugcccggcgagacccuggccagcagaguggccgccagccagcugaccugccugggcugccuggagcugaucgccaagaacagacaggaguacgaggacaucgccgugaagcugggcaccgaccuggaguaccugaagaaggugagaggcaagguguggaagcagagaaucagcagcccccuguucaacaccaagcaguacaccauggagcuggagagacuguaccugcagaugugggagcacuacgccgccggcaacaagcccgaccacaugaucaagcccguggaggugaccgagagcgccuga

SEQ ID NO: 2931 - RNA, 3141 nt, Artificial Sequence
  derived and/or modified sequence opt5 from OGT__Homo_sapiens__AAH38180
auggccagcuccgugggcaacgucgcugacucuaccgagcccacaaagagaaugcugagcuuccaggggcucgccgaacuggcgcaccgggaguaccaagcuggagauuuugaagccgccgagcgccauugcaugcagcuuuggagacaggaaccugacaauacgggcguucugcuccugcuuuccucuauccacuuccagugucggcgccuggauagaagcgcucauuuuuccacccucgccauuaaacaaaacccgcugcuggcugaggccuauucuaaucucgggaacguguacaaggagcggggacagcugcaggaagcgaucgagcacuaucgccaugcccuuagacugaaacccgacuucauugauggcuacaucaaucucgcugccgcucugguggccgcgggggacauggaaggagccguccaggcuuaugugagcgcccuucaauacaacccugaucuguauugcguucgguccgaccucggcaaucugcugaaggcucucggccgccuggaggaggccaaagccuguuaccuuaaggcuauugaaacacagcccaacuuugcgguggccuggagcaaucuggggugcgucuucaacgcucagggagagaucuggcucgccauccaccacuuugaaaaggccgugacccuggauccuaauuuccuugacgcuuacauuaaccugggcaauguucucaaagaggccagaaucuuugaucgggcgguggcugccuaucugcgcgcccugucucucucccccaaccaugcugucgugcacgggaaucuggccuguguguacuaugaacagggacuuauugaccuggcuaucgauacauacagacgggccauugagcuccaaccucauuucccggacgcguauugcaaccuggccaacgcucuuaaggagaaaggcagcgucgccgaagcugaggacuguuacaauaccgcccugcgccucugccccacacacgcggauucucugaacaaucuggccaacaucaagagagaacaggggaauauugaggaagcuguucggcucuauagaaaagcccuggagguguuuccugaguucgcugccgcccacuccaaccuugcuagcgugcugcagcaacagggaaagcuccaggaagcgcugaugcauuacaaggaggccauccgcaucucucccaccuuugcugacgccuacuccaauaugggcaacacgcugaaagaaaugcaggauguccaaggcgcccuucaguguuauacccgggcuauucagaucaauccugccuucgcggacgcucacagcaaccucgccuccauucauaaggauucugggaauauccccgaggccauugcuagcuacagaacagcccugaaacugaagccggacuucccugaugcguauugcaaccucgcucacugucugcagaucgugugcgacuggaccgauuacgacgaacgcaugaaaaagcugguuuccaucguggccgaucaacuugagaaaaaucggcuccccagcguccauccucaccacucuaugcuguauccccugucccauggauuuagaaaggccauugcugagcgccacggcaaccuuugccucgacaagaucaaugugcugcauaaacccccuuacgaacacccgaaggaccugaaacucagcgaugggcggcugagaguuggauaugugucuagcgacuucggcaaccaccccacaucccaucuuaugcagucuauuccugggaugcacaaccccgauaaguuugaggucuucuguuacgcccugagcccugacgauggaaccaauuuucgcgugaaagucauggcugaagccaaccauuucaucgaccucucccagauucccugcaauggcaaggcggccgaucggauccaccaggacggcauccauauucuggugaacaugaauggguacacgaagggagcuagaaacgagcuguuugcccuucgcccggcuccuauccaagccauguggcucggcuaucccgggacaagcggagcccuguucauggauuacauuaucaccgaccaggagacaucuccugcugaaguugcggagcaguauuccgaaaaacuggccuacaugccccacaccuuuuucauuggcgaucacgcuaauauguuuccucaucucaagaaaaaggccgugaucgacuucaaaagcaacgggcacauuuaugauaaucggaucguccugaacggcaucgaccuuaaggccuuucuggacucucuccccgaugugaagauuguuaaaaugaaguguccggacggaggcgauaaugcugacuccagcaacaccgcccugaauaugccugugauccccaugaacacaauugcggaggcugucaucgaaaugauuaauagagggcagauccaaaucacgauuaacggauucuccaucucuaacggccuggccaccacacagauuaauaacaaagccgcuaccggggaggaggugccccggacaaucauugugaccacgcgcagccaguacggacuuccugaagaugccaucguuuauugcaauuucaaccaacucuacaagaucgacccguccacacugcagaugugggcgaauauucugaaaagaguccccaacucugugcucuggcugcuucgguuuccugcugugggcgagcccaauauccagcaguacgcccaaaacauggggcugccucagaauagaauuaucuucagccccgucgccccuaaggaggaacaugugcgccggggccagcucgcugauguuugucuggacacaccccugugcaacggacacaccaccggcauggaugugcuuugggccgggaccccgauggucacaaugccuggagaaacgcuggcuuccagaguggccgcgagccagcucaccugucugggcugccucgagcugauugccaagaaucgccaagaguaugaagacaucgcuguuaaacuugggacagaucuggaguaccucaagaaagugagaggaaaggucuggaaacagcggaucucuagcccccuguuuaacaccaagcaguauacaauggaacuggagcgccuuuaccugcagaugugggaacauuaugccgcuggcaauaaaccugaccacaugauuaagcccguggagguuaccgaguccgccuga

SEQ ID NO: 2932 - protein, 146 aa, Artificial Sequence [sequence omitted]

SEQ ID NO: 2933 - RNA, 441 nt, Artificial Sequence
  OS-9__Homo_sapiens__BAG57972
auggcggcggaaacgcugcuguccaguuuguuaggacugcugcuucugggacuccuguuacccgcaagucugaccggcggugucgggagucugaaccuggaggagcugagugagaugcguuaugggaucgagauccugccguugccugucaugggagggcagagccaaucuucggacguggugauugucuccucuaaguacaaacagcgcuaugagugucgccugccaguuggagcuauucacuuccagcgugaaagggaggaggaaacaccugcuuaccaagggccugggaucccugaguuguugagcccaaugagagaugcucccugcuugcugaagacaaaggacugguggacauaugaauucuguuauggacgccacauccagcaauaccacauggaagauucagagaucaaaggccuccaagcagcaucgucuuaa

SEQ ID NO: 2934 - RNA, 441 nt, Artificial Sequence
  derived and/or modified sequence opt1 from OS-9__Homo_sapiens__BAG57972
auggccgccgagacccugcucagcucccugcugggccuccugcugcucgggcugcugcuccccgcgagccugaccggcggggugggcucccugaaccucgaggagcugagcgagaugcgcuacgggaucgagauccugccgcuccccgucaugggcggccagucccagagcuccgacguggugaucgucagcuccaaguacaagcagcgguacgagugccgccugcccgugggggccauccacuuccagcgggagcgcgaggaggagacgcccgccuaccagggcccggggauccccgagcugcucagccccaugcgggacgcccccugccugcugaagaccaaggacugguggaccuacgaguucugcuacggccgccacauccagcaguaccacauggaggacuccgagaucaaggggcuccaggccgcgagcuccuga

SEQ ID NO: 2935 - RNA, 441 nt, Artificial Sequence
  derived and/or modified sequence opt2 from OS-9__Homo_sapiens__BAG57972
auggccgccgagacccuccucuccucccuccucggccuccuccuccucggccuccuccuccccgccucccucaccggcggcgucggcucccucaaccucgaggagcucuccgagaugcgcuacggcaucgagauccucccccuccccgucaugggcggccagucccaguccuccgacgucgucaucgucuccuccaaguacaagcagcgcuacgagugccgccuccccgucggcgccauccacuuccagcgcgagcgcgaggaggagacccccgccuaccagggccccggcauccccgagcuccucucccccaugcgcgacgcccccugccuccucaagaccaaggacugguggaccuacgaguucugcuacggccgccacauccagcaguaccacauggaggacuccgagaucaagggccuccaggccgccuccuccuga

SEQ ID NO: 2936 - RNA, 441 nt, Artificial Sequence
  derived and/or modified sequence opt3 from OS-9__Homo_sapiens__BAG57972
auggccgcugagacccugcucagcucccuucugggcuuguuacugcuagggcuccugcuucccgcaucucugacaggaggugugggcucauugaaccucgaggaacugagugaaaugagauacgggaucgagauucugccucucccagucaugggaggccagagccaauccucugacguugugauaguaucgucaaaguauaaacagagguacgaaugccgguuaccggugggugccauccacuuccagcgcgagcgagaggaagagacucccgcguaucaggggccuggcauuccagaacugcuuagccccaugcgugaugcuccuuguuugcugaagacgaaagacugguggaccuacgaguuuugcuauggaagacauauccaacaguaccacauggaggauagugaaauuaagggccuacaggccgcauccucuuga

SEQ ID NO: 2937 - RNA, 441 nt, Artificial Sequence
  derived and/or modified sequence opt4 from OS-9__Homo_sapiens__BAG57972
auggccgccgagacccugcugagcagccugcugggccugcugcugcugggccugcugcugcccgccagccugaccggcggcgugggcagccugaaccuggaggagcugagcgagaugagauacggcaucgagauccugccccugcccgugaugggcggccagagccagagcagcgacguggugaucgugagcagcaaguacaagcagagauacgagugcagacugcccgugggcgccauccacuuccagagagagagagaggaggagacccccgccuaccagggccccggcauccccgagcugcugagccccaugagagacgcccccugccugcugaagaccaaggacugguggaccuacgaguucugcuacggcagacacauccagcaguaccacauggaggacagcgagaucaagggccugcaggccgccagcagcuga

SEQ ID NO: 2938 - RNA, 441 nt, Artificial Sequence
  derived and/or modified sequence opt5 from OS-9__Homo_sapiens__BAG57972
auggccgcugagacccugcucagcucccugcuuggccugcuccugcuugggcugcuccugcccgccucucugacaggaggcguggggagccucaaccuggaggaacuuuccgaaaugagauacggaaucgagauucugccucucccggucaugggcgggcagucucaaagcuccgacguugugaucgugucuagcaaguauaaacagcgguacgaaugccgccugcccgucggagcgauucacuuccagagagagcgggaggaagagacgccugcuuaucagggccccggcaucccugaacuucugucccccaugcgcgaugccccuugucuccugaagaccaaagacugguggacauacgaguuuugcuaugggagacauauucaacaguaccacauggaggauagcgaaaucaagggacugcaggccgcuucuuccuga

SEQ ID NO: 2939 - protein, 406 aa, Artificial Sequence
  OS-9__Homo_sapiens__B4E321
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 2940 - RNA, 1221 nt, Artificial Sequence
  OS-9__Homo_sapiens__BAG65333
auggcggcggaaacgcugcuguccaguuuguuaggacugcugcuucugggacuccuguuacccgcaagucugaccggcggugucgggagccugaaccuggaggagcugagugagaugcguuaugggaucgagauccugccguugccugucaugggagggcagagccaaucuucggacguggugauugucuccucuaaguacaaacagcgcuaugagugucgccugccagcuggagcuauucacuuccagcgugaaagggaggaggaaacaccugcuuaccaagggccugggaucccugaguuguugagcccaaugagagaugcucccugcuugcugaagacaaaggacugguggacauaugaauucuguuauggacgccacauccagcaauaccacauggaagauucagcuucuggugcucccaaugauuuucagaacaacgugcaggucaaagucauucgaagcccugcggauuugauucgauucauagaggagcugaaagguggaacaaaaaaggggaagccaaauauaggccaagagcagccuguggaugaugcugcagaagucccucagagggaaccagagaaggaaaggggugauccagaacggcagagagagauggaagaagaggaggaugaggaugaggaugaggaugaagaugaggaugaacggcaguuacugggagaauuugagaaggaacuggaagggauccugcuuccgucagaccgagaccggcuccguucggaggugaaggcuggcauggagcgggaacuggaaaacaucauccaggagacagagaaagagcuggacccagaugggcugaagaaggagucagagcgggaucgggcaaugcuggcucucacauccacucucaacaaacucaucaaaagacuggaggaaaaacagaguccagagcuggugaagaagcacaagaaaaagaggguuguccccaaaaagccucccccaucaccccaaccuacagggaaaauugagaucaaaauuguccgcccaugggcugaagggacugaagagggugcacguuggcugacugaugaggacacgagaaaccucaaggagaucuucuucaauaucuuggugccgggagcugaagaggcccagaaggaacgccagcggcagaaagagcuggagagcaauuaccgccggguguggggcucuccagguggggagggcacaggggaccuggacgaauuugacuucuga

SEQ ID NO: 2941 - RNA, 1221 nt, Artificial Sequence
  derived and/or modified sequence opt1 from OS-9__Homo_sapiens__BAG65333
auggccgccgagacccugcucagcucccugcugggccuccugcugcucgggcugcugcuccccgcgagccugaccggcggggugggcucccugaaccucgaggagcugagcgagaugcgcuacgggaucgagauccugccgcuccccgucaugggcggccagucccagagcuccgacguggugaucgucagcuccaaguacaagcagcgguacgagugccgccugcccgccggggccauccacuuccagcgggagcgcgaggaggagacgcccgccuaccagggcccggggauccccgagcugcucagccccaugcgggacgcccccugccugcugaagaccaaggacugguggaccuacgaguucugcuacggccgccacauccagcaguaccacauggaggacuccgcgagcggggccccgaacgacuuccagaacaacguccaggugaaggugauccggucccccgccgaccucauccgcuucaucgaggagcugaagggcggcaccaagaaggggaagcccaacaucggccaggagcagcccguggacgacgccgcggaggugccgcagcgggagcccgagaaggagcgcggggaccccgagcggcagcgcgagauggaggaggaggaggacgaggacgaggacgaggacgaggacgaggacgagcggcagcugcucggcgaguucgagaaggagcuggagggcauccugcuccccagcgaccgcgaccggcugcgcuccgaggucaaggccgggauggagcgggagcuggagaacaucauccaggagacggagaaggagcucgacccggacggccugaagaaggagagcgagcgcgaccgggccaugcuggcccucaccuccacccugaacaagcugaucaagcgccucgaggagaagcagagccccgagcuggugaagaagcacaagaagaagcgggugguccccaagaagcccccgcccagcccccagcccaccgggaagaucgagaucaagaucgugcgcccgugggccgagggcacggaggagggggcgcgcuggcugaccgacgaggacacccggaaccucaaggagaucuucuucaacauccuggugcccggcgccgaggaggcccagaaggagcgccagcggcagaaggagcuggaguccaacuaccgccgggucuggggcagccccgggggcgaggggaccggcgaccucgacgaguucgacuucuga

SEQ ID NO: 2942 - RNA, 1221 nt, Artificial Sequence
  derived and/or modified sequence opt2 from OS-9__Homo_sapiens__BAG65333
auggccgccgagacccuccucuccucccuccucggccuccuccuccucggccuccuccuccccgccucccucaccggcggcgucggcucccucaaccucgaggagcucuccgagaugcgcuacggcaucgagauccucccccuccccgucaugggcggccagucccaguccuccgacgucgucaucgucuccuccaaguacaagcagcgcuacgagugccgccuccccgccggcgccauccacuuccagcgcgagcgcgaggaggagacccccgccuaccagggccccggcauccccgagcuccucucccccaugcgcgacgcccccugccuccucaagaccaaggacugguggaccuacgaguucugcuacggccgccacauccagcaguaccacauggaggacuccgccuccggcgcccccaacgacuuccagaacaacguccaggucaaggucauccgcucccccgccgaccucauccgcuucaucgaggagcucaagggcggcaccaagaagggcaagcccaacaucggccaggagcagcccgucgacgacgccgccgaggucccccagcgcgagcccgagaaggagcgcggcgaccccgagcgccagcgcgagauggaggaggaggaggacgaggacgaggacgaggacgaggacgaggacgagcgccagcuccucggcgaguucgagaaggagcucgagggcauccuccuccccuccgaccgcgaccgccuccgcuccgaggucaaggccggcauggagcgcgagcucgagaacaucauccaggagaccgagaaggagcucgaccccgacggccucaagaaggaguccgagcgcgaccgcgccaugcucgcccucaccuccacccucaacaagcucaucaagcgccucgaggagaagcagucccccgagcucgucaagaagcacaagaagaagcgcgucguccccaagaagcccccccccuccccccagcccaccggcaagaucgagaucaagaucguccgccccugggccgagggcaccgaggagggcgcccgcuggcucaccgacgaggacacccgcaaccucaaggagaucuucuucaacauccucguccccggcgccgaggaggcccagaaggagcgccagcgccagaaggagcucgaguccaacuaccgccgcgucuggggcucccccggcggcgagggcaccggcgaccucgacgaguucgacuucuga

SEQ ID NO: 2943 - RNA, 1221 nt, Artificial Sequence
  derived and/or modified sequence opt3 from OS-9__Homo_sapiens__BAG65333
auggccgcugagacccugcucagcucccuucugggcuuguuacugcuagggcuccugcuucccgcaucucugacaggaggugugggcucauugaaccucgaagaacugagugaaaugagauacgggaucgagauucugccucucccagucaugggaggccagagccaauccucugacguugugauaguaucgucaaaguauaaacagagguacgaaugccgguuaccggccggugcgauccacuuccagcgcgagcgagaggaagagacucccgcuuaucaggggccuggcauuccagaacugcuuagccccaugcgugaugccccuuguuugcugaagacgaaagacugguggaccuacgaguuuugcuauggaagacauauccaacaguaccacauggaggauagugcauccggcgccccaaaugacuuccagaacaaugugcaggucaaggugauuaggucucccgcugaucuaauccgguuuauagaggagcucaaagggggaacaaagaaggguaaaccuaacaucggccaagaacagccaguugacgaugcagccgaggugccgcagcgcgaacccgagaaggagagaggggacccugaaaggcagcgggagauggaagaggaagaggaugaggacgaagaugaggacgaagaugaggacgaacgccaacugcuuggagaguucgagaaagaacuggagggcauuuugcucccaagcgaccgagauagacugagguccgaagucaaggcugguauggagcgggaguuagaaaauaucauucaggagacugaaaaagagcuggaccccgaugggcucaagaaggaaucagagcgugaccgcgccaugcuugcgcugaccaguacauugaacaaacuaaucaagagacuggaggaaaaacagagcccugagcucgugaagaaacauaagaaaaagaggguaguuccaaagaaacccccgccuucuccccaaccaaccggaaagauagaaauuaaaaucgugcggccuugggcagagggcacugaagagggcgcccgauggcugacagaugaggacacccgcaaucuuaaggaaaucuuuuucaacauucugguccccggggcugaggaagcccagaaagagagacagaggcagaaggaauuggaguccaauuaucggcgcguguggggaucaccagguggcgaggggacgggagaucucgacgaauuugauuucuga

SEQ ID NO: 2944 - RNA, 1221 nt, Artificial Sequence
  derived and/or modified sequence opt4 from OS-9__Homo_sapiens__BAG65333
auggccgccgagacccugcugagcagccugcugggccugcugcugcugggccugcugcugcccgccagccugaccggcggcgugggcagccugaaccuggaggagcugagcgagaugagauacggcaucgagauccugccccugcccgugaugggcggccagagccagagcagcgacguggugaucgugagcagcaaguacaagcagagauacgagugcagacugcccgccggcgccauccacuuccagagagagagagaggaggagacccccgccuaccagggccccggcauccccgagcugcugagccccaugagagacgcccccugccugcugaagaccaaggacugguggaccuacgaguucugcuacggcagacacauccagcaguaccacauggaggacagcgccagcggcgcccccaacgacuuccagaacaacgugcaggugaaggugaucagaagccccgccgaccugaucagauucaucgaggagcugaagggcggcaccaagaagggcaagcccaacaucggccaggagcagcccguggacgacgccgccgaggugccccagagagagcccgagaaggagagaggcgaccccgagagacagagagagauggaggaggaggaggacgaggacgaggacgaggacgaggacgaggacgagagacagcugcugggcgaguucgagaaggagcuggagggcauccugcugcccagcgacagagacagacugagaagcgaggugaaggccggcauggagagagagcuggagaacaucauccaggagaccgagaaggagcuggaccccgacggccugaagaaggagagcgagagagacagagccaugcuggcccugaccagcacccugaacaagcugaucaagagacuggaggagaagcagagccccgagcuggugaagaagcacaagaagaagagaguggugcccaagaagcccccccccagcccccagcccaccggcaagaucgagaucaagaucgugagacccugggccgagggcaccgaggagggcgccagauggcugaccgacgaggacaccagaaaccugaaggagaucuucuucaacauccuggugcccggcgccgaggaggcccagaaggagagacagagacagaaggagcuggagagcaacuacagaagaguguggggcagccccggcggcgagggcaccggcgaccuggacgaguucgacuucuga

SEQ ID NO: 2945 - RNA, 1221 nt, Artificial Sequence
  derived and/or modified sequence opt5 from OS-9__Homo_sapiens__BAG65333
auggccgcugagacccugcucagcucccugcuuggccugcuccugcuugggcugcuccugcccgccucucugacaggaggcguggggagccucaaccuggaagaacuuuccgaaaugagauacggaaucgagauucugccucucccggucaugggcgggcagucucaaagcuccgacguugugaucgugucuagcaaguauaaacagcgguacgaaugccgccugcccgcgggagcuauucacuuccagagagagcgggaggaagagacgccugccuaucagggccccggcaucccugaacuucugucccccaugcgcgaugccccuugucuccugaagaccaaagacugguggacauacgaguuuugcuaugggagacauauucaacaguaccacauggaggauagcgcuucuggagccccgaaugacuuccagaacaauguccaggugaagguuauccggucccccgcugaucugauccgcuuuauugaggagcucaaaggcgggaccaagaagggaaaaccuaacaucggccaagaacagcccguggacgaugccgcggaggucccucagagagaacccgagaaggagcgcggggacccggaacggcagagagagauggaagaggaagaggaugaggacgaagaugaggacgaagaugaggacgaacggcaacugcuuggagaguucgagaaagaacuggagggcauucuccugccuagcgaccgcgauagacuucggucugaagugaaggccggcauggagcgcgagcuggaaaauaucauucaggagacagaaaaagagcucgaccccgaugggcugaagaaggaauccgagagagaccgggcuaugcuggcccucaccagcacacugaacaaacuuaucaagagacuggaggaaaaacagucuccugagcucguuaagaaacauaagaaaaagcgcgugguccccaagaaacccccuccgagcccccaaccuaccggaaagauugaaaucaaaaucgugcggcccugggcugagggcacggaagagggggccagauggcugaccgaugaggacacacgcaaucuuaaggaaaucuuuuucaacauucuggugccuggagcggaggaagcccagaaagagcggcagagacagaaggaacucgaguccaauuaucgccgggucuggggcucccccgggggagagggcaccggcgaucuggacgaauuugauuucuga

SEQ ID NO: 2946 - protein, 740 aa, Artificial Sequence
  OS-9__Homo_sapiens__B7Z8E7
MAVETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGRTLFHLFREIHFHFFPSPDLTVLTDWWGGGGVEKYHGPSSLGDRGGEGTPSYLLPSVSPLLSDQSLPVLCTLGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 2947 - RNA, 2223 nt, Artificial Sequence
  OS-9__Homo_sapiens__BAH13933
auggcgguggaaacgcugcuguccaguuuguuaggacugcugcuucugggacuccuguuacccgcaagucugaccggcggugucgggagccugaaccuggaggagcugagugagaugcguuaugggaucgagauccugccguugccugucaugggagggcagagccaaucuucggacguggugauugucuccucuaaguacaaacagcgcuaugagugucgccugccagcuggagcuauucacuuccagcgugaaagggaggaggaaacaccugcuuaccaagggccugggaucccugaguuguugagcccaaugagagaugcucccugcuugcugaagacaaaggacugguggacauaugaauucuguuauggacgccacauccagcaauaccacauggaagauucagagaucaaaggugaaguccucuaucucggcuacuaccaaucagccuucgacugggaugaugaaacagccaaggccuccaagcagcaucgucuuaaacgcuaccacagccagaccuauggcaauggguccaagugcgaccuuaaugggaggccccgggaggccgagguucgguuccucugugacgagggugcagguaucucuggggacuacaucgaucgcguggacgagcccuuguccugcucuuaugugcugaccauucgcacuccucggcucugcccccacccucuccuccggcccccacccagugcugcaccgcaggccauccucugucacccuucccuacagccugaggaguacauggccuacguucagaggcaagccgacucaaagcaguauggagauaaaaucauagaggagcugcaagaucuaggcccccaaguguggagugagaccaagucugggguggcaccccaaaagauggcagguaggaccuuguuucaccuguuccgugaaauucacuuccauuucuucccuuccccugaucuuacuguccugacugacugguggggugggggggggguggaaaaguaccaugggcccuccucccuuggugauagaggaggggaagggaccccauccuauuugcucccuucugucucaccccuccugucagaucagucucucccuguucucuguacccuaggugcgagcccgaccaaggaugacaguaaggacucagauuucuggaagaugcuuaaugagccagaggaccaggccccaggaggggaggaggugccggcugaggagcaggacccaagcccugaggcagcagauucagcuucuggugcucccaaugauuuucagaacaacgugcaggucaaagucauucgaagcccugcggauuugauucgauucauagaggagcugaaagguggaacaaaaaaggggaagccaaauauaggccaagagcagccuguggaugaugcugcagaagucccucagagggaaccagagaaggaaaggggugauccagaacggcagagagagauggaagaagaggaggaugaggaugaggaugaggaugaagaugaggaugaacggcaguuacugggagaauuugagaaggaacuggaagggauccugcuuccgucagaccgagaccggcuccguucggaggugaaggcuggcauggagcgggaacuggagaacaucauccaggagacagagaaagagcuggacccagaugggcugaagaaggagucagagcgggaucgggcaaugcuggcucucacauccacucucaacaaacucaucaaaagacuggaggaaaaacagaguccagagcuggugaagaagcacaagaaaaagaggguuguccccaaaaagccucccccaucaccccaaccuacagaggaggauccugagcacagaguccggguccgggucaccaagcuccgucucggaggcccuaaucaggaucugacuguccucgagaugaaacgggaaaacccacagcugaaacaaaucgaggggcuggugaaggagcugcuggagagggagggacucacagcugcagggaaaauugagaucaaaauuguccgcccaugggcugaagggacugaagagggugcacguuggcugacugaugaggacacgagaaaccucaaggagaucuucuucaauaucuuggugccgggagcugaagaggcccagaaggaacgccagcggcagaaagagcuggagagcaauuaccgccggguguggggcucuccagguggggagggcacaggggaccuggacgaauuugacuucuga

SEQ ID NO: 2948 - RNA, 2223 nt, Artificial Sequence
  derived and/or modified sequence opt1 from OS-9__Homo_sapiens__BAH13933
auggccguggagacccugcucagcucccugcugggccuccugcugcucgggcugcugcuccccgccagccugaccggcggggucggcucccugaaccucgaggagcugagcgagaugcgcuacgggaucgagauccugccgcuccccgugaugggcggccagucccagagcuccgacguggucaucgugagcuccaaguacaagcagcgguacgagugccgccugcccgcgggggccauccacuuccagcgggagcgcgaggaggagacgcccgccuaccagggcccggggauccccgagcugcucagccccaugcgggacgcccccugccugcugaagaccaaggacugguggaccuacgaguucugcuacggccgccacauccagcaguaccacauggaggacuccgagaucaagggggaggugcucuaccugggcuacuaccagagcgccuucgacugggacgacgagaccgcgaaggccuccaagcagcaccggcugaagcgcuaccacagccagacguacggcaacggguccaagugcgaccucaacggccggccgcgcgaggccgagguccgguuccugugcgacgagggggccggcaucagcggcgacuacaucgaccgcguggacgagccccuguccugcagcuacgugcucaccauccggacgccccgccugugcccccacccgcugcuccggcccccgcccuccgcggccccgcaggccauccugugccaccccagccugcagcccgaggaguacauggccuacguccagcgccaggccgacagcaagcaguacggggacaagaucaucgaggagcuccaggaccugggcccccaggugugguccgagaccaagagcgggguggcgccgcagaagauggccggccggacccuguuccaccucuuccgcgagauccacuuccacuucuuccccucccccgaccugaccguccugaccgacugguggggcgggggcgggguggagaaguaccacggccccagcucccucggggaccggggcggggagggcaccccgagcuaccugcugcccuccgugagcccccuccuguccgaccagagccugcccguccucugcacgcugggcgccuccccgaccaaggacgacagcaaggacuccgacuucuggaagaugcugaacgagcccgaggaccaggcccccgggggcgaggaggugccggccgaggagcaggaccccagccccgaggcggccgacuccgccagcggggcccccaacgacuuccagaacaacgugcaggucaaggugauccgcuccccggccgaccucauccgguucaucgaggagcugaagggcgggaccaagaagggcaagcccaacaucggccaggagcagcccguggacgacgcggccgaggucccccagcgcgagccggagaaggagcgcggggaccccgagcggcagcgcgagauggaggaggaggaggacgaggacgaggacgaggacgaggacgaggacgagcggcagcugcugggcgaguucgagaaggagcucgaggggauccugcugcccagcgaccgcgaccggcuccgcuccgaggugaaggccggcauggagcgggagcuggagaacaucauccaggagaccgagaaggagcuggaccccgacggccucaagaaggagagcgagcgcgaccgggccaugcuggcccugacgagcacccucaacaagcugaucaagcgccuggaggagaagcaguccccggagcucgugaagaagcacaagaagaagcgggucgugcccaagaagcccccgcccagcccccagcccaccgaggaggaccccgagcaccgcguccgggugcgcgugaccaagcugcggcucgggggcccgaaccaggaccugacgguccuggagaugaagcgcgagaacccccagcugaagcagaucgaggggcucgugaaggagcugcuggagcgggagggccucaccgcggccgggaagaucgagaucaagaucgugcgccccugggccgagggcaccgaggagggcgcccgguggcugaccgacgaggacacgcgcaaccugaaggagaucuucuucaacauccucguccccggggcggaggaggcccagaaggagcgccagcggcagaaggagcuggaguccaacuaccgccggguguggggcagccccgggggcgaggggaccggcgaccuggacgaguucgacuucuga

SEQ ID NO: 2949 - RNA, 2223 nt, Artificial Sequence
  derived and/or modified sequence opt2 from OS-9__Homo_sapiens__BAH13933
auggccgucgagacccuccucuccucccuccucggccuccuccuccucggccuccuccuccccgccucccucaccggcggcgucggcucccucaaccucgaggagcucuccgagaugcgcuacggcaucgagauccucccccuccccgucaugggcggccagucccaguccuccgacgucgucaucgucuccuccaaguacaagcagcgcuacgagugccgccuccccgccggcgccauccacuuccagcgcgagcgcgaggaggagacccccgccuaccagggccccggcauccccgagcuccucucccccaugcgcgacgcccccugccuccucaagaccaaggacugguggaccuacgaguucugcuacggccgccacauccagcaguaccacauggaggacuccgagaucaagggcgagguccucuaccucggcuacuaccaguccgccuucgacugggacgacgagaccgccaaggccuccaagcagcaccgccucaagcgcuaccacucccagaccuacggcaacggcuccaagugcgaccucaacggccgcccccgcgaggccgagguccgcuuccucugcgacgagggcgccggcaucuccggcgacuacaucgaccgcgucgacgagccccucuccugcuccuacguccucaccauccgcaccccccgccucugcccccacccccuccuccgccccccccccuccgccgccccccaggccauccucugccaccccucccuccagcccgaggaguacauggccuacguccagcgccaggccgacuccaagcaguacggcgacaagaucaucgaggagcuccaggaccucggcccccaggucugguccgagaccaaguccggcgucgccccccagaagauggccggccgcacccucuuccaccucuuccgcgagauccacuuccacuucuuccccucccccgaccucaccguccucaccgacugguggggcggcggcggcgucgagaaguaccacggccccuccucccucggcgaccgcggcggcgagggcacccccuccuaccuccuccccuccgucuccccccuccucuccgaccagucccuccccguccucugcacccucggcgccucccccaccaaggacgacuccaaggacuccgacuucuggaagaugcucaacgagcccgaggaccaggcccccggcggcgaggagguccccgccgaggagcaggaccccucccccgaggccgccgacuccgccuccggcgcccccaacgacuuccagaacaacguccaggucaaggucauccgcucccccgccgaccucauccgcuucaucgaggagcucaagggcggcaccaagaagggcaagcccaacaucggccaggagcagcccgucgacgacgccgccgaggucccccagcgcgagcccgagaaggagcgcggcgaccccgagcgccagcgcgagauggaggaggaggaggacgaggacgaggacgaggacgaggacgaggacgagcgccagcuccucggcgaguucgagaaggagcucgagggcauccuccuccccuccgaccgcgaccgccuccgcuccgaggucaaggccggcauggagcgcgagcucgagaacaucauccaggagaccgagaaggagcucgaccccgacggccucaagaaggaguccgagcgcgaccgcgccaugcucgcccucaccuccacccucaacaagcucaucaagcgccucgaggagaagcagucccccgagcucgucaagaagcacaagaagaagcgcgucguccccaagaagcccccccccuccccccagcccaccgaggaggaccccgagcaccgcguccgcguccgcgucaccaagcuccgccucggcggccccaaccaggaccucaccguccucgagaugaagcgcgagaacccccagcucaagcagaucgagggccucgucaaggagcuccucgagcgcgagggccucaccgccgccggcaagaucgagaucaagaucguccgccccugggccgagggcaccgaggagggcgcccgcuggcucaccgacgaggacacccgcaaccucaaggagaucuucuucaacauccucguccccggcgccgaggaggcccagaaggagcgccagcgccagaaggagcucgaguccaacuaccgccgcgucuggggcucccccggcggcgagggcaccggcgaccucgacgaguucgacuucuga

SEQ ID NO: 2950 - RNA, 2223 nt, Artificial Sequence
  derived and/or modified sequence opt3 from OS-9__Homo_sapiens__BAH13933
auggccguggagacccugcucagcucccuucugggcuuguuacugcuagggcuccugcuucccgcuucucugacaggaggugucggcucauugaaccucgaagaacugagugaaaugagauacgggaucgagauucugccucucccaguuaugggaggccagagccaauccucugacgugguaauagugucgucaaaguauaaacagagguacgaaugccgguuaccggccggugcaauccacuuccagcgcgagcgagaggaagagacucccgcguaucaggggccuggcauuccagaacugcuuagccccaugcgugaugcuccuuguuugcugaagacgaaagacugguggaccuacgaguuuugcuauggaagacauauccaacaguaccacauggaggauagugaaauuaagggcgagguccuauaucucggguacuaccaguccgccuucgacugggaugacgaaacagcaaaagccucuaagcagcauaggcugaagcgguaucacagccaaacuuacggaaaugguuccaaaugugaucuuaacggccgcccaagagaggcugaagugagguuucugugcgacgagggggcaggaaucucaggcgauuauauagaccggguugaugagcccuugaguuguagcuacgugcucaccauccgcacaccucgacugugcccacauccguuacugagacccccuccaucugccgcuccccaggccauucucugucacccuucccuucagccagaagaguauauggcguacguccagaggcaagcagacucaaagcaguauggugauaaaaucauugaggagcugcaggacuuggggccccaaguguggagcgaaaccaagaguggaguagccccgcagaaaauggcuggccggacucuauuccaccuguuucgugagauccauuuccacuuuuucccuucucccgaccucacaguucugaccgauugguggggcgggggagguguggagaaguaccauggcccauccagccuuggggaccgcggaggcgaagguacgccuucguaccuguugcccucugucuccccacuccugucagaucagaguuuacccgugcugugcacucuaggggccagcccuaccaaggacgauuccaaagacucugauuuuuggaagaugcucaaugagccagaagaccaggcaccgggcggagaggaagugcccgcugaggagcaagauccuagcccagaagccgcggacucagccaguggcgcacccaacgauuuccagaauaacguccagguuaaagugauaagauccccugcugaccugauuagguuuaucgaggaacuuaaagggggaacaaagaaggguaaaccaaauauuggccaggagcaacccguagacgaugccgcugaggugccgcagcgggaaccugagaaggaacgaggggacccagagcgccagagagaaauggaggaggaagaggaugaagacgaggaugaagacgaggaugaggacgaaaggcaguugcugggagaguucgaaaaggagcucgaaggcauccugcuucccagcgaucgggaccgccugagaucugaggucaaagccgguauggagagggaauuggagaacaucauucaagaaacugagaaggagcucgauccugacgggcugaaaaaggaaucagagcgugaucgggcaauguuagcccugaccaguacacuaaauaaacucauaaagcgacuggaagagaagcagagccccgaacuugugaaaaagcacaaaaagaaaagaguugugccaaagaagccucccccauccccgcagccuaccgaggaggaccccgaacacaggguccgcgugcggguaacgaaauugagacugggcggaccaaaccaggaccucacuguucuggagaugaagagggaaaauccccaauuaaaacagaucgagggccuggugaaggaacuuuuggagcgcgaggggcucacagcugcgggaaaaauugaaaucaagauaguccgaccuugggcagaggguaccgaagagggcgcccgguggcugacugaugaagacacacguaaccuaaaggagauuuucuucaauauccuggugccaggggcugaggaagcccagaaagagagacaaaggcagaaggaacucgagucuaacuaucgccgggucuggggaucgcccggcggugaggggaccggcgaucuggacgaauuugauuuuuga

SEQ ID NO: 2951 - RNA, 2223 nt, Artificial Sequence
  derived and/or modified sequence opt4 from OS-9__Homo_sapiens__BAH13933
auggccguggagacccugcugagcagccugcugggccugcugcugcugggccugcugcugcccgccagccugaccggcggcgugggcagccugaaccuggaggagcugagcgagaugagauacggcaucgagauccugccccugcccgugaugggcggccagagccagagcagcgacguggugaucgugagcagcaaguacaagcagagauacgagugcagacugcccgccggcgccauccacuuccagagagagagagaggaggagacccccgccuaccagggccccggcauccccgagcugcugagccccaugagagacgcccccugccugcugaagaccaaggacugguggaccuacgaguucugcuacggcagacacauccagcaguaccacauggaggacagcgagaucaagggcgaggugcuguaccugggcuacuaccagagcgccuucgacugggacgacgagaccgccaaggccagcaagcagcacagacugaagagauaccacagccagaccuacggcaacggcagcaagugcgaccugaacggcagacccagagaggccgaggugagauuccugugcgacgagggcgccggcaucagcggcgacuacaucgacagaguggacgagccccugagcugcagcuacgugcugaccaucagaacccccagacugugcccccacccccugcugagacccccccccagcgccgccccccaggccauccugugccaccccagccugcagcccgaggaguacauggccuacgugcagagacaggccgacagcaagcaguacggcgacaagaucaucgaggagcugcaggaccugggcccccagguguggagcgagaccaagagcggcguggccccccagaagauggccggcagaacccuguuccaccuguucagagagauccacuuccacuucuuccccagccccgaccugaccgugcugaccgacugguggggcggcggcggcguggagaaguaccacggccccagcagccugggcgacagaggcggcgagggcacccccagcuaccugcugcccagcgugagcccccugcugagcgaccagagccugcccgugcugugcacccugggcgccagccccaccaaggacgacagcaaggacagcgacuucuggaagaugcugaacgagcccgaggaccaggcccccggcggcgaggaggugcccgccgaggagcaggaccccagccccgaggccgccgacagcgccagcggcgcccccaacgacuuccagaacaacgugcaggugaaggugaucagaagccccgccgaccugaucagauucaucgaggagcugaagggcggcaccaagaagggcaagcccaacaucggccaggagcagcccguggacgacgccgccgaggugccccagagagagcccgagaaggagagaggcgaccccgagagacagagagagauggaggaggaggaggacgaggacgaggacgaggacgaggacgaggacgagagacagcugcugggcgaguucgagaaggagcuggagggcauccugcugcccagcgacagagacagacugagaagcgaggugaaggccggcauggagagagagcuggagaacaucauccaggagaccgagaaggagcuggaccccgacggccugaagaaggagagcgagagagacagagccaugcuggcccugaccagcacccugaacaagcugaucaagagacuggaggagaagcagagccccgagcuggugaagaagcacaagaagaagagaguggugcccaagaagcccccccccagcccccagcccaccgaggaggaccccgagcacagagugagagugagagugaccaagcugagacugggcggccccaaccaggaccugaccgugcuggagaugaagagagagaacccccagcugaagcagaucgagggccuggugaaggagcugcuggagagagagggccugaccgccgccggcaagaucgagaucaagaucgugagacccugggccgagggcaccgaggagggcgccagauggcugaccgacgaggacaccagaaaccugaaggagaucuucuucaacauccuggugcccggcgccgaggaggcccagaaggagagacagagacagaaggagcuggagagcaacuacagaagaguguggggcagccccggcggcgagggcaccggcgaccuggacgaguucgacuucuga

SEQ ID NO: 2952 - RNA, 2223 nt, Artificial Sequence
  derived and/or modified sequence opt5 from OS-9__Homo_sapiens__BAH13933
auggccguggagacccugcucagcucccugcuuggccugcuccugcuugggcugcuccugcccgcuucucugacaggaggcgucgggagccucaaccuggaagaacuuuccgaaaugagauacggaaucgagauucugccucucccgguuaugggcgggcagucucaaagcuccgacguggugaucgucucuagcaaguauaaacagcgguacgaaugccgccugcccgccggagcgauucacuuccagagagagcgggaggaagagacgccugcuuaucagggccccggcaucccugaacuucugucccccaugcgcgaugccccuugucuccugaagaccaaagacugguggacauacgaguuuugcuaugggagacauauucaacaguaccacauggaggauagcgaaaucaagggagaggugcuguaucucggcuacuaccagucugccuucgacugggaugacgaaaccgcuaaagccuccaagcagcaucggcugaagcgcuaucacagccaaacauacgggaauggaucuaaaugugaucuuaacggcagaccgcgggaggcugaaguucgcuuucugugcgacgagggggccggaaucuccggcgauuauauugacagaguggaugagccccucagcuguucuuacguccugaccauccggacaccucgccuuugcccccauccucugcucagacccccgccuuccgcggcuccccaggccauucugugucacccuagccugcagcccgaagaguauauggccuacgugcagcggcaagcugacuccaagcaguauggcgauaaaaucauugaggagcuccaggaccuggggccccaaguuuggucugaaaccaagagcggaguggccccucagaaaauggcgggccgcacgcuuuuccaccuguuuagagagauccauuuccacuuuuucccgucccccgaccucaccguccugacagauugguggggagggggcgggguggagaaguaccauggaccuagcucucuuggcgaccggggcggggaaggaacccccuccuaccugcucccuagcgugucuccccugcugagcgaucagucccucccgguccugugcacacuuggcgccucuccuaccaaggacgauagcaaagacuccgauuuuuggaagaugcugaaugagcccgaagaccaggcuccugggggagaggaaguucccgccgaggagcaagauccuagccccgaagcugccgacucugccuccggcgcuccgaacgauuuccagaauaacguccaggugaaagugauuagaagcccugcggaccucauccgcuuuaucgaggaacugaaagggggcacgaagaagggaaaacccaauauuggccaggagcaacccguggacgaugccgcugagguuccucagcgggaaccggagaaggaaagaggggaccccgagcgccagcgggaaauggaggaggaagaggaugaagacgaggaugaagacgaggaugaggacgaaagacagcugcuuggagaguucgaaaaggagcucgaaggcauccugcugccuucugaucgcgaccggcucagauccgaggugaaagccgggauggagcgcgaacuggagaacauuauccaagaaacagagaaggagcuugaucccgacggacugaaaaaggaaagcgagcgggauagagccaugcucgcucugaccuccacacugaauaaacuuauuaagcgccucgaagagaagcagucuccugaacuggucaaaaagcacaaaaagaaacgggugguucccaagaagccucccccgagcccucagcccaccgaggaggacccugaacacagagugcggguccgcgugaccaaacugagacucggcgggcccaaccaggaccugacaguccuugagaugaagcgggaaaauccgcaacugaaacagaucgagggccucgugaaggaacugcuggagagagagggacuuacggccgcgggcaaaaucgaaauuaagaucguucgcccuugggcugaggggaccgaagagggagcccgguggcucacagaugaagacaccagaaaccugaaggagauuuucuucaauauccuggugcccggcgccgaggaagcucagaaagagcgccaaagacagaaggaacucgaguccaacuaucggcgcgucugggggucuccuggaggcgaggggacaggcgaucuggacgaauuugauuuuuga

SEQ ID NO: 2953 - protein, 667 aa, Artificial Sequence
  OS-9__Homo_sapiens__Q13438
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 2954 - RNA, 2004 nt, Artificial Sequence
  OS-9__Homo_sapiens__AAB06495
auggcggcggaaacgcugcuguccaguuuguuaggacugcugcuucugggacuccuguuacccgcaagucugaccggcggugucgggagccugaaccuggaggagcugagugagaugcguuaugggaucgagauccugccguugccugucaugggagggcagagccaaucuucggacguggugauugucuccucuaaguacaaacagcgcuaugagugucgccugccagcuggagcuauucacuuccagcgugaaagggaggaggaaacaccugcuuaccaagggccugggaucccugaguuguugagcccaaugagagaugcucccugcuugcugaagacaaaggacugguggacauaugaauucuguuauggacgccacauccagcaauaccacauggaagauucagagaucaaaggugaaguccucuaucucggcuacuaccaaucagccuucgacugggaugaugaaacagccaaggccuccaagcagcaucgucuuaaacgcuaccacagccagaccuauggcaauggguccaagugcgaccuuaaugggaggccccgggaggccgagguucgguuccucugugacgagggugcagguaucucuggggacuacaucgaucgcguggacgagcccuuguccugcucuuaugugcugaccauucgcacuccucggcucugcccccacccucuccuccggcccccacccagugcugcaccacaggccauccucugucacccuucccuacagccugaggaguacauggccuacguucagaggcaagccgacucaaagcaguauggagauaaaaucauagaggagcugcaagaucuaggcccccaaguguggagugagaccaagucugggguggcaccccaaaagauggcaggugcgagcccgaccaaggaugacaguaaggacucagauuucuggaagaugcuuaaugagccagaggaccaggccccaggaggggaggaggugccggcugaggagcaggacccaagcccugaggcagcagauucagcuucuggugcucccaaugauuuucagaacaacgugcaggucaaagucauucgaagcccugcggauuugauucgauucauagaggagcugaaagguggaacaaaaaaggggaagccaaauauaggccaagagcagccuguggaugaugcugcagaagucccucagagggaaccagagaaggaaaggggugauccagaacggcagagagagauggaagaagaggaggaugaggaugaggaugaggaugaagaugaggaugaacggcaguuacugggagaauuugagaaggaacuggaagggauccugcuuccgucagaccgagaccggcuccguucggaggugaaggcuggcauggagcgggaacuggagaacaucauccaggagacagagaaagagcuggacccagaugggcugaagaaggagucagagcgggaucgggcaaugcuggcucucacauccacucucaacaaacucaucaaaagacuggaggaaaaacagaguccagagcuggugaagaagcacaagaaaaagaggguuguccccaaaaagccucccccaucaccccaaccuacagaggaggauccugagcacagaguccggguccgggucaccaagcuccgucucggaggcccuaaucaggaucugacuguccucgagaugaaacgggaaaacccacagcugaaacaaaucgaggggcuggugaaggagcugcuggagagggagggacucacagcugcagggaaaauugagaucaaaauuguccgcccaugggcugaagggacugaagagggugcacguuggcugacugaugaggacacgagaaaccucaaggagaucuucuucaauaucuuggugccgggagcugaagaggcccagaaggaacgccagcggcagaaagagcuggagagcaauuaccgccggguguggggcucuccagguggggagggcacaggggaccuggacgaauuugacuucuga

SEQ ID NO: 2955 - RNA, 2004 nt, Artificial Sequence
  derived and/or modified sequence opt1 from OS-9__Homo_sapiens__AAB06495
auggccgccgagacccugcucagcucccugcugggccuccugcugcucgggcugcugcuccccgcgagccugaccggcggggugggcucccugaaccucgaggagcugagcgagaugcgcuacgggaucgagauccugccgcuccccgucaugggcggccagucccagagcuccgacguggugaucgucagcuccaaguacaagcagcgguacgagugccgccugcccgccggggccauccacuuccagcgggagcgcgaggaggagacgcccgccuaccagggcccggggauccccgagcugcucagccccaugcgggacgcccccugccugcugaagaccaaggacugguggaccuacgaguucugcuacggccgccacauccagcaguaccacauggaggacuccgagaucaagggggaggugcucuaccugggcuacuaccagagcgcguucgacugggacgacgagaccgccaaggccuccaagcagcaccggcugaagcgcuaccacagccagacguacggcaacggguccaagugcgaccucaacggccggccgcgcgaggccgaggugcgguuccugugcgacgagggggcgggcaucagcggcgacuacaucgaccgcgucgacgagccccuguccugcagcuacgugcucaccauccggacgccccgccugugcccccacccgcugcuccggcccccgcccuccgccgcgccccaggccauccugugccaccccagccugcagcccgaggaguacauggccuacgugcagcgccaggccgacagcaagcaguacggggacaagaucaucgaggagcuccaggaccugggcccccaggucugguccgagaccaagagcgggguggccccgcagaagauggccggcgccucccccaccaaggacgacagcaaggacuccgacuucuggaagaugcugaacgagcccgaggaccaggcccccgggggcgaggaggugccggcggaggagcaggaccccagccccgaggccgccgacuccgccagcggcgcccccaacgacuuccagaacaacguccaggugaaggugauccgguccccggcggaccucauccgcuucaucgaggagcugaagggcgggaccaagaaggggaagcccaacaucggccaggagcagcccgucgacgacgccgccgaggugccgcagcgggagcccgagaaggagcgcggggaccccgagcggcagcgcgagauggaggaggaggaggacgaggacgaggacgaggacgaggacgaggacgagcgccagcugcucggcgaguucgagaaggagcuggagggcauccugcuccccagcgaccgggaccgccugcgguccgaggugaaggccgggauggagcgcgagcuggagaacaucauccaggagaccgagaaggagcucgacccggacggccugaagaaggagagcgagcgggaccgcgccaugcuggcgcucaccuccacgcugaacaagcugaucaagcggcuggaggagaagcagagccccgagcucgucaagaagcacaagaagaagcgcguggugcccaagaagcccccgcccagcccccagcccaccgaggaggacccggagcaccggguccgcgugcgggugaccaagcugcgccucgggggccccaaccaggaccugaccguccuggagaugaagcgggagaacccccagcugaagcagaucgaggggcucgugaaggagcugcuggagcgcgagggccucacggccgccggcaagaucgagaucaagaucguccggcccugggccgaggggaccgaggagggcgcgcgcuggcugaccgacgaggacacccggaaccugaaggagaucuucuucaacauccucgugccgggggccgaggaggcccagaaggagcgccagcggcagaaggagcuggaguccaacuaccgccgcguguggggcucccccggcggggagggcacgggggaccuggacgaguucgacuucuga

SEQ ID NO: 2956 - RNA, 2004 nt, Artificial Sequence
  derived and/or modified sequence opt2 from OS-9__Homo_sapiens__AAB06495
auggccgccgagacccuccucuccucccuccucggccuccuccuccucggccuccuccuccccgccucccucaccggcggcgucggcucccucaaccucgaggagcucuccgagaugcgcuacggcaucgagauccucccccuccccgucaugggcggccagucccaguccuccgacgucgucaucgucuccuccaaguacaagcagcgcuacgagugccgccuccccgccggcgccauccacuuccagcgcgagcgcgaggaggagacccccgccuaccagggccccggcauccccgagcuccucucccccaugcgcgacgcccccugccuccucaagaccaaggacugguggaccuacgaguucugcuacggccgccacauccagcaguaccacauggaggacuccgagaucaagggcgagguccucuaccucggcuacuaccaguccgccuucgacugggacgacgagaccgccaaggccuccaagcagcaccgccucaagcgcuaccacucccagaccuacggcaacggcuccaagugcgaccucaacggccgcccccgcgaggccgagguccgcuuccucugcgacgagggcgccggcaucuccggcgacuacaucgaccgcgucgacgagccccucuccugcuccuacguccucaccauccgcaccccccgccucugcccccacccccuccuccgccccccccccuccgccgccccccaggccauccucugccaccccucccuccagcccgaggaguacauggccuacguccagcgccaggccgacuccaagcaguacggcgacaagaucaucgaggagcuccaggaccucggcccccaggucugguccgagaccaaguccggcgucgccccccagaagauggccggcgccucccccaccaaggacgacuccaaggacuccgacuucuggaagaugcucaacgagcccgaggaccaggcccccggcggcgaggagguccccgccgaggagcaggaccccucccccgaggccgccgacuccgccuccggcgcccccaacgacuuccagaacaacguccaggucaaggucauccgcucccccgccgaccucauccgcuucaucgaggagcucaagggcggcaccaagaagggcaagcccaacaucggccaggagcagcccgucgacgacgccgccgaggucccccagcgcgagcccgagaaggagcgcggcgaccccgagcgccagcgcgagauggaggaggaggaggacgaggacgaggacgaggacgaggacgaggacgagcgccagcuccucggcgaguucgagaaggagcucgagggcauccuccuccccuccgaccgcgaccgccuccgcuccgaggucaaggccggcauggagcgcgagcucgagaacaucauccaggagaccgagaaggagcucgaccccgacggccucaagaaggaguccgagcgcgaccgcgccaugcucgcccucaccuccacccucaacaagcucaucaagcgccucgaggagaagcagucccccgagcucgucaagaagcacaagaagaagcgcgucguccccaagaagcccccccccuccccccagcccaccgaggaggaccccgagcaccgcguccgcguccgcgucaccaagcuccgccucggcggccccaaccaggaccucaccguccucgagaugaagcgcgagaacccccagcucaagcagaucgagggccucgucaaggagcuccucgagcgcgagggccucaccgccgccggcaagaucgagaucaagaucguccgccccugggccgagggcaccgaggagggcgcccgcuggcucaccgacgaggacacccgcaaccucaaggagaucuucuucaacauccucguccccggcgccgaggaggcccagaaggagcgccagcgccagaaggagcucgaguccaacuaccgccgcgucuggggcucccccggcggcgagggcaccggcgaccucgacgaguucgacuucuga

SEQ ID NO: 2957 - RNA, 2004 nt, Artificial Sequence
  derived and/or modified sequence opt3 from OS-9__Homo_sapiens__AAB06495
auggccgcugagacccugcucagcucccuucugggcuuguuacugcuagggcuccugcuucccgcaucucugacaggaggugugggcucauugaaccucgaagaacugagugaaaugagauacgggaucgagauucugccucucccagucaugggaggccagagccaauccucugacguugugauaguaucgucaaaguauaaacagagguacgaaugccgguuaccggccggugcgauccacuuccagcgcgagcgagaggaagagacucccgcuuaucaggggccugggauuccagaacugcuuagccccaugcgugaugccccuuguuugcugaagacgaaagacugguggaccuacgaguuuugcuauggcagacauauccaacaguaccacauggaggauagugaaauuaagggcgaggugcuauaucucggguacuaccaguccgcauucgacugggaugacgaaacagccaaagccucuaagcagcauaggcugaagcgguaucacagccaaacuuacggaaaugguuccaaaugugaucuuaacggccgcccaagagaggcagaagucagguuucugugcgacgagggggccggaaucucaggcgauuauauagaccggguggaugagcccuugaguuguagcuacguucucaccauccgcacaccucgacugugcccacauccguuacugagacccccuccaucugcugcuccccaggcgauucucugucacccuucccuucagccagaagaguauauggcauacgugcagaggcaagccgacucaaagcaguauggugauaaaaucauugaagaacugcaggacuuggggccccaagucuggagcgaaaccaagaguggaguggcuccgcagaaaauggccggcgcaucuccuacuaaggacgauuccaaggacagcgauuucuggaaaaugcuaaaugagcccgaggaccaggcuccaggcggggaagagguaccugccgaggagcaggaucccucgccagaagcggccgacucugcauccggagcucccaacgauuuucaaaauaacguucaggugaaggucauccggaguccugccgaccugauacguuucauugaggagcucaaagguggcacaaagaaagggaagccaaauaucggacaggaacagccgguggaugacgcugccgaggugccccaacgcgaaccugagaaagagagaggcgauccagaaaggcagcgggagauggaagaggaagaggacgaggacgaagaugaggacgaagaugaggacgaacgacagcugcuuggugaguuugagaaggaacuggaggggauuuugcuccccucagaucgcgacagacugaggagcgaagucaaggcaggcauggagcgggaauuagagaacaucauccaggagaccgaaaaagagcuggauccugacggacuaaagaaagaauccgagcgcgauagagccaugcucgcucugacgucuacucuuaauaaguugauuaaaaggcuggaggaaaagcaaagcccagagcucguuaagaaacacaagaaaaagcgugugguacccaaaaagccgccuccaucaccccagccuaccgaagaggaccccgaacaucgggugcgagucagagugacaaagcugaggcuuggcgggccaaaccaggaucugacuguuuuggagaugaaacgcgagaauccucagcucaagcaaauagaaggacuggugaaagaguuacuggaacgggagggucuaaccgcggcaggcaagaucgaaauuaaaaucgucagacccugggccgaggggacagaggaaggagcuagguggcucaccgacgaggauacgcgcaaccugaaggaaauauucuuuaauauucuugugccaggcgccgaggaagcacagaaggagcgacagcggcaaaaagaguuggaaaguaacuaccguagaguaugggguuccccgggaggcgagggaacuggcgaccuggacgaguucgauuuuuga

SEQ ID NO: 2958 - RNA, 2004 nt, Artificial Sequence
  derived and/or modified sequence opt4 from OS-9__Homo_sapiens__AAB06495
auggccgccgagacccugcugagcagccugcugggccugcugcugcugggccugcugcugcccgccagccugaccggcggcgugggcagccugaaccuggaggagcugagcgagaugagauacggcaucgagauccugccccugcccgugaugggcggccagagccagagcagcgacguggugaucgugagcagcaaguacaagcagagauacgagugcagacugcccgccggcgccauccacuuccagagagagagagaggaggagacccccgccuaccagggccccggcauccccgagcugcugagccccaugagagacgcccccugccugcugaagaccaaggacugguggaccuacgaguucugcuacggcagacacauccagcaguaccacauggaggacagcgagaucaagggcgaggugcuguaccugggcuacuaccagagcgccuucgacugggacgacgagaccgccaaggccagcaagcagcacagacugaagagauaccacagccagaccuacggcaacggcagcaagugcgaccugaacggcagacccagagaggccgaggugagauuccugugcgacgagggcgccggcaucagcggcgacuacaucgacagaguggacgagccccugagcugcagcuacgugcugaccaucagaacccccagacugugcccccacccccugcugagacccccccccagcgccgccccccaggccauccugugccaccccagccugcagcccgaggaguacauggccuacgugcagagacaggccgacagcaagcaguacggcgacaagaucaucgaggagcugcaggaccugggcccccagguguggagcgagaccaagagcggcguggccccccagaagauggccggcgccagccccaccaaggacgacagcaaggacagcgacuucuggaagaugcugaacgagcccgaggaccaggcccccggcggcgaggaggugcccgccgaggagcaggaccccagccccgaggccgccgacagcgccagcggcgcccccaacgacuuccagaacaacgugcaggugaaggugaucagaagccccgccgaccugaucagauucaucgaggagcugaagggcggcaccaagaagggcaagcccaacaucggccaggagcagcccguggacgacgccgccgaggugccccagagagagcccgagaaggagagaggcgaccccgagagacagagagagauggaggaggaggaggacgaggacgaggacgaggacgaggacgaggacgagagacagcugcugggcgaguucgagaaggagcuggagggcauccugcugcccagcgacagagacagacugagaagcgaggugaaggccggcauggagagagagcuggagaacaucauccaggagaccgagaaggagcuggaccccgacggccugaagaaggagagcgagagagacagagccaugcuggcccugaccagcacccugaacaagcugaucaagagacuggaggagaagcagagccccgagcuggugaagaagcacaagaagaagagaguggugcccaagaagcccccccccagcccccagcccaccgaggaggaccccgagcacagagugagagugagagugaccaagcugagacugggcggccccaaccaggaccugaccgugcuggagaugaagagagagaacccccagcugaagcagaucgagggccuggugaaggagcugcuggagagagagggccugaccgccgccggcaagaucgagaucaagaucgugagacccugggccgagggcaccgaggagggcgccagauggcugaccgacgaggacaccagaaaccugaaggagaucuucuucaacauccuggugcccggcgccgaggaggcccagaaggagagacagagacagaaggagcuggagagcaacuacagaagaguguggggcagccccggcggcgagggcaccggcgaccuggacgaguucgacuucuga

SEQ ID NO: 2959 - RNA, 2004 nt, Artificial Sequence
  derived and/or modified sequence opt5 from OS-9__Homo_sapiens__AAB06495
auggccgcugagacccugcucagcucccugcuuggccugcuccugcuugggcugcuccugcccgccucucugacaggaggcguggggagccucaaccuggaagaacuuuccgaaaugagauacggaaucgagauucugccucucccggucaugggcgggcagucucaaagcuccgacguugugaucgugucuagcaaguauaaacagcgguacgaaugccgccugcccgcgggagcuauucacuuccagagagagcgggaggaagagacgccugccuaucagggccccggcaucccugaacuucugucccccaugcgcgaugccccuugucuccugaagaccaaagacugguggacauacgaguuuugcuaugggagacauauucaacaguaccacauggaggauagcgaaaucaagggagagguccuguaucucggcuacuaccagucugcuuucgacugggaugacgaaaccgccaaggcuuccaaacagcaucggcugaagcgcuaucacagccaaacauacgggaauggaucuaaaugugaucuuaacggcagaccgcgggaggccgaagugcgcuuucugugcgacgagggggcgggaaucuccggcgauuauauugacagaguugaugagccccucagcuguucuuacgugcugaccauccggacaccucgccuuugcccccauccucugcucagacccccgccuuccgccgcuccccaggccauucugugucacccuagccugcagcccgaagaguauauggcuuacguccagcggcaagccgacuccaagcaguauggcgauaaaaucauugaagaacuccaggaccuggggccccaaguguggucugaaaccaagagcggaguugcgccucagaaaauggccggcgcuuccccgacgaaggacgauagcaaggacucugauuucuggaaaaugcuuaaugagcccgaggaccaggccccugggggagaagaggugcccgcugaggagcaggauccuucccccgaagccgccgacagcgcuucuggcgcgccgaacgauuuucaaaauaacguccaggugaaggugauccgcagcccugccgaccugauuagauucaucgaggagcucaaagggggaaccaagaaaggcaagcccaauaucggccaggaacagccugucgaugacgcugccgagguuccccaacgggaaccugagaaagagagaggggaucccgaacgccagcgggagauggaagaggaagaggacgaggacgaagaugaggacgaagaugaggacgaaagacagcugcuuggagaguuugagaaggaacuggagggcauucuccugccguccgaucgcgaccggcugagaucugaagugaaggccgggauggagcgcgaacucgagaacaucauucaggagacagaaaaagagcuggauccugacggacuuaagaaagaaagcgagcgggauagagcuaugcuggcccucaccuccacacugaauaagcugaucaaacgccuugaggaaaagcaaagccccgagcucgugaagaaacacaagaaaaagcgggucgugcccaaaaagccuccgcccucuccucagcccaccgaagaggacccugaacauagaguucgcgugcgggucacgaagcugagacugggcgggcccaaccaggaucucacagugcuggagaugaaacgggagaauccucagcuuaagcaaauugaaggccugguuaaagagcuccuggaacgcgagggacugaccgcggcuggcaagaucgaaaucaaaauugugagacccugggccgaggggacagaggaaggagcccgguggcuuaccgacgaggauaccagaaaccucaaggaaaucuucuuuaauauucuggucccgggcgcugaggaagcccagaaggagcgccagcggcaaaaagagcuggaauccaacuacagacgcgugugggggagcccuggaggcgaggggacaggcgaccucgacgaguucgauuuuuga

SEQ ID NO: 2960 - protein, 100 aa, Artificial Sequence
  osteocalcin__Homo_sapiens__P02818
MRALTLLALLALAALCIAGQAGAKPSGAESSKGAAFVSKQEGSEVVKRPRRYLYQWLGAPVPYPDPLEPRREVCELNPDCDELADHIGFQEAYRRFYGPV

SEQ ID NO: 2961 - RNA, 303 nt, Artificial Sequence
  osteocalcin__Homo_sapiens__AAI13433
augagagcccucacacuccucgcccuauuggcccuggccgcacuuugcaucgcuggccaggcaggugcgaagcccagcggugcagaguccagcaaaggugcagccuuuguguccaagcaggagggcagcgagguagugaagagacccaggcgcuaccuguaucaauggcugggagccccaguccccuacccggauccccuggagcccaggagggaggugugugagcucaauccggacugugacgaguuggcugaccacaucggcuuucaggaggccuaucggcgcuucuacggcccggucuag

SEQ ID NO: 2962 - RNA, 303 nt, Artificial Sequence
  derived and/or modified sequence opt1 from osteocalcin__Homo_sapiens__AAI13433
augcgcgcccugacccuccuggcccugcucgcgcuggccgcccugugcaucgccggccaggccggggcgaagcccagcggcgccgaguccagcaagggggccgccuucguguccaagcaggagggcagcgaggucgugaagcggccgcgccgguaccucuaccaguggcugggggcgcccgugcccuaccccgacccgcuggagccccgccgggaggucugcgagcucaaccccgacugcgacgagcuggccgaccacaucggcuuccaggaggccuaccgccgguucuacggccccguguga

SEQ ID NO: 2963 - RNA, 303 nt, Artificial Sequence
  derived and/or modified sequence opt2 from osteocalcin__Homo_sapiens__AAI13433
augcgcgcccucacccuccucgcccuccucgcccucgccgcccucugcaucgccggccaggccggcgccaagcccuccggcgccgaguccuccaagggcgccgccuucgucuccaagcaggagggcuccgaggucgucaagcgcccccgccgcuaccucuaccaguggcucggcgcccccguccccuaccccgacccccucgagccccgccgcgaggucugcgagcucaaccccgacugcgacgagcucgccgaccacaucggcuuccaggaggccuaccgccgcuucuacggccccgucuga

SEQ ID NO: 2964 - RNA, 303 nt, Artificial Sequence
  derived and/or modified sequence opt3 from osteocalcin__Homo_sapiens__AAI13433
augagagcccugacccuccuugcucuguuggcauuagccgcgcugugcaucgcuggccaggccggggcaaagcccagcggagccgaguccucuaaaggugcugcauucgugucaaagcaagaaggcagugaggucguuaaaaggccucggcgcuaccuauaucaguggcucggggccccagugccguaccccgacccucuggaaccacgacgugagguaugugaacuuaaccccgauugcgacgagcuggcugaucacauuggauuucaggaggccuauagaagguucuacggcccuguguga

SEQ ID NO: 2965 - RNA, 303 nt, Artificial Sequence
  derived and/or modified sequence opt4 from osteocalcin__Homo_sapiens__AAI13433
augagagcccugacccugcuggcccugcuggcccuggccgcccugugcaucgccggccaggccggcgccaagcccagcggcgccgagagcagcaagggcgccgccuucgugagcaagcaggagggcagcgagguggugaagagacccagaagauaccuguaccaguggcugggcgcccccgugcccuaccccgacccccuggagcccagaagagaggugugcgagcugaaccccgacugcgacgagcuggccgaccacaucggcuuccaggaggccuacagaagauucuacggccccguguga

SEQ ID NO: 2966 - RNA, 303 nt, Artificial Sequence
  derived and/or modified sequence opt5 from osteocalcin__Homo_sapiens__AAI13433
augagagcccugacccuccuggcccuucuggcucucgcggcucugugcaucgccggccaggccggggcuaagcccagcggagccgaguccucuaaaggcgcugccuucgugagcaagcaagaaggguccgaggucguuaaacggccucgcagauaccuuuaucaguggcugggagcgccggugcccuacccugacccccucgaaccucggcgcgaggugugugaacugaaccccgauugcgacgagcuggccgaucacauuggcuuucaggaggcuuauagacgguucuacgggccugucuga

SEQ ID NO: 2967 - protein, 314 aa, Artificial Sequence
  osteopontin__Homo_sapiens__A0A024RDE2
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 2968 - RNA, 945 nt, Artificial Sequence
  osteopontin__Homo_sapiens__EAX06008
augagaauugcagugauuugcuuuugccuccuaggcaucaccugugccauaccaguuaaacaggcugauucuggaaguucugaggaaaagcagcuuuacaacaaauacccagaugcuguggccacauggcuaaacccugacccaucucagaagcagaaucuccuagccccacagaaugcuguguccucugaagaaaccaaugacuuuaaacaagagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaa

SEQ ID NO: 2969 - RNA, 945 nt, Artificial Sequence
  derived and/or modified sequence opt1 from osteopontin__Homo_sapiens__EAX06008
augcgcaucgccgugaucugcuucugccugcucggcaucacgugcgccauccccgucaagcaggcggacagcggguccagcgaggagaagcagcuguacaacaaguacccggacgccguggccaccuggcugaaccccgaccccucccagaagcagaaccuccuggcgccccagaacgccgugagcuccgaggagaccaacgacuucaagcaggagacccugccgagcaaguccaacgagagccacgaccacauggacgacauggacgacgaggacgacgacgaccacgucgacucccaggacagcaucgacuccaacgacagcgacgacguggacgacaccgacgacucccaccagagcgacgagucccaccacagcgacgaguccgacgagcucgugaccgacuuccccacggaccugcccgccaccgaggucuucacccccguggugccgaccgucgacacguacgacggccgcggggacagcgugguguacggccugcgguccaagagcaagaaguuccggcgccccgacauccaguaccccgacgccaccgacgaggacaucaccagccacauggaguccgaggagcucaacggggccuacaaggccauccccgucgcgcaggaccugaacgccccgagcgacugggacucccggggcaaggacagcuacgagaccucccagcuggacgaccagagcgccgagacgcacucccacaagcagagccgccucuacaagcggaaggccaacgacgaguccaacgagcacagcgacgugaucgacucccaggagcugagcaaggugucccgcgaguuccacagccacgaguuccacucccacgaggacaugcuggucguggaccccaagagcaaggaggaggacaagcaccucaaguuccggaucucccacgagcuggacagcgccuccagcgaggugaacuga

SEQ ID NO: 2970 - RNA, 945 nt, Artificial Sequence
  derived and/or modified sequence opt2 from osteopontin__Homo_sapiens__EAX06008
augcgcaucgccgucaucugcuucugccuccucggcaucaccugcgccauccccgucaagcaggccgacuccggcuccuccgaggagaagcagcucuacaacaaguaccccgacgccgucgccaccuggcucaaccccgaccccucccagaagcagaaccuccucgccccccagaacgccgucuccuccgaggagaccaacgacuucaagcaggagacccuccccuccaaguccaacgagucccacgaccacauggacgacauggacgacgaggacgacgacgaccacgucgacucccaggacuccaucgacuccaacgacuccgacgacgucgacgacaccgacgacucccaccaguccgacgagucccaccacuccgacgaguccgacgagcucgucaccgacuuccccaccgaccuccccgccaccgaggucuucacccccgucguccccaccgucgacaccuacgacggccgcggcgacuccgucgucuacggccuccgcuccaaguccaagaaguuccgccgccccgacauccaguaccccgacgccaccgacgaggacaucaccucccacauggaguccgaggagcucaacggcgccuacaaggccauccccgucgcccaggaccucaacgcccccuccgacugggacucccgcggcaaggacuccuacgagaccucccagcucgacgaccaguccgccgagacccacucccacaagcagucccgccucuacaagcgcaaggccaacgacgaguccaacgagcacuccgacgucaucgacucccaggagcucuccaaggucucccgcgaguuccacucccacgaguuccacucccacgaggacaugcucgucgucgaccccaaguccaaggaggaggacaagcaccucaaguuccgcaucucccacgagcucgacuccgccuccuccgaggucaacuga

SEQ ID NO: 2971 - RNA, 945 nt, Artificial Sequence
  derived and/or modified sequence opt3 from osteopontin__Homo_sapiens__EAX06008
augagaaucgccgugauuugcuucugucugcucggcauaaccugcgcuauccccgucaagcaggcagacagcggguccucugaggaaaaacaacuuuacaacaaguauccugaugccguugcgacauggcugaauccagacccgucacagaaacagaacuuguuagcuccccagaaugccgugaguagcgaggaaacuaacgauuuuaagcaagagacgcugccuuccaaaucuaaugaaucgcacgaccauauggaugacauggaugacgaggaugacgaugaccacguagauucacaggacagcauugacaguaacgauuccgacgauguggacgauaccgacgauucucaucagagcgacgagucccaccauucagaugaaagugacgagcuagucacagauuucccaacugaccuccccgcaaccgaaguguuuacaccuguugugccaaccgucgacacuuacgauggaaggggugacagcgugguauauggccugcggucuaaguccaagaaauuccgccgacccgauauccaguacccugacgccacagaugaggacauuaccucacacauggagagcgaggaacuuaauggggcuuauaaggcaaucccaguugcccaagaucugaacgcuccgagugacugggauucucguggaaaagacuccuacgaaacgagccaguuggaugaccagucggccgagacucacucucauaagcaguccagacucuauaaaaggaaggcgaaugaugaaucaaacgagcacagugacgugauagacagccaagagcuguccaaggucucucgggaauuucauagccacgaguuccacucacaugaagauaugcuggugguggaccccaaaaguaaggaggaagauaaacaccucaaguuucgcaucucccaugaguuagacagcgcaucuucagaggucaauuga

SEQ ID NO: 2972 - RNA, 945 nt, Artificial Sequence
  derived and/or modified sequence opt4 from osteopontin__Homo_sapiens__EAX06008
augagaaucgccgugaucugcuucugccugcugggcaucaccugcgccauccccgugaagcaggccgacagcggcagcagcgaggagaagcagcuguacaacaaguaccccgacgccguggccaccuggcugaaccccgaccccagccagaagcagaaccugcuggccccccagaacgccgugagcagcgaggagaccaacgacuucaagcaggagacccugcccagcaagagcaacgagagccacgaccacauggacgacauggacgacgaggacgacgacgaccacguggacagccaggacagcaucgacagcaacgacagcgacgacguggacgacaccgacgacagccaccagagcgacgagagccaccacagcgacgagagcgacgagcuggugaccgacuuccccaccgaccugcccgccaccgagguguucacccccguggugcccaccguggacaccuacgacggcagaggcgacagcgugguguacggccugagaagcaagagcaagaaguucagaagacccgacauccaguaccccgacgccaccgacgaggacaucaccagccacauggagagcgaggagcugaacggcgccuacaaggccauccccguggcccaggaccugaacgcccccagcgacugggacagcagaggcaaggacagcuacgagaccagccagcuggacgaccagagcgccgagacccacagccacaagcagagcagacuguacaagagaaaggccaacgacgagagcaacgagcacagcgacgugaucgacagccaggagcugagcaaggugagcagagaguuccacagccacgaguuccacagccacgaggacaugcuggugguggaccccaagagcaaggaggaggacaagcaccugaaguucagaaucagccacgagcuggacagcgccagcagcgaggugaacuga

SEQ ID NO: 2973 - RNA, 945 nt, Artificial Sequence
  derived and/or modified sequence opt5 from osteopontin__Homo_sapiens__EAX06008
augagaaucgccgugauuugcuucugucugcucggcauuaccugcgcuauccccgucaagcaggccgacagcggguccucugaggaaaaacaacuguacaacaaguauccugaugcgguugcuacauggcuuaauccggaccccagccagaaacagaaccugcucgccccucagaaugccguguccucugaggaaacgaacgauuuuaagcaagagacccugcccagcaaauccaaugaaucucacgaccauauggaugacauggaugacgaggaugacgaugaccacguggauagccaggacuccaucgacagcaacgauucugacgaugucgacgauacagacgauucccaucagagcgacgagucucaccauuccgaugaaagcgacgagcuugugaccgauuucccuacagaccugcccgcuaccgaaguuuuuacaccuguggucccgaccguggacacguacgauggacggggcgacucuguuguguaugggcuccgcuccaagagcaagaaauucagacggcccgauauucaguacccugacgccaccgaugaggacaucacaucccacauggagucugaggaacugaauggagcuuauaaggccauccccgucgcgcaagaucugaacgccccuagcgacugggauucccgcggcaaagacagcuacgaaaccucucagcucgaugaccaguccgcugagacacacagccauaagcagucuagacuguauaaacggaaggccaaugaugaaagcaacgagcacuccgacgugauugacucucaagagcuuagcaaggugucccgcgaauuucauagccacgaguuccacucucaugaagauaugcuggucguugaccccaaauccaaggaggaagauaaacaccucaaguuuagaaucagccaugagcuggacucugcuuccagcgaggugaauuga

SEQ ID NO: 2974 - protein, 300 aa, Artificial Sequence
  osteopontin__Homo_sapiens__A0A024RDE6
MRIAVICFCLLGITCAIPVKQADSGSSEEKQLYNKYPDAVATWLNPDPSQKQNLLAPQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 2975 - RNA, 903 nt, Artificial Sequence
  osteopontin__Homo_sapiens__EAX06009
augagaauugcagugauuugcuuuugccuccuaggcaucaccugugccauaccaguuaaacaggcugauucuggaaguucugaggaaaagcagcuuuacaacaaauacccagaugcuguggccacauggcuaaacccugacccaucucagaagcagaaucuccuagccccacagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaa

SEQ ID NO: 2976 - RNA, 903 nt, Artificial Sequence
  derived and/or modified sequence opt1 from osteopontin__Homo_sapiens__EAX06009
augcgcaucgccgugaucugcuucugccugcucggcaucacgugcgccauccccgucaagcaggcggacagcggguccagcgaggagaagcagcuguacaacaaguacccggacgccguggccaccuggcugaaccccgaccccucccagaagcagaaccuccuggcgccccagacccugccgagcaaguccaacgagagccacgaccacauggacgacauggacgacgaggacgacgacgaccacguggacucccaggacagcaucgacuccaacgacagcgacgacgucgacgacaccgacgacucccaccagagcgacgagucccaccacagcgacgaguccgacgagcucgugaccgacuuccccaccgaccugcccgccacggagguguucacccccgucgugccgaccguggacaccuacgacggccgcggggacagcgucguguacggccugcgguccaagagcaagaaguuccggcgccccgacauccaguaccccgacgccacggacgaggacaucaccucccacauggagagcgaggagcucaacggggccuacaaggccauccccguggcccaggaccugaacgcgccgagcgacugggacucccggggcaaggacagcuacgagaccucccagcuggacgaccagagcgccgagacccacucccacaagcagagccgccucuacaagcggaaggccaacgacgaguccaacgagcacagcgacgucaucgacucccaggagcugagcaaggugucccgcgaguuccacagccacgaguuccacucccacgaggacaugcugguggucgaccccaagagcaaggaggaggacaagcaccucaaguuccggaucucccacgagcuggacagcgccuccagcgaggugaacuga

SEQ ID NO: 2977 - RNA, 903 nt, Artificial Sequence
  derived and/or modified sequence opt2 from osteopontin__Homo_sapiens__EAX06009
augcgcaucgccgucaucugcuucugccuccucggcaucaccugcgccauccccgucaagcaggccgacuccggcuccuccgaggagaagcagcucuacaacaaguaccccgacgccgucgccaccuggcucaaccccgaccccucccagaagcagaaccuccucgccccccagacccuccccuccaaguccaacgagucccacgaccacauggacgacauggacgacgaggacgacgacgaccacgucgacucccaggacuccaucgacuccaacgacuccgacgacgucgacgacaccgacgacucccaccaguccgacgagucccaccacuccgacgaguccgacgagcucgucaccgacuuccccaccgaccuccccgccaccgaggucuucacccccgucguccccaccgucgacaccuacgacggccgcggcgacuccgucgucuacggccuccgcuccaaguccaagaaguuccgccgccccgacauccaguaccccgacgccaccgacgaggacaucaccucccacauggaguccgaggagcucaacggcgccuacaaggccauccccgucgcccaggaccucaacgcccccuccgacugggacucccgcggcaaggacuccuacgagaccucccagcucgacgaccaguccgccgagacccacucccacaagcagucccgccucuacaagcgcaaggccaacgacgaguccaacgagcacuccgacgucaucgacucccaggagcucuccaaggucucccgcgaguuccacucccacgaguuccacucccacgaggacaugcucgucgucgaccccaaguccaaggaggaggacaagcaccucaaguuccgcaucucccacgagcucgacuccgccuccuccgaggucaacuga

SEQ ID NO: 2978 - RNA, 903 nt, Artificial Sequence
  derived and/or modified sequence opt3 from osteopontin__Homo_sapiens__EAX06009
augagaaucgccgugauuugcuucugucugcucggcauaaccugcgcuauccccgucaagcaggcagacagcggguccucugaggaaaaacaacuuuacaacaaguauccugaugccguugcgacauggcugaauccagacccgucacagaaacagaacuuguuagcuccccagacucugccuaguaagagcaaugagucccacgaucauauggacgauauggacgaugaagacgaugacgaucacguggacucucaagauucgauugacucaaacgacagcgaugacguagaugacacggaugacagucaucaguccgaugagucucaccauagcgacgaauccgaugagcuagugaccgacuuuccaacagaucuccccgccacugaggucuucaccccugugguuccaacaguggacaccuacgacggaaggggugauucagucguguauggccugcggaguaaaagcaagaaguuucgccgacccgacauccaguacccugaugcaacugacgaagauauuacaucucacauggaguccgaagaacuuaauggggccuauaaagcuaucccaguagcacaggaccugaacgccccgucagauugggacagccguggaaaggauaguuacgagaccucucaauuggacgaucaguccgcugaaacgcacagccauaaacagucgagacucuauaagaggaaagccaaugacgagucuaacgaacacuccgauguuauagacucacaggagcugaguaaggugagccgggaguuccauucccacgaguuucacucucaugaggacaugcuggucguggaucccaagagcaaagaagaggacaagcaccucaaauuccgcaucucacaugaauuagauagugcguccagcgaggugaauuga

SEQ ID NO: 2979 - RNA, 903 nt, Artificial Sequence
  derived and/or modified sequence opt4 from osteopontin__Homo_sapiens__EAX06009
augagaaucgccgugaucugcuucugccugcugggcaucaccugcgccauccccgugaagcaggccgacagcggcagcagcgaggagaagcagcuguacaacaaguaccccgacgccguggccaccuggcugaaccccgaccccagccagaagcagaaccugcuggccccccagacccugcccagcaagagcaacgagagccacgaccacauggacgacauggacgacgaggacgacgacgaccacguggacagccaggacagcaucgacagcaacgacagcgacgacguggacgacaccgacgacagccaccagagcgacgagagccaccacagcgacgagagcgacgagcuggugaccgacuuccccaccgaccugcccgccaccgagguguucacccccguggugcccaccguggacaccuacgacggcagaggcgacagcgugguguacggccugagaagcaagagcaagaaguucagaagacccgacauccaguaccccgacgccaccgacgaggacaucaccagccacauggagagcgaggagcugaacggcgccuacaaggccauccccguggcccaggaccugaacgcccccagcgacugggacagcagaggcaaggacagcuacgagaccagccagcuggacgaccagagcgccgagacccacagccacaagcagagcagacuguacaagagaaaggccaacgacgagagcaacgagcacagcgacgugaucgacagccaggagcugagcaaggugagcagagaguuccacagccacgaguuccacagccacgaggacaugcuggugguggaccccaagagcaaggaggaggacaagcaccugaaguucagaaucagccacgagcuggacagcgccagcagcgaggugaacuga

SEQ ID NO: 2980 - RNA, 903 nt, Artificial Sequence
  derived and/or modified sequence opt5 from osteopontin__Homo_sapiens__EAX06009
augagaaucgccgugauuugcuucugucugcucggcauuaccugcgcuauccccgucaagcaggccgacagcggguccucugaggaaaaacaacuguacaacaaguauccugaugcgguugcuacauggcuuaauccggaccccagccagaaacagaaccugcucgccccucagacgcugcccuccaagucuaaugagagccacgaucauauggacgauauggacgaugaagacgaugacgaucacguggacucccaagauucuaucgacagcaacgacuccgaugacguggaugacaccgaugacagccaucagucugaugagucccaccauagcgacgaaucugaugagcuugucacagacuuuccuaccgaucugcccgccacagagguguucaccccuguugugccgacagucgacaccuacgacggacggggcgauuccgugguuuaugggcuccgcagcaaaucuaagaaguuuagacggcccgacauucaguacccugaugcuacggacgaagauaucaccucccacauggagagcgaagaacugaauggagccuauaaagcuauccccguggcccaggaccugaacgcgccuuccgauugggacucucgcggcaaggauagcuacgagacaucccaacucgacgaucagagcgccgaaacccacucucauaaacaguccagacuguauaagcggaaagcuaaugacgagagcaacgaacacucugaugucauugacagccaggagcuuuccaaggugucucgcgaguuccauagccacgaguuucacucccaugaggacaugcugguggucgaucccaagagcaaagaagaggacaagcaccucaaauucagaaucucucaugaacuggauuccgccagcucugagguuaauuga

SEQ ID NO: 2981 - protein, 287 aa, Artificial Sequence
  osteopontin__Homo_sapiens__A0A024RDJ0
MRIAVICFCLLGITCAIPVKQADSGSSEEKQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 2982 - RNA, 864 nt, Artificial Sequence
  osteopontin__Homo_sapiens__EAX06010
augagaauugcagugauuugcuuuugccuccuaggcaucaccugugccauaccaguuaaacaggcugauucuggaaguucugaggaaaagcagaaugcuguguccucugaagaaaccaaugacuuuaaacaagagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaa

SEQ ID NO: 2983 - RNA, 864 nt, Artificial Sequence
  derived and/or modified sequence opt1 from osteopontin__Homo_sapiens__EAX06010
augcgcaucgccgugaucugcuucugccugcucggcaucacgugcgccauccccgucaagcaggcggacagcggguccagcgaggagaagcagaacgccguguccagcgaggagaccaacgacuucaagcaggagacccugccguccaagagcaacgagucccacgaccacauggacgacauggacgacgaggacgacgacgaccacguggacagccaggacuccaucgacagcaacgacuccgacgacgucgacgacaccgacgacagccaccaguccgacgagagccaccacuccgacgagagcgacgagcuggugaccgacuuccccaccgaccuccccgccacggagguguucacccccgucgugccgaccguggacaccuacgacggccgcggggacuccgucguguacggccugcggagcaaguccaagaaguuccggcgccccgacauccaguaccccgacgccacggacgaggacaucaccagccacauggagagcgaggagcugaacggggccuacaaggcgauccccguggcccaggaccucaacgccccguccgacugggacagccggggcaaggacuccuacgagaccagccagcuggacgaccaguccgccgagacccacagccacaagcagucccgccuguacaagcggaaggcgaacgacgagagcaacgagcacuccgacgucaucgacagccaggagcucuccaaggugagccgcgaguuccacucccacgaguuccacagccacgaggacaugcugguggucgaccccaaguccaaggaggaggacaagcaccugaaguuccggaucagccacgagcucgacuccgccagcuccgaggugaacuga

SEQ ID NO: 2984 - RNA, 864 nt, Artificial Sequence
  derived and/or modified sequence opt2 from osteopontin__Homo_sapiens__EAX06010
augcgcaucgccgucaucugcuucugccuccucggcaucaccugcgccauccccgucaagcaggccgacuccggcuccuccgaggagaagcagaacgccgucuccuccgaggagaccaacgacuucaagcaggagacccuccccuccaaguccaacgagucccacgaccacauggacgacauggacgacgaggacgacgacgaccacgucgacucccaggacuccaucgacuccaacgacuccgacgacgucgacgacaccgacgacucccaccaguccgacgagucccaccacuccgacgaguccgacgagcucgucaccgacuuccccaccgaccuccccgccaccgaggucuucacccccgucguccccaccgucgacaccuacgacggccgcggcgacuccgucgucuacggccuccgcuccaaguccaagaaguuccgccgccccgacauccaguaccccgacgccaccgacgaggacaucaccucccacauggaguccgaggagcucaacggcgccuacaaggccauccccgucgcccaggaccucaacgcccccuccgacugggacucccgcggcaaggacuccuacgagaccucccagcucgacgaccaguccgccgagacccacucccacaagcagucccgccucuacaagcgcaaggccaacgacgaguccaacgagcacuccgacgucaucgacucccaggagcucuccaaggucucccgcgaguuccacucccacgaguuccacucccacgaggacaugcucgucgucgaccccaaguccaaggaggaggacaagcaccucaaguuccgcaucucccacgagcucgacuccgccuccuccgaggucaacuga

SEQ ID NO: 2985 - RNA, 864 nt, Artificial Sequence
  derived and/or modified sequence opt3 from osteopontin__Homo_sapiens__EAX06010
augagaaucgccgugauuugcuucugucugcucggcauaaccugcgcuauccccgucaagcaggcagacagcggguccucugaggaaaaacaaaacgccguuucaagugaggaaacaaaugauuuuaagcaggagacucuuccuagcaaauccaacgaaucucacgaccauauggaugacauggaugacgaggaugacgaugaccacguggauucgcaggacucaauugauagcaaugacagugacgauguagacgauacggacgauucccaucagucugacgagagccaccauuccgaugaaucagacgagcuggugaccgauuucccaacagacuugccggcgacugaagucuuuacccccgugguuccuacaguggauaccuacgacggaaggggugacagugucguguauggcuuacggagcaagucuaaaaaguuccgccgaccagauauccaauaccccgacgcuacugaugaggacauuacaucccacauggagucagaggaacugaacggggccuauaaggcaaucccuguagcccaggaucuaaaugcuccaagcgacugggauagucguggaaaagacucuuacgaaaccucccagcucgaugaccagagcgcagagacgcacucgcauaagcaaucuagacuguauaaaaggaaggccaacgaugaauccaaugagcacucagacguuauagauagucaggagcuuagcaaagugucccgggaauuucauucucacgaguuccacagccaugaagacaugcuggucguggaccccaagucaaaggaggaagauaaacacuugaaguuucgcaucagucaugagcucgacuccgcuagcucugaggugaacuga

SEQ ID NO: 2986 - RNA, 864 nt, Artificial Sequence
  derived and/or modified sequence opt4 from osteopontin__Homo_sapiens__EAX06010
augagaaucgccgugaucugcuucugccugcugggcaucaccugcgccauccccgugaagcaggccgacagcggcagcagcgaggagaagcagaacgccgugagcagcgaggagaccaacgacuucaagcaggagacccugcccagcaagagcaacgagagccacgaccacauggacgacauggacgacgaggacgacgacgaccacguggacagccaggacagcaucgacagcaacgacagcgacgacguggacgacaccgacgacagccaccagagcgacgagagccaccacagcgacgagagcgacgagcuggugaccgacuuccccaccgaccugcccgccaccgagguguucacccccguggugcccaccguggacaccuacgacggcagaggcgacagcgugguguacggccugagaagcaagagcaagaaguucagaagacccgacauccaguaccccgacgccaccgacgaggacaucaccagccacauggagagcgaggagcugaacggcgccuacaaggccauccccguggcccaggaccugaacgcccccagcgacugggacagcagaggcaaggacagcuacgagaccagccagcuggacgaccagagcgccgagacccacagccacaagcagagcagacuguacaagagaaaggccaacgacgagagcaacgagcacagcgacgugaucgacagccaggagcugagcaaggugagcagagaguuccacagccacgaguuccacagccacgaggacaugcuggugguggaccccaagagcaaggaggaggacaagcaccugaaguucagaaucagccacgagcuggacagcgccagcagcgaggugaacuga

SEQ ID NO: 2987 - RNA, 864 nt, Artificial Sequence
  derived and/or modified sequence opt5 from osteopontin__Homo_sapiens__EAX06010
augagaaucgccgugauuugcuucugucugcucggcauuaccugcgcuauccccgucaagcaggccgacagcggguccucugaggaaaaacaaaacgcgguuagcuccgaggaaacaaaugauuuuaagcaggagacgcugccuucuaaaagcaacgaaucccacgaccauauggaugacauggaugacgaggaugacgaugaccacguggauucucaggacagcaucgauuccaaugacagcgacgauguggacgauaccgacgauucucaucaguccgacgagagccaccauucugaugaauccgacgagcuugucacagauuucccgaccgaccugcccgcuacagaaguguuuaccccuguugugcccacagucgauaccuacgacggacggggcgacagcgugguuuaugggcuccgcucuaaguccaaaaaguucagacggccugauauucaauaccccgacgccacggaugaggacaucaccagccacauggaguccgaggaacugaacggagccuauaaggcuaucccuguggcccaggaucuuaaugcuccgucugacugggauagccgcggcaaagacuccuacgaaacaagccagcuggaugaccagucugccgagacccacucccauaagcaaagcagacucuauaaacggaaggcgaacgaugaaucuaaugagcacagcgacgucauugauucccaggagcugucuaaagugagccgcgaauuucauucccacgaguuccacagccaugaagacaugcugguggucgaccccaagucuaaggaggaagauaaacaccucaaguuuagaaucucccaugagcuggacagcgccucuuccgagguuaacuga

SEQ ID NO: 2988 - protein, 327 aa, Artificial Sequence
  osteopontin__Homo_sapiens__B7Z351
MGIVPRSLDKKAHRVQFQLNRIKAKIELPWGSLQLDCLMKTLKELYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 2989 - RNA, 984 nt, Artificial Sequence
  osteopontin__Homo_sapiens__BAH12087
augggcauuguccccagaagcuuggacaaaaaggcacacagaguucaauuccaguugaacagaauaaaggccaaaauagagcugccuugggggucacugcaauuagacugcuugaugaagacauuaaaagaacuuuacaacaaauacccagaugcuguggccacauggcuaaacccugacccaucucagaagcagaaucuccuagccccacagaaugcuguguccucugaagaaaccaaugacuuuaaacaagagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaa

SEQ ID NO: 2990 - RNA, 984 nt, Artificial Sequence
  derived and/or modified sequence opt1 from osteopontin__Homo_sapiens__BAH12087
augggcaucgugccccgcagccuggacaagaaggcccaccggguccaguuccagcucaaccgcaucaaggccaagaucgagcugccgugggggucccugcagcucgacugccugaugaagacccugaaggagcucuacaacaaguaccccgacgcgguggccaccuggcugaaccccgaccccagccagaagcagaaccugcucgccccgcagaacgccguguccagcgaggagacgaacgacuucaagcaggagacccugcccuccaagagcaacgagucccacgaccacauggacgacauggacgacgaggacgacgacgaccacgucgacagccaggacuccaucgacagcaacgacuccgacgacguggacgacaccgacgacagccaccaguccgacgagagccaccacuccgacgagagcgacgagcuggugaccgacuuccccacggaccuccccgccaccgaggucuucaccccgguggugcccaccgucgacacguacgacggccgcggggacuccgugguguacggccugcggagcaaguccaagaaguuccggcgccccgacauccaguaccccgacgcgaccgacgaggacaucaccagccacauggagagcgaggagcugaacggggccuacaaggccaucccggucgcccaggaccucaacgcgcccuccgacugggacagccggggcaaggacuccuacgagaccagccagcuggacgaccaguccgccgagacgcacagccacaagcagucccgccuguacaagcggaaggccaacgacgagagcaacgagcacuccgacgugaucgacagccaggagcucuccaaggugagccgcgaguuccacucccacgaguuccacagccacgaggacaugcuggucguggaccccaaguccaaggaggaggacaagcaccugaaguuccggaucagccacgagcucgacuccgccagcuccgaggugaacuga

SEQ ID NO: 2991 - RNA, 984 nt, Artificial Sequence
  derived and/or modified sequence opt2 from osteopontin__Homo_sapiens__BAH12087
augggcaucgucccccgcucccucgacaagaaggcccaccgcguccaguuccagcucaaccgcaucaaggccaagaucgagcuccccuggggcucccuccagcucgacugccucaugaagacccucaaggagcucuacaacaaguaccccgacgccgucgccaccuggcucaaccccgaccccucccagaagcagaaccuccucgccccccagaacgccgucuccuccgaggagaccaacgacuucaagcaggagacccuccccuccaaguccaacgagucccacgaccacauggacgacauggacgacgaggacgacgacgaccacgucgacucccaggacuccaucgacuccaacgacuccgacgacgucgacgacaccgacgacucccaccaguccgacgagucccaccacuccgacgaguccgacgagcucgucaccgacuuccccaccgaccuccccgccaccgaggucuucacccccgucguccccaccgucgacaccuacgacggccgcggcgacuccgucgucuacggccuccgcuccaaguccaagaaguuccgccgccccgacauccaguaccccgacgccaccgacgaggacaucaccucccacauggaguccgaggagcucaacggcgccuacaaggccauccccgucgcccaggaccucaacgcccccuccgacugggacucccgcggcaaggacuccuacgagaccucccagcucgacgaccaguccgccgagacccacucccacaagcagucccgccucuacaagcgcaaggccaacgacgaguccaacgagcacuccgacgucaucgacucccaggagcucuccaaggucucccgcgaguuccacucccacgaguuccacucccacgaggacaugcucgucgucgaccccaaguccaaggaggaggacaagcaccucaaguuccgcaucucccacgagcucgacuccgccuccuccgaggucaacuga

SEQ ID NO: 2992 - RNA, 984 nt, Artificial Sequence
  derived and/or modified sequence opt3 from osteopontin__Homo_sapiens__BAH12087
augggcaucgugcccagaagccuggacaagaaagcccacaggguccaguuccaacucaaccggauuaaggcuaaaauagagcuuccuugggggucccugcaguuggauugcuuaaugaagacccugaaagaacuauacaauaaguauccagacgcaguugccacauggcucaacccggaucccucucagaagcagaaucugcuugcgccucaaaacgcugugucaagugaggaaacuaaugacuuuaaacaggagacgcugccaagcaaguccaacgaaucucaugaucacauggacgauauggacgaugaggacgaugacgaucauguagacucgcaggacucaaucgauagcaaugacagugaugacguggaugacaccgaugacucccaccagucugaugagagccaucacuccgacgaaucagaugaguuggucacagacuuccccacugaccucccugccaccgaaguguuuacaccaguugugcccaccgucgauacuuacgacggacgcggugauagugugguauauggccugcgaagcaaaucuaagaaauuccguagaccugacauucaauacccagaugcaacagacgaggauaucaccucccacauggagucagaggaacugaacggggccuauaaggcuauuccgguugcacaggaccucaaugcccccagcgauugggacaguaggggaaaggauucuuacgaaacgucccaguuagacgaucagagcgcugagacucauucgcacaaacaaucucggcuguauaagcgcaaagccaacgacgaauccaaugagcauucagacgugaucgauagucaggagcuuagcaaggucuccagagaauuucacucucacgaguuccauagccacgaagacauguuggugguggauccuaaaucaaaggaggaagacaaacaucugaaguuuaggauaagucacgagcuagauuccgcgagcucugaggucaacuga

SEQ ID NO: 2993 - RNA, 984 nt, Artificial Sequence
  derived and/or modified sequence opt4 from osteopontin__Homo_sapiens__BAH12087
augggcaucgugcccagaagccuggacaagaaggcccacagagugcaguuccagcugaacagaaucaaggccaagaucgagcugcccuggggcagccugcagcuggacugccugaugaagacccugaaggagcuguacaacaaguaccccgacgccguggccaccuggcugaaccccgaccccagccagaagcagaaccugcuggccccccagaacgccgugagcagcgaggagaccaacgacuucaagcaggagacccugcccagcaagagcaacgagagccacgaccacauggacgacauggacgacgaggacgacgacgaccacguggacagccaggacagcaucgacagcaacgacagcgacgacguggacgacaccgacgacagccaccagagcgacgagagccaccacagcgacgagagcgacgagcuggugaccgacuuccccaccgaccugcccgccaccgagguguucacccccguggugcccaccguggacaccuacgacggcagaggcgacagcgugguguacggccugagaagcaagagcaagaaguucagaagacccgacauccaguaccccgacgccaccgacgaggacaucaccagccacauggagagcgaggagcugaacggcgccuacaaggccauccccguggcccaggaccugaacgcccccagcgacugggacagcagaggcaaggacagcuacgagaccagccagcuggacgaccagagcgccgagacccacagccacaagcagagcagacuguacaagagaaaggccaacgacgagagcaacgagcacagcgacgugaucgacagccaggagcugagcaaggugagcagagaguuccacagccacgaguuccacagccacgaggacaugcuggugguggaccccaagagcaaggaggaggacaagcaccugaaguucagaaucagccacgagcuggacagcgccagcagcgaggugaacuga

SEQ ID NO: 2994 - RNA, 984 nt, Artificial Sequence
  derived and/or modified sequence opt5 from osteopontin__Homo_sapiens__BAH12087
augggcaucgugcccagaagccuggacaagaaagcccaccggguccaguuccaacucaaccgcauuaaggcuaaaaucgagcugccuugggggucccuucagcuggauugccucaugaagacccugaaagaacuuuacaauaaguauccggacgccguugcgacauggcugaaccccgauccuucucagaagcagaaucuccuggcuccccaaaacgccgugagcuccgaggaaacgaaugacuuuaaacaggagacccugccuucuaagagcaacgaaucccaugaucacauggacgauauggacgaugaggacgaugacgaucauguggacucucaggacagcauugauuccaaugacagcgaugacgucgaugacacagaugacucucaccaguccgaugagagccaucacucugacgaauccgaugagcucgugaccgacuuccccacagaccugccugccaccgaaguuuuuacaccggugguccccaccguggauacguacgacggaagaggcgauagcguuguguaugggcuucggucuaaauccaagaaauuccgcagaccugacauccaauaccccgaugcuaccgacgaggauauuacaagccacauggaguccgaggaacugaacggagccuauaaggcuaucccugucgcccaggaccucaaugcgcccucugauugggacagccggggcaaggauuccuacgaaaccagccagcuggacgaucagucugccgagacacauucccacaaacaaagccgccuuuauaagagaaaagcuaacgacgaaucuaaugagcauagcgacgugaucgauucccaggagcugucuaaggugagccgggaauuucacucccacgaguuccauagccacgaagacaugcucgucguugauccgaaaucuaaggaggaagacaaacaucugaaguuucgcauuucccacgagcuggauagcgccucuuccgaggugaacuga

SEQ ID NO: 2995 - protein, 292 aa, Artificial Sequence
  osteopontin__Homo_sapiens__F2YQ21
MRIAVICFCLLGITCAIPVKQADSGSSEEKQLYNKYPDAVATWLNPDPSQKQNLLAPQNAVSSEETNDFKQETLPSKSNESHDHMDDMDDEDDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 2996 - RNA, 879 nt, Artificial Sequence
  osteopontin__Homo_sapiens__AEA49030
augagaauugcagugauuugcuuuugccuccuaggcaucaccugugccauaccaguuaaacaggcugauucuggaaguucugaggaaaagcagcuuuacaacaaauacccagaugcuguggccacauggcuaaacccugacccaucucagaagcagaaucuccuagccccacagaaugcuguguccucugaagaaaccaaugacuuuaaacaagagacccuuccaaguaaguccaacgaaagccaugaccacauggaugauauggaugaugaagaugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagcuaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaa

SEQ ID NO: 2997 - RNA, 879 nt, Artificial Sequence
  derived and/or modified sequence opt1 from osteopontin__Homo_sapiens__AEA49030
augcgcaucgccgugaucugcuucugccugcucggcaucacgugcgccauccccgucaagcaggcggacagcggguccagcgaggagaagcagcuguacaacaaguacccggacgccguggccaccuggcugaaccccgaccccucccagaagcagaaccuccuggcgccccagaacgccgugagcuccgaggagaccaacgacuucaagcaggagacccugccgagcaaguccaacgagagccacgaccacauggacgacauggacgacgaggacgacgacucccaccagagcgacgagucccaccacagcgacgaguccgacgagcucgucaccgacuuccccaccgaccugcccgccacggagguguucacccccguggucccgaccguggacaccuacgacggccgcggggacagcguggucuacggccugcgguccaagagcaagaaguuccggcgccccgacauccaguaccccgacgccacggacgaggacaucaccucccacauggagagcgaggagcucaacggggccuacaaggccauccccguggcgcaggaccugaacgccccguccgacugggacagccggggcaaggacagcuacgagaccucccagcuggacgaccagagcgccgagacccacucccacaagcagagccgccucuacaagcggaaggccaacgacgaguccaacgagcacagcgacgugaucgacucccaggagcugagcaaggucucccgcgaguuccacagccacgaguuccacucccacgaggacaugcuggugguggaccccaagagcaaggaggaggacaagcaccucaaguuccggaucucccacgagcuggacagcgccuccagcgaggucaacuga

SEQ ID NO: 2998 - RNA, 879 nt, Artificial Sequence
  derived and/or modified sequence opt2 from osteopontin__Homo_sapiens__AEA49030
augcgcaucgccgucaucugcuucugccuccucggcaucaccugcgccauccccgucaagcaggccgacuccggcuccuccgaggagaagcagcucuacaacaaguaccccgacgccgucgccaccuggcucaaccccgaccccucccagaagcagaaccuccucgccccccagaacgccgucuccuccgaggagaccaacgacuucaagcaggagacccuccccuccaaguccaacgagucccacgaccacauggacgacauggacgacgaggacgacgacucccaccaguccgacgagucccaccacuccgacgaguccgacgagcucgucaccgacuuccccaccgaccuccccgccaccgaggucuucacccccgucguccccaccgucgacaccuacgacggccgcggcgacuccgucgucuacggccuccgcuccaaguccaagaaguuccgccgccccgacauccaguaccccgacgccaccgacgaggacaucaccucccacauggaguccgaggagcucaacggcgccuacaaggccauccccgucgcccaggaccucaacgcccccuccgacugggacucccgcggcaaggacuccuacgagaccucccagcucgacgaccaguccgccgagacccacucccacaagcagucccgccucuacaagcgcaaggccaacgacgaguccaacgagcacuccgacgucaucgacucccaggagcucuccaaggucucccgcgaguuccacucccacgaguuccacucccacgaggacaugcucgucgucgaccccaaguccaaggaggaggacaagcaccucaaguuccgcaucucccacgagcucgacuccgccuccuccgaggucaacuga

SEQ ID NO: 2999 - RNA, 879 nt, Artificial Sequence
  derived and/or modified sequence opt3 from osteopontin__Homo_sapiens__AEA49030
augagaaucgccgugauuugcuucugucugcucggcauaaccugcgcuauccccgucaagcaggcagacagcggguccucugaggaaaaacaacuuuacaacaaguauccugaugccguugcgacauggcugaauccagacccgucacagaaacagaacuuguuagcuccccagaaugccgugaguagcgaggaaacuaacgauuuuaagcaagagacgcugccuuccaaaucuaaugaaucgcacgaccauauggaugacauggaugacgaggaugacgauucacaccagagcgacgagagucaucacuccgaugaaucugacgagcuaguaaccgacuucccaacagaucuccccgcaacugaaguguuuaccccugucgugccaacaguugacaccuacgauggaaggggugacagcguggucuauggccugcgguccaagucaaagaaauuccgccgacccgauauucaguacccugacgccacugaugaggacaucacaagucauauggagagcgaggaacuuaacggggcuuauaaggcaauuccaguggcccaggaucugaaugcuccgucugacugggauucccguggaaaagacucauacgaaaccagccaauuggacgaucagagugccgagacgcacucucacaagcaguccagacucuauaaaaggaaggcgaacgacgaaagcaaugagcauucggauguaaucgacucucaggagcuguccaagguuucacgggaauuucacagucaugaguuccacagccacgaagauaugcugguggucgaccccaaauccaaggaggaagauaaacaucucaaguuucgcauaucucacgaguuagacagcgcaucaagugaggugaacuga

SEQ ID NO: 3000 - RNA, 879 nt, Artificial Sequence
  derived and/or modified sequence opt4 from osteopontin__Homo_sapiens__AEA49030
augagaaucgccgugaucugcuucugccugcugggcaucaccugcgccauccccgugaagcaggccgacagcggcagcagcgaggagaagcagcuguacaacaaguaccccgacgccguggccaccuggcugaaccccgaccccagccagaagcagaaccugcuggccccccagaacgccgugagcagcgaggagaccaacgacuucaagcaggagacccugcccagcaagagcaacgagagccacgaccacauggacgacauggacgacgaggacgacgacagccaccagagcgacgagagccaccacagcgacgagagcgacgagcuggugaccgacuuccccaccgaccugcccgccaccgagguguucacccccguggugcccaccguggacaccuacgacggcagaggcgacagcgugguguacggccugagaagcaagagcaagaaguucagaagacccgacauccaguaccccgacgccaccgacgaggacaucaccagccacauggagagcgaggagcugaacggcgccuacaaggccauccccguggcccaggaccugaacgcccccagcgacugggacagcagaggcaaggacagcuacgagaccagccagcuggacgaccagagcgccgagacccacagccacaagcagagcagacuguacaagagaaaggccaacgacgagagcaacgagcacagcgacgugaucgacagccaggagcugagcaaggugagcagagaguuccacagccacgaguuccacagccacgaggacaugcuggugguggaccccaagagcaaggaggaggacaagcaccugaaguucagaaucagccacgagcuggacagcgccagcagcgaggugaacuga

SEQ ID NO: 3001 - RNA, 879 nt, Artificial Sequence
  derived and/or modified sequence opt5 from osteopontin__Homo_sapiens__AEA49030
augagaaucgccgugauuugcuucugucugcucggcauuaccugcgcuauccccgucaagcaggccgacagcggguccucugaggaaaaacaacuguacaacaaguauccugaugcgguugcuacauggcuuaauccggaccccagccagaaacagaaccugcucgccccucagaaugccguguccucugaggaaacgaacgauuuuaagcaagagacccugcccagcaaauccaaugaaucucacgaccauauggaugacauggaugacgaggaugacgauagccaccaguccgacgagagccaucacucugaugaauccgacgagcuugugacagacuucccuaccgaucugcccgcuacagaagucuuuaccccugugguuccgacaguggacaccuacgauggacggggcgacagcgucguguaugggcuccgcucuaaguccaagaaauucagacggcccgauauccaguacccugacgccacggaugaggacauuaccagccauauggagucugaggaacugaacggagcuuauaaggccauccccguugcgcaggaucugaaugccccuuccgacugggauagccgcggcaaagacuccuacgaaacaucucaacucgacgaucagagcgcugagacccacucccacaagcagagcagacuguauaaacggaaggccaacgacgaaucuaaugagcauuccgaugugaucgacagccaggagcuuucuaaggucagccgcgaauuucacucccaugaguuccacucucacgaagauaugcuggugguggaccccaaaagcaaggaggaagauaaacaucucaaguuuagaauuucccacgagcuggacagcgcuucuuccgaggucaacuga

SEQ ID NO: 3002 - protein, 314 aa, Artificial Sequence; identical to SEQ ID NO: 2967
  osteopontin__Homo_sapiens__P10451

SEQ ID NO: 3003 - RNA, 945 nt, Artificial Sequence; identical to SEQ ID NO: 2968
  osteopontin__Homo_sapiens__AAA86886

SEQ ID NO: 3004 - RNA, 945 nt, Artificial Sequence; identical to SEQ ID NO: 2969
  derived and/or modified sequence opt1 from osteopontin__Homo_sapiens__AAA86886

SEQ ID NO: 3005 - RNA, 945 nt, Artificial Sequence; identical to SEQ ID NO: 2970
  derived and/or modified sequence opt2 from osteopontin__Homo_sapiens__AAA86886

SEQ ID NO: 3006 - RNA, 945 nt, Artificial Sequence; identical to SEQ ID NO: 2971
  derived and/or modified sequence opt3 from osteopontin__Homo_sapiens__AAA86886

SEQ ID NO: 3007 - RNA, 945 nt, Artificial Sequence; identical to SEQ ID NO: 2972
  derived and/or modified sequence opt4 from osteopontin__Homo_sapiens__AAA86886

SEQ ID NO: 3008 - RNA, 945 nt, Artificial Sequence; identical to SEQ ID NO: 2973
  derived and/or modified sequence opt5 from osteopontin__Homo_sapiens__AAA86886

SEQ ID NO: 3009 - protein, 393 aa, Artificial Sequence [sequence omitted]

SEQ ID NO: 3010 - RNA, 1182 nt, Artificial Sequence
  p53__Homo_sapiens__AAA59988
auggaggagccgcagucagauccuagcgucgagcccccucugagucaggaaacauuuucagaccuauggaaacuacuuccugaaaacaacguucugucccccuugccgucccaagcaauggaugauuugaugcuguccccggacgauauugaacaaugguucacugaagacccagguccagaugaagcucccagaaugccagaggcugcuccccccguggccccugcaccagcagcuccuacaccggcggccccugcaccagcccccuccuggccccugucaucuucugucccuucccagaaaaccuaccagggcagcuacgguuuccgucugggcuucuugcauucugggacagccaagucugugacuugcacguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucagauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacuga

SEQ ID NO: 3011 - RNA, 1182 nt, Artificial Sequence
  derived and/or modified sequence opt1 from p53__Homo_sapiens__AAA59988
auggaggagccccagagcgacccguccguggagccgccccugagccaggagaccuucuccgaccucuggaagcugcugcccgagaacaacguccucagcccccugcccucccaggccauggacgaccugaugcucagccccgacgacaucgagcagugguucaccgaggaccccggcccggacgaggcgccccgcaugcccgaggccgcgcccccgguggcccccgcccccgccgcccccacgccggccgcccccgcccccgcgcccuccuggccgcugagcuccagcgugcccucccagaagaccuaccaggggagcuacggcuuccggcugggguuccuccacuccggcaccgccaagagcgugaccugcacguacucccccgcccugaacaagauguucugccagcuggccaagaccugccccguccagcucuggguggacagcaccccgccgcccgggacccgcguccgggccauggcgaucuacaagcagucccagcacaugacggagguggugcgccggugcccccaccacgagcgcugcagcgacuccgacggccuggccccgccccagcaccugauccgggucgagggcaaccuccgcguggaguaccuggacgaccggaacaccuuccgccacagcguggucgugcccuacgagccgcccgagguggggagcgacugcaccaccauccacuacaacuacaugugcaacuccagcugcaugggcgggaugaaccggcgccccauccugacgaucaucacccucgaggacuccagcggcaaccugcuggggcggaacuccuucgagguccgcgugugcgccugccccggccgggaccgccggaccgaggaggagaaccuccgcaagaagggcgagccccaccacgagcugccgcccgggagcaccaagcgggcccugcccaacaacacguccagcagcccccagcccaagaagaagccccucgacggcgaguacuucacccugcagauccgcgggcgggagcgcuucgagauguuccgcgagcugaacgaggcccucgagcugaaggacgcgcaggccggcaaggagcccggcgggucccgggcccacuccagccaccugaaguccaagaagggccagagcaccucccgccacaagaagcucauguucaagaccgaggggccggacagcgacuga

SEQ ID NO: 3012 - RNA, 1182 nt, Artificial Sequence
  derived and/or modified sequence opt2 from p53__Homo_sapiens__AAA59988
auggaggagccccaguccgaccccuccgucgagcccccccucucccaggagaccuucuccgaccucuggaagcuccuccccgagaacaacguccucuccccccuccccucccaggccauggacgaccucaugcucucccccgacgacaucgagcagugguucaccgaggaccccggccccgacgaggccccccgcaugcccgaggccgccccccccgucgcccccgcccccgccgcccccacccccgccgcccccgcccccgcccccuccuggccccucuccuccuccguccccucccagaagaccuaccagggcuccuacggcuuccgccucggcuuccuccacuccggcaccgccaaguccgucaccugcaccuacucccccgcccucaacaagauguucugccagcucgccaagaccugccccguccagcucugggucgacuccacccccccccccggcacccgcguccgcgccauggccaucuacaagcagucccagcacaugaccgaggucguccgccgcugcccccaccacgagcgcugcuccgacuccgacggccucgcccccccccagcaccucauccgcgucgagggcaaccuccgcgucgaguaccucgacgaccgcaacaccuuccgccacuccgucgucguccccuacgagccccccgaggucggcuccgacugcaccaccauccacuacaacuacaugugcaacuccuccugcaugggcggcaugaaccgccgccccauccucaccaucaucacccucgaggacuccuccggcaaccuccucggccgcaacuccuucgagguccgcgucugcgccugccccggccgcgaccgccgcaccgaggaggagaaccuccgcaagaagggcgagccccaccacgagcucccccccggcuccaccaagcgcgcccuccccaacaacaccuccuccuccccccagcccaagaagaagccccucgacggcgaguacuucacccuccagauccgcggccgcgagcgcuucgagauguuccgcgagcucaacgaggcccucgagcucaaggacgcccaggccggcaaggagcccggcggcucccgcgcccacuccucccaccucaaguccaagaagggccaguccaccucccgccacaagaagcucauguucaagaccgagggccccgacuccgacuga

SEQ ID NO: 3013 - RNA, 1182 nt, Artificial Sequence
  derived and/or modified sequence opt3 from p53__Homo_sapiens__AAA59988
auggaggaaccccagagcgacccuuccguggagccaccgcugucucaagaaaccuucucagaucucuggaaacuucugcccgagaacaaugucuugaguccuuuaccaagccaggccauggacgaucugaugcuaucccccgacgauaucgaacagugguuuacagaggacccuggcccagaugaggcucccagaaugccugaagcagccccaccgguugcgcccgcuccugccgcaccaacucccgccgcuccugcaccagcccccucuuggccgcucucgucaagcgugccuagucagaagacguaccaaggguccuauggauucaggcuggguuuucuucacucuggcaccgcuaagagcguaacaugcacuuacucccccgcccugaacaaaauguucugucaguuggcgaagaccugcccagugcagcucugggucgacucaacaccucccccagggacccgggugcgcgcaauggccauuuauaaacagagucaacauaugacugagguugugcgacguuguccccaccaugaaagaugcagcgauucugacggacuggcuccuccacagcaccugauaagggucgagggcaaucuccggguggaguacuuagaugaccgcaacacauuuagacauuccguaguugugccguaugaacccccugaggucgguucagauuguaccacgauccacuacaauuauaugugcaacagcaguuguaugggagggaugaauaggcggccaauucugacuaucauuacccuugaagacucuuccggcaacuugcugggccgcaauagcuucgaggugcgagugugcgccugucccgggagagacaggcggacagaagaggagaaccuacguaagaagggagaaccucaccaugagcucccacccgguucgacuaaacgcgcacugccgaauaacaccucuuccucaccucagccaaagaaaaagccccuugauggcgaauacuuuacacugcagaucagagggagggagcgguucgaaauguuucgagaguugaaugaggcucucgaacugaaagacgcccaagcgggaaaggagccuggcgguagucgcgcccacagcucccauuuaaagucuaaaaaggggcagagcaccucaagacacaaaaagcugauguucaaaacggaaggacccgauagugacuga

SEQ ID NO: 3014 - RNA, 1182 nt, Artificial Sequence
  derived and/or modified sequence opt4 from p53__Homo_sapiens__AAA59988
auggaggagccccagagcgaccccagcguggagcccccccugagccaggagaccuucagcgaccuguggaagcugcugcccgagaacaacgugcugagcccccugcccagccaggccauggacgaccugaugcugagccccgacgacaucgagcagugguucaccgaggaccccggccccgacgaggcccccagaaugcccgaggccgccccccccguggcccccgcccccgccgcccccacccccgccgcccccgcccccgcccccagcuggccccugagcagcagcgugcccagccagaagaccuaccagggcagcuacggcuucagacugggcuuccugcacagcggcaccgccaagagcgugaccugcaccuacagccccgcccugaacaagauguucugccagcuggccaagaccugccccgugcagcuguggguggacagcacccccccccccggcaccagagugagagccauggccaucuacaagcagagccagcacaugaccgagguggugagaagaugcccccaccacgagagaugcagcgacagcgacggccuggcccccccccagcaccugaucagaguggagggcaaccugagaguggaguaccuggacgacagaaacaccuucagacacagcgugguggugcccuacgagccccccgaggugggcagcgacugcaccaccauccacuacaacuacaugugcaacagcagcugcaugggcggcaugaacagaagacccauccugaccaucaucacccuggaggacagcagcggcaaccugcugggcagaaacagcuucgaggugagagugugcgccugccccggcagagacagaagaaccgaggaggagaaccugagaaagaagggcgagccccaccacgagcugccccccggcagcaccaagagagcccugcccaacaacaccagcagcagcccccagcccaagaagaagccccuggacggcgaguacuucacccugcagaucagaggcagagagagauucgagauguucagagagcugaacgaggcccuggagcugaaggacgcccaggccggcaaggagcccggcggcagcagagcccacagcagccaccugaagagcaagaagggccagagcaccagcagacacaagaagcugauguucaagaccgagggccccgacagcgacuga

SEQ ID NO: 3015 - RNA, 1182 nt, Artificial Sequence
  derived and/or modified sequence opt5 from p53__Homo_sapiens__AAA59988
auggaggaaccccagagcgacccuuccguggagccgccccugucucaagaaaccuucagcgaucucuggaagcugcuuccugagaacaauguccugucuccccucccuucccaggccauggacgaucugaugcuuagccccgacgauaucgaacagugguuuacagaggacccuggcccggaugaggcucccagaaugccugaagccgcgcccccuguugcucccgccccggccgcuccuacgcccgccgcuccugcccccgcgcccuccuggccucugucuagcuccgugccgagccagaaaaccuaccaagggucuuauggauuccggcucggcuuucugcacuccgggacagccaagagcgugaccugcacauacucucccgcucugaacaaaauguucugucagcucgccaagaccugcccuguccagcuguggguggacuccacacccccucccggaacccgcguuagagcuauggccauuuauaaacagagccaacauaugacggaggugguccggcgcuguccgcaccaugaaagaugcucugauuccgacggccuugcgccuccccagcaccugauccggguggaggggaaucuccgcguugaguaccuggaugacagaaacaccuuucggcauagcguggucgugccuuaugaacccccugaggugggauccgauuguacaaccauucacuacaauuauaugugcaacucuagcuguaugggcggcaugaaucgcagacccauccuuacaauuaucacccuggaagacuccagcgggaaccuccugggacgcaauucuuucgagguccggguuugcgccuguccgggcagagaccggcgcacggaagaggagaaccugagaaagaagggggaaccucaccaugagcucccucccggauccacaaaacgggcucugcccaauaacaccagcucuagcccgcagcccaagaaaaagccucuugauggcgaauacuuuacacugcagaucagagggcgcgagcgguucgaaauguuuagagagcucaaugaggcccuggaacuuaaagacgcucaagccggaaaggagcccggcggcucccgcgcccacucuagccaucugaaguccaaaaaggggcagagcaccucucggcacaaaaagcucauguucaaaaccgaaggaccugauuccgacuga

SEQ ID NO: 3016 - protein, 102 aa, Artificial Sequence
  PAGE-4__Homo_sapiens__O60829
MSARVRSRSRGRGDGQEAPDVVAFVAPGESQQEEPPTDNQDIEPGQEREGTPPIEERKVEGDCQEMDLEKTRSERGDGSDVKEKTPPNPKHAKTKEAGDGQP

SEQ ID NO: 3017 - RNA, 309 nt, Artificial Sequence
  PAGE-4__Homo_sapiens__AAF88037
augagugcacgagugagaucaagauccagaggaagaggagauggucaggaggcucccgaugugguugcauucguggcucccggugaaucucagcaagaggaaccaccaacugacaaucaggauauugaaccuggacaagagagagaaggaacaccuccgaucgaagaacguaaaguagaaggugauugccaggaaauggaucuggaaaagacucggagugagcguggagauggcucugauguaaaagagaagacuccaccuaauccuaagcaugcuaagacuaaagaagcaggagaugggcagccauaa

SEQ ID NO: 3018 - RNA, 309 nt, Artificial Sequence
  derived and/or modified sequence opt1 from PAGE-4__Homo_sapiens__AAF88037
augagcgcccgcgugcggucccgcagccggggccgcggggacggccaggaggcccccgacgucguggcguucguggcccccggggagucccagcaggaggagccgcccaccgacaaccaggacaucgagcccggccaggagcgggaggggaccccgcccaucgaggagcgcaaggucgagggcgacugccaggagauggaccuggagaagacgcggagcgagcgcggcgacggguccgacgugaaggagaagaccccgcccaaccccaagcacgccaagaccaaggaggccggcgacgggcagcccuga

SEQ ID NO: 3019 - RNA, 309 nt, Artificial Sequence
  derived and/or modified sequence opt2 from PAGE-4__Homo_sapiens__AAF88037
auguccgcccgcguccgcucccgcucccgcggccgcggcgacggccaggaggcccccgacgucgucgccuucgucgcccccggcgagucccagcaggaggagccccccaccgacaaccaggacaucgagcccggccaggagcgcgagggcaccccccccaucgaggagcgcaaggucgagggcgacugccaggagauggaccucgagaagacccgcuccgagcgcggcgacggcuccgacgucaaggagaagaccccccccaaccccaagcacgccaagaccaaggaggccggcgacggccagcccuga

SEQ ID NO: 3020 - RNA, 309 nt, Artificial Sequence
  derived and/or modified sequence opt3 from PAGE-4__Homo_sapiens__AAF88037
augagcgccagagugaggucccggucucgcggccgaggggacggacaggaggcucccgaugucguugcauucguggccccuggugaaucacaacaggaggaaccaccgaccgacaaccaggauaucgagcccggccaggaacgugaggggacaccuccaauugaggaaagaaagguagagggagacugccaagaaauggaucuggagaaaacuaggagugagcggggcgacgguagcgaugugaaggagaaaacgcccccuaauccaaagcacgcgaaaaccaaggaagcuggggacggacagcccuga

SEQ ID NO: 3021 - RNA, 309 nt, Artificial Sequence
  derived and/or modified sequence opt4 from PAGE-4__Homo_sapiens__AAF88037
augagcgccagagugagaagcagaagcagaggcagaggcgacggccaggaggcccccgacgugguggccuucguggcccccggcgagagccagcaggaggagccccccaccgacaaccaggacaucgagcccggccaggagagagagggcaccccccccaucgaggagagaaagguggagggcgacugccaggagauggaccuggagaagaccagaagcgagagaggcgacggcagcgacgugaaggagaagaccccccccaaccccaagcacgccaagaccaaggaggccggcgacggccagcccuga

SEQ ID NO: 3022 - RNA, 309 nt, Artificial Sequence
  derived and/or modified sequence opt5 from PAGE-4__Homo_sapiens__AAF88037
augagcgccagagugcggucccgcucuagaggccgcggggacggacaggaggcucccgaugucguugccuucguggcgccuggcgaaagccaacaggaggaaccgcccaccgacaaccaggauaucgagccugggcaggaacgggagggaacacccccuauugaggaaagaaagguggagggcgacugccaagaaauggaucuggagaaaacgcgguccgagcgcggggacggaucugaugucaaggagaaaacacccccuaauccgaagcacgcuaaaaccaaggaagccggcgacggccagcccuga

SEQ ID NO: 3023 - protein, 402 aa, Artificial Sequence [sequence omitted]

SEQ ID NO: 3024 - RNA, 1209 nt, Artificial Sequence
  PAI-1__Homo_sapiens__AAA60003
augcagaugucuccagcccucaccugccuaguccugggccuggcccuugucuuuggugaagggucugcugugcaccaucccccauccuacguggcccaccuggccucagacuucggggugaggguguuucagcagguggcgcaggccuccaaggaccgcaacgugguuuucucacccuaugggguggccucgguguuggccaugcuccagcugacaacaggaggagaaacccagcagcagauucaagcagcuaugggauucaagauugaugacaagggcauggcccccgcccuccggcaucuguacaaggagcucauggggccauggaacaaggaugagaucagcaccacagacgcgaucuucguccagcgggaucugaagcugguccagggcuucaugccccacuucuucaggcuguuccggagcacggucaagcaaguggacuuuucagagguggagagagccagauucaucaucaaugacugggugaagacacacacaaaagguaugaucagcaacuugcuugggaaaggagccguggaccagcugacacggcuggugcuggugaaugcccucuacuucaacggccaguggaagacucccuuccccgacuccagcacccaccgccgccucuuccacaaaucagacggcagcacugucucugugcccaugauggcucagaccaacaaguucaacuauacugaguucaccacgcccgauggccauuacuacgacauccuggaacugcccuaccacggggacacccucagcauguucauugcugccccuuaugaaaaagaggugccucucucugcccucaccaacauucugagugcccagcucaucagccacuggaaaggcaacaugaccaggcugccccgccuccugguucugcccaaguucucccuggagacugaagucgaccucaggaagccccuagagaaccugggaaugaccgacauguucagacaguuucaggcugacuucacgagucuuucagaccaagagccucuccacgucgcgcaggcgcugcagaaagugaagaucgaggugaacgagaguggcacgguggccuccucauccacagcugucauagucucagcccgcauggcccccgaggagaucaucauggacagacccuuccucuuugugguccggcacaaccccacaggaacaguccuuuucaugggccaagugauggaacccuga

SEQ ID NO: 3025 - RNA, 1209 nt, Artificial Sequence
  derived and/or modified sequence opt1 from PAI-1__Homo_sapiens__AAA60003
augcagaugagccccgcccugaccugccucgugcuggggcuggcccucgucuucggggagggcuccgcggugcaccacccgcccagcuacguggcccaccuggccuccgacuucgggguccgcguguuccagcaggucgcccaggccagcaaggaccggaacgugguguucucccccuacggcguggcgagcguccuggccaugcuccagcugaccaccgggggcgagacgcagcagcagauccaggccgccaugggcuucaagaucgacgacaaggggauggcgcccgcccugcgccaccucuacaaggagcugaugggcccguggaacaaggacgagaucuccaccaccgacgccaucuucgugcagcgggaccugaagcucgugcagggguucaugccccacuucuuccgccuguuccggagcacggucaagcaggucgacuucuccgagguggagcgcgcccgguucaucaucaacgacugggugaagacccacaccaagggcaugaucagcaaccugcucgggaagggcgccguggaccagcugacccgccuggugcucgucaacgcgcuguacuucaacggccaguggaagacgcccuuccccgacuccagcacccaccggcgccuguuccacaaguccgacgggagcaccguguccgugccgaugauggcccagaccaacaaguucaacuacacggaguucaccacccccgacggccacuacuacgacauccucgagcugcccuaccacggggacacccugagcauguucaucgccgcccccuacgagaaggaggucccgcucuccgcccugacgaacauccugagcgcgcagcucaucucccacuggaagggcaacaugacccggcugccccgccugcucgugcugcccaaguucagccuggagaccgagguggaccuccggaagccccuggagaaccugggcaugaccgacauguuccgccaguuccaggccgacuucacgagccucuccgaccaggagccgcugcacgucgcccaggcccugcagaaggugaagaucgaggucaacgagagcgggaccguggccuccagcuccaccgcggugaucgucagcgcccggauggcccccgaggagaucaucauggaccgccccuuccucuucguggugcggcacaaccccaccggcacgguccuguucaugggccaggugauggagccguga

SEQ ID NO: 3026 - RNA, 1209 nt, Artificial Sequence
  derived and/or modified sequence opt2 from PAI-1__Homo_sapiens__AAA60003
augcagaugucccccgcccucaccugccucguccucggccucgcccucgucuucggcgagggcuccgccguccaccacccccccuccuacgucgcccaccucgccuccgacuucggcguccgcgucuuccagcaggucgcccaggccuccaaggaccgcaacgucgucuucucccccuacggcgucgccuccguccucgccaugcuccagcucaccaccggcggcgagacccagcagcagauccaggccgccaugggcuucaagaucgacgacaagggcauggcccccgcccuccgccaccucuacaaggagcucaugggccccuggaacaaggacgagaucuccaccaccgacgccaucuucguccagcgcgaccucaagcucguccagggcuucaugccccacuucuuccgccucuuccgcuccaccgucaagcaggucgacuucuccgaggucgagcgcgcccgcuucaucaucaacgacugggucaagacccacaccaagggcaugaucuccaaccuccucggcaagggcgccgucgaccagcucacccgccucguccucgucaacgcccucuacuucaacggccaguggaagacccccuuccccgacuccuccacccaccgccgccucuuccacaaguccgacggcuccaccgucuccguccccaugauggcccagaccaacaaguucaacuacaccgaguucaccacccccgacggccacuacuacgacauccucgagcuccccuaccacggcgacacccucuccauguucaucgccgcccccuacgagaaggaggucccccucuccgcccucaccaacauccucuccgcccagcucaucucccacuggaagggcaacaugacccgccucccccgccuccucguccuccccaaguucucccucgagaccgaggucgaccuccgcaagccccucgagaaccucggcaugaccgacauguuccgccaguuccaggccgacuucaccucccucuccgaccaggagccccuccacgucgcccaggcccuccagaaggucaagaucgaggucaacgaguccggcaccgucgccuccuccuccaccgccgucaucgucuccgcccgcauggcccccgaggagaucaucauggaccgccccuuccucuucgucguccgccacaaccccaccggcaccguccucuucaugggccaggucauggagcccuga

SEQ ID NO: 3027 - RNA, 1209 nt, Artificial Sequence
  derived and/or modified sequence opt3 from PAI-1__Homo_sapiens__AAA60003
augcagaugagccccgcccugaccugccucgugcuuggccuggcuuuggucuucggggagggauccgcaguucaccauccuccaucuuacguggcccacuuagcgucagacuuugguguaagaguguuccaacaggucgcucaggccaguaaggauaggaacgugguuuuuagcccguauggcguggcauccguccuggccaugcuacagcucacaacugggggagaaacgcaacagcagauccaggcugcaaugggcuucaaaauugacgauaaggguauggcccccgcucugcggcaucuuuacaaagagcugauggggccuuggaauaaggacgaaauaucuaccacagaugccaucuuugugcaacgcgacuugaaacucguacagggauucaugccacacuuuuuccgacuguuucguucgacuguuaaacagguggauuucucagaggucgaaagagcgagguuuauuaucaacgacugggugaagacccauacaaagggcaugauuagcaaucugcucggcaagggggcaguggaucaguuaacccggcugguccuuguuaacgccuuguauuucaauggacaauggaaaacucccuuuccugacaguuccacacaccgcagacuguuccacaagucugaugguagcaccguguccguaccaaugauggcucagacgaacaaauucaauuacacugaguuuaccacacccgacggccauuauuacgauauccuagagcucccuuaucacggggacacucugucaauguucauagccgcaccauacgaaaaggaggugccgcuuagugcucugaccaacaucuugagcgcccagcucauuucucauuggaagggaaauaugacaaggcugccccgguuacugguccucccuaaauuuucccuugaaaccgagguggaccugcgcaagccauuggagaaccuaggcaugacggauauguuccgacaauuucaggcggacuucacuucacugagcgaucaggaaccccuccacguugcccaggcacugcaaaaagugaagaucgaggucaaugaaagugguacaguggcuucuuccagcaccgccguaauuguuucggcuagaauggccccugaggaaaucauaauggacaggccauuucuuuucgugguccggcacaaccccacugggacagugcuguuuaugggacaggucauggagccguga

SEQ ID NO: 3028 - RNA, 1209 nt, Artificial Sequence
  derived and/or modified sequence opt4 from PAI-1__Homo_sapiens__AAA60003
augcagaugagccccgcccugaccugccuggugcugggccuggcccugguguucggcgagggcagcgccgugcaccacccccccagcuacguggcccaccuggccagcgacuucggcgugagaguguuccagcagguggcccaggccagcaaggacagaaacgugguguucagccccuacggcguggccagcgugcuggccaugcugcagcugaccaccggcggcgagacccagcagcagauccaggccgccaugggcuucaagaucgacgacaagggcauggcccccgcccugagacaccuguacaaggagcugaugggccccuggaacaaggacgagaucagcaccaccgacgccaucuucgugcagagagaccugaagcuggugcagggcuucaugccccacuucuucagacuguucagaagcaccgugaagcagguggacuucagcgagguggagagagccagauucaucaucaacgacugggugaagacccacaccaagggcaugaucagcaaccugcugggcaagggcgccguggaccagcugaccagacuggugcuggugaacgcccuguacuucaacggccaguggaagacccccuuccccgacagcagcacccacagaagacuguuccacaagagcgacggcagcaccgugagcgugcccaugauggcccagaccaacaaguucaacuacaccgaguucaccacccccgacggccacuacuacgacauccuggagcugcccuaccacggcgacacccugagcauguucaucgccgcccccuacgagaaggaggugccccugagcgcccugaccaacauccugagcgcccagcugaucagccacuggaagggcaacaugaccagacugcccagacugcuggugcugcccaaguucagccuggagaccgagguggaccugagaaagccccuggagaaccugggcaugaccgacauguucagacaguuccaggccgacuucaccagccugagcgaccaggagccccugcacguggcccaggcccugcagaaggugaagaucgaggugaacgagagcggcaccguggccagcagcagcaccgccgugaucgugagcgccagaauggcccccgaggagaucaucauggacagacccuuccuguucguggugagacacaaccccaccggcaccgugcuguucaugggccaggugauggagcccuga

SEQ ID NO: 3029 - RNA, 1209 nt, Artificial Sequence
  derived and/or modified sequence opt5 from PAI-1__Homo_sapiens__AAA60003
augcagaugagccccgcccugaccugccucgugcugggccuugcucuggucuucggggagggauccgccguucaccauccuccgucuuacguggcgcaccucgcuagcgacuuuggcgugagagucuuccaacagguggcccaggccuccaaggaucggaacguuguguuuucucccuauggggucgcuagcgugcuggccaugcuucagcugacaacgggaggcgaaacccaacagcagauccaggcugccaugggguucaaaauugacgauaagggaauggcgccugcccuccgccaucuguacaaagagcugaugggccccuggaauaaggacgaaaucuccacaaccgaugcuauuuuuguucaaagagaccucaaacuggugcagggcuucaugccucacuuuuuccggcuuuuucgcucuacagucaaacagguggauuucagcgagguggaaagagcccgguuuaucauuaacgacugggucaagacccauacaaaggggaugaucuccaaucugcucggaaagggcgcuguugaucagcugacccgccuugugcuggugaacgcccucuauuucaaugggcaauggaaaacgcccuuuccugacagcucuacccacagacggcuguuccacaaguccgauggaagcacagucucugugccgaugauggcgcagaccaacaaauucaauuacacagaguuuaccacgcccgacggccauuauuacgauauccuggagcucccuuaucacggggacacacuguccauguucauugccgcucccuacgaaaaggagguuccucuuagcgcccugaccaacauccucucugcucagcugauuucccauuggaagggaaauaugacacgccuucccagacugcucgugcugccgaaauuuagccuggaaaccgaggucgaccuccggaagccucuggagaaccuuggcaugaccgauauguuccgccaauuucaggccgacuucacaucccugucugaucaggaaccccuccacguggcccaggcucugcaaaaaguuaagaucgaggugaaugaaagcggcacggucgcguccagcucuaccgccgugauugucuccgcuagaauggccccugaggaaaucauuauggaccggcccuuucuuuucgugguucgccacaaccccacagggaccgugcuguuuaugggacaggucauggagccuuga

SEQ ID NO: 3030 - protein, 415 aa, Artificial Sequence
  PAI-2__Homo_sapiens__P05120
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 3031 - RNA, 1248 nt, Artificial Sequence
  PAI-2__Homo_sapiens__AAA36797
auggaggaucuuuguguggcaaacacacucuuugcccucaauuuauucaagcaucuggcaaaagcaagccccacccagaaccucuuccucuccccauggagcaucucguccaccauggccauggucuacaugggcuccaggggcagcaccgaagaccagauggccaaggugcuucaguuuaaugaagugggagccaaugcaguuacccccaugacuccagagaacuuuaccagcuguggguucaugcagcagauccagaaggguaguuauccugaugcgauuuugcaggcacaagcugcagauaaaauccauucauccuuccgcucucucagcucugcaaucaaugcauccacagggaauuauuuacuggaaagugucaauaagcuguuuggugagaagucugcgagcuuccgggaagaauauauucgacucugucagaaauauuacuccucagaaccccaggcaguagacuuccuagaaugugcagaagaagcuagaaaaaagauuaauuccugggucaagacucaaaccaaaggcaaaaucccaaacuuguuaccugaagguucuguagauggggauaccaggaugguccuggugaaugcugucuacuucaaaggaaaguggaaaacuccauuugagaagaaacuaaaugggcuuuauccuuuccguguaaacucggcucagcgcacaccuguacagaugauguacuugcgugaaaagcuaaacauuggauacauagaagaccuaaaggcucagauucuagaacucccauaugcuggagauguuagcauguucuuguugcuuccagaugaaauugccgauguguccacuggcuuggagcugcuggaaagugaaauaaccuaugacaaacucaacaaguggaccagcaaagacaaaauggcugaagaugaaguugagguauacauaccccaguucaaauuagaagagcauuaugaacucagauccauucugagaagcaugggcauggaggacgccuucaacaagggacgggccaauuucucagggaugucggagaggaaugaccuguuucuuucugaaguguuccaccaagccaugguggaugugaaugaggagggcacugaagcagccgcuggcacaggagguguuaugacagggagaacuggacauggaggcccacaguuuguggcagaucauccuuuucuuuuucuuauuaugcauaagauaaccaacugcauuuuauuuuucggcagauuuuccucacccuaa

SEQ ID NO: 3032 - RNA, 1248 nt, Artificial Sequence
  derived and/or modified sequence opt1 from PAI-2__Homo_sapiens__AAA36797
auggaggaccugugcguggccaacacccucuucgcccugaaccuguucaagcaccucgcgaaggccagccccacccagaaccuguuccuguccccguggagcaucuccagcacgauggccauggucuacaugggcucccgcgggagcaccgaggaccagauggccaaggugcuccaguucaacgaggugggcgccaacgcggucacccccaugacccccgagaacuucacguccugcggguucaugcagcagauccagaagggcagcuaccccgacgccauccugcaggcccaggccgcggacaagauccacuccagcuuccggucccugagcuccgccaucaacgccagcaccgggaacuaccuccuggaguccgugaacaagcuguucggcgagaaguccgccagcuuccgcgaggaguacauccggcucugccagaaguacuacagcuccgagccgcaggccguggacuuccuggagugcgcggaggaggcccgcaagaagaucaacagcugggucaagacccagaccaagggcaagauccccaaccugcuccccgaggggagcguggacggcgacacgcggauggugcuggucaacgccguguacuucaaggggaaguggaagacccccuucgagaagaagcugaacggccucuacccguuccgcgugaacuccgcccagcggacccccguccagaugauguaccugcgcgagaagcugaacaucggguacaucgaggaccucaaggcccagauccuggagcugcccuacgcgggcgacgugagcauguuccuccugcugcccgacgagaucgccgacguguccaccggccucgagcugcuggagagcgagaucacguacgacaagcucaacaaguggaccuccaaggacaagauggccgaggacgaggucgagguguacaucccgcaguucaagcuggaggagcacuacgagcugcggagcauccuccgcuccauggggauggaggacgccuucaacaagggccgggccaacuucagcgggauguccgagcgcaacgaccuguuccugagcgagguguuccaccaggcgauggucgacgugaacgaggagggcaccgaggccgccgccggcaccgggggcgugaugacggggcggaccggccacgggggcccccaguucgucgccgaccaccccuuccucuuccugaucaugcacaagaucaccaacugcauccuguucuucggccgcuucuccagccccuga

SEQ ID NO: 3033 - RNA, 1248 nt, Artificial Sequence
  derived and/or modified sequence opt2 from PAI-2__Homo_sapiens__AAA36797
auggaggaccucugcgucgccaacacccucuucgcccucaaccucuucaagcaccucgccaaggccucccccacccagaaccucuuccucucccccugguccaucuccuccaccauggccauggucuacaugggcucccgcggcuccaccgaggaccagauggccaagguccuccaguucaacgaggucggcgccaacgccgucacccccaugacccccgagaacuucaccuccugcggcuucaugcagcagauccagaagggcuccuaccccgacgccauccuccaggcccaggccgccgacaagauccacuccuccuuccgcucccucuccuccgccaucaacgccuccaccggcaacuaccuccucgaguccgucaacaagcucuucggcgagaaguccgccuccuuccgcgaggaguacauccgccucugccagaaguacuacuccuccgagccccaggccgucgacuuccucgagugcgccgaggaggcccgcaagaagaucaacuccugggucaagacccagaccaagggcaagauccccaaccuccuccccgagggcuccgucgacggcgacacccgcaugguccucgucaacgccgucuacuucaagggcaaguggaagacccccuucgagaagaagcucaacggccucuaccccuuccgcgucaacuccgcccagcgcacccccguccagaugauguaccuccgcgagaagcucaacaucggcuacaucgaggaccucaaggcccagauccucgagcuccccuacgccggcgacgucuccauguuccuccuccuccccgacgagaucgccgacgucuccaccggccucgagcuccucgaguccgagaucaccuacgacaagcucaacaaguggaccuccaaggacaagauggccgaggacgaggucgaggucuacaucccccaguucaagcucgaggagcacuacgagcuccgcuccauccuccgcuccaugggcauggaggacgccuucaacaagggccgcgccaacuucuccggcauguccgagcgcaacgaccucuuccucuccgaggucuuccaccaggccauggucgacgucaacgaggagggcaccgaggccgccgccggcaccggcggcgucaugaccggccgcaccggccacggcggcccccaguucgucgccgaccaccccuuccucuuccucaucaugcacaagaucaccaacugcauccucuucuucggccgcuucuccucccccuga

SEQ ID NO: 3034 - RNA, 1248 nt, Artificial Sequence
  derived and/or modified sequence opt3 from PAI-2__Homo_sapiens__AAA36797
auggaggaccugugcguggccaacacccucuucgcucuuaaucuguuuaagcacuuggcaaaagccagccccacacagaacuuauuccuguccccuuggucuaucucaaguacuauggcgauggucuacaugggcagcagaggguccacggaagaucaaauggcuaagguucuacaguuuaaugaggugggagccaacgcaguaaccccaaugacaccggaaaauuucacuucuugugguuuuaugcagcagauucaaaaaggcucguaucccgacgccauacuccaggcucaggcagccgauaagauccauagcucauucaggagucuguccucugcuauuaacgccagcaccgggaauuaccuucuggaguccgugaacaaauuguuuggagaaaagucagcgaguuuccgggaggaguauauccgccucugccagaaguacuauagcucugaaccucaagcagucgacuuucuggagugugccgaagaggcucguaaaaagauuaauuccugggugaaaacacagaccaagggcaaaaucccaaaccugcuccccgaggguucaguugauggggacacucgaaugguguuagucaaugccguguacuucaagggaaaguggaaaacaccuuuugaaaagaaacugaacggccuuuauccauucagaguaaauagcgcacagaggacccccguucagaugauguacuugcgggagaagcugaacauaggcuacaucgaagaucuaaaagcucaaauucucgagcugccuuaugccggggacgugaguauguuucuucuguugccagaugaaaucgcggacgucucuacgggacucgagcuguuagaguccgaaauuacuuacgauaagcugaauaaauggaccagcaaggacaagauggccgaggaugaaguggagguguauaucccgcaguucaaacucgaggaacacuacgagcuucgcucgauacugagaucuauggguauggaagacgcauucaacaagggcagggcuaacuuuuccgggaugucagagcggaaugacuuguuccuaagugaagucuuucaucaggccaugguugaugugaacgaggaaggaacagaggcugccgcaggcacuggugggguaaugaccggacgcacaggccacggcgggccccaauucguggccgaccauccuuuucuguuccucauuaugcacaaaaucaccaauugcauucuguuuuucggacgauuuagcuccccauga

SEQ ID NO: 3035 - RNA, 1248 nt, Artificial Sequence
  derived and/or modified sequence opt4 from PAI-2__Homo_sapiens__AAA36797
auggaggaccugugcguggccaacacccuguucgcccugaaccuguucaagcaccuggccaaggccagccccacccagaaccuguuccugagccccuggagcaucagcagcaccauggccaugguguacaugggcagcagaggcagcaccgaggaccagauggccaaggugcugcaguucaacgaggugggcgccaacgccgugacccccaugacccccgagaacuucaccagcugcggcuucaugcagcagauccagaagggcagcuaccccgacgccauccugcaggcccaggccgccgacaagauccacagcagcuucagaagccugagcagcgccaucaacgccagcaccggcaacuaccugcuggagagcgugaacaagcuguucggcgagaagagcgccagcuucagagaggaguacaucagacugugccagaaguacuacagcagcgagccccaggccguggacuuccuggagugcgccgaggaggccagaaagaagaucaacagcugggugaagacccagaccaagggcaagauccccaaccugcugcccgagggcagcguggacggcgacaccagaauggugcuggugaacgccguguacuucaagggcaaguggaagacccccuucgagaagaagcugaacggccuguaccccuucagagugaacagcgcccagagaacccccgugcagaugauguaccugagagagaagcugaacaucggcuacaucgaggaccugaaggcccagauccuggagcugcccuacgccggcgacgugagcauguuccugcugcugcccgacgagaucgccgacgugagcaccggccuggagcugcuggagagcgagaucaccuacgacaagcugaacaaguggaccagcaaggacaagauggccgaggacgagguggagguguacaucccccaguucaagcuggaggagcacuacgagcugagaagcauccugagaagcaugggcauggaggacgccuucaacaagggcagagccaacuucagcggcaugagcgagagaaacgaccuguuccugagcgagguguuccaccaggccaugguggacgugaacgaggagggcaccgaggccgccgccggcaccggcggcgugaugaccggcagaaccggccacggcggcccccaguucguggccgaccaccccuuccuguuccugaucaugcacaagaucaccaacugcauccuguucuucggcagauucagcagccccuga

SEQ ID NO: 3036 - RNA, 1248 nt, Artificial Sequence
  derived and/or modified sequence opt5 from PAI-2__Homo_sapiens__AAA36797
auggaggaccugugcguggccaacacccucuucgcucugaaucuuuuuaagcaccuggccaaagcgagccccacacagaaccucuuccuguccccuuggucuaucagcuccacgauggcuauggucuacaugggcucuagagggagcaccgaagaucaaauggccaagguucuucaguuuaaugaggugggagccaacgcugugacaccgaugacccccgaaaauuucacauccuguggcuuuaugcagcagauucaaaaagggucuuauccugacgccauccugcaggcucaggccgcggauaagauucauagcuccuuccggagccucucuuccgccaucaacgcuagcaccggaaauuaccugcuggagucugucaacaaacucuuuggcgaaaaguccgccagcuuccgcgaggaguauauuagacugugccagaaguacuauucuuccgaaccccaagcuguggacuuucuugagugugccgaagaggcgcggaaaaagaucaauagcuggguuaaaacacagaccaaggggaaaaucccuaaccugcuccccgagggauccguggauggcgacacgcgcaugguccuggugaaugccguuuacuucaagggcaaguggaaaaccccuuuugaaaagaaacuuaacgggcuguauccguucagagucaauucugcucagcggacacccgugcagaugauguaccuccgcgagaagcugaacauuggauacaucgaagaucugaaagcccaaauucucgagcugccuuaugcuggcgacgugagcauguuucuucugcuccccgaugaaaucgccgacguguccaccgggcuggagcuucuggagagcgaaauuacauacgauaagcucaauaaauggaccucuaaggacaagauggccgaggaugaagucgagguuuauaucccucaguucaaacuggaggaacacuacgagcugagauccauucuccggagcaugggaauggaagacgcuuucaacaagggccgcgcgaacuuuucugggaugagcgagagaaaugaccuguuccuuuccgaaguguuucaucaggccaugguggaugucaacgaggaaggaacggaggcugccgccggcacaggcggggugaugaccggacggacaggccacgggggaccccaauucguugcugaccauccguuucuguuccucaucaugcacaaaaucaccaauugcauucuguuuuucggccgcuuuucuagcccuuga

SEQ ID NO: 3037 - protein, 175 aa, Artificial Sequence
  PAP__Homo_sapiens__Q06141
MLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 3038 - RNA, 528 nt, Artificial Sequence
  PAP__Homo_sapiens__AAA60020
augcugccucccauggcccugcccaguguaucuuggaugcugcuuuccugccucaugcugcugucucagguucaaggugaagaaccccagagggaacugcccucugcacggauccgcugucccaaaggcuccaaggccuauggcucccacugcuaugccuuguuuuugucaccaaaauccuggacagaugcagaucuggccugccagaagcggcccucuggaaaccuggugucugugcucaguggggcugagggauccuucguguccucccuggugaagagcauugguaacagcuacucauacgucuggauugggcuccaugaccccacacagggcaccgagcccaauggagaagguugggaguggaguagcagugaugugaugaauuacuuugcaugggagagaaaucccuccaccaucucaagccccggccacugugcgagccugucgagaagcacagcauuucugagguggaaagauuauaacuguaaugugagguuacccuaugucugcaaguucacugacuag

SEQ ID NO: 3039 - RNA, 528 nt, Artificial Sequence
  derived and/or modified sequence opt1 from PAP__Homo_sapiens__AAA60020
augcugcccccgauggcccuccccagcguguccuggaugcugcugagcugccucaugcugcugucccagguccagggcgaggagccccagcgcgagcuccccagcgcccggauccgcugcccgaagggguccaaggcguacggcagccacugcuacgcccuguuccugucccccaagagcuggaccgacgccgaccucgccugccagaagcggcccuccgggaaccuggugagcgugcuguccggcgccgaggggagcuucgucuccagccucgugaaguccaucggcaacagcuacuccuacguguggaucggccugcacgaccccacccaggggacggagccgaacggcgaggggugggaguggagcuccagcgacgucaugaacuacuucgcgugggagcgcaaccccagcaccaucuccagccccggccacugcgccucccugagccgguccaccgccuuccuccgcuggaaggacuacaacugcaacgugcggcugcccuacgugugcaaguucaccgacuga

SEQ ID NO: 3040 - RNA, 528 nt, Artificial Sequence
  derived and/or modified sequence opt2 from PAP__Homo_sapiens__AAA60020
augcucccccccauggcccuccccuccgucuccuggaugcuccucuccugccucaugcuccucucccagguccagggcgaggagccccagcgcgagcuccccuccgcccgcauccgcugccccaagggcuccaaggccuacggcucccacugcuacgcccucuuccucucccccaaguccuggaccgacgccgaccucgccugccagaagcgccccuccggcaaccucgucuccguccucuccggcgccgagggcuccuucgucuccucccucgucaaguccaucggcaacuccuacuccuacgucuggaucggccuccacgaccccacccagggcaccgagcccaacggcgagggcugggagugguccuccuccgacgucaugaacuacuucgccugggagcgcaaccccuccaccaucuccucccccggccacugcgccucccucucccgcuccaccgccuuccuccgcuggaaggacuacaacugcaacguccgccuccccuacgucugcaaguucaccgacuga

SEQ ID NO: 3041 - RNA, 528 nt, Artificial Sequence
  derived and/or modified sequence opt3 from PAP__Homo_sapiens__AAA60020
augcugcccccuauggcccucccaagcguguccuggaugcuucugucuugcuugauguuacugucacagguccaaggcgaggaaccgcagagagagcuacccagugcuaggauccgguguccuaaggggagcaaagcauacggaucccacugcuaugcccucuuccugucuccaaagucguggaccgacgcggaucuugcuugucagaaacgccccucagguaaccugguuagcguguugaguggcgccgaaggguccuuuguaucuagccucgugaaguccauuggaaauucauacaguuaugucuggauaggccugcaugacccuacacaggguacugagccaaacggggaaggaugggaguggucuagcuccgaugugaugaauuacuucgcaugggagcgaaaccccucaacgaucagcaguccuggccacugcgccucucugucccguagcaccgcuuuucucagauggaaagacuauaauuguaacguuagguuaccauacgugugcaaguucacagauuga

SEQ ID NO: 3042 - RNA, 528 nt, Artificial Sequence
  derived and/or modified sequence opt4 from PAP__Homo_sapiens__AAA60020
augcugccccccauggcccugcccagcgugagcuggaugcugcugagcugccugaugcugcugagccaggugcagggcgaggagccccagagagagcugcccagcgccagaaucagaugccccaagggcagcaaggccuacggcagccacugcuacgcccuguuccugagccccaagagcuggaccgacgccgaccuggccugccagaagagacccagcggcaaccuggugagcgugcugagcggcgccgagggcagcuucgugagcagccuggugaagagcaucggcaacagcuacagcuacguguggaucggccugcacgaccccacccagggcaccgagcccaacggcgagggcugggaguggagcagcagcgacgugaugaacuacuucgccugggagagaaaccccagcaccaucagcagccccggccacugcgccagccugagcagaagcaccgccuuccugagauggaaggacuacaacugcaacgugagacugcccuacgugugcaaguucaccgacuga

SEQ ID NO: 3043 - RNA, 528 nt, Artificial Sequence
  derived and/or modified sequence opt5 from PAP__Homo_sapiens__AAA60020
augcugcccccuauggcccucccgagcguguccuggaugcugcuuucuugccugaugcuccugagccagguccaaggcgaggaaccccagagagagcuuccuuccgcucggauccgcugucccaaggggucuaaagccuacggaagccacugcuaugcgcuguuccucuccccuaagucuuggaccgacgcugaucuggccugucagaaaagacccagcggcaaccugguuuccgugcucagcggggccgaaggaucuuuuguguccagccuggucaagucuauuggcaauuccuacagcuauguguggaucgggcuucaugacccuacacagggaacggagccgaacggcgaaggcugggaguggucuuccagcgauguuaugaauuacuucgcuugggagcggaaccccuccaccauuucuagcccugggcacugcgccucccugagccgcucuacagcuuuucucagauggaaagacuauaauuguaacgugcggcugcccuacgucugcaaguucaccgauuga

SEQ ID NO: 3044 - protein, 175 aa, Artificial Sequence; identical to SEQ ID NO: 3037
  PAP__Homo_sapiens__Q53S56

SEQ ID NO: 3045 - RNA, 528 nt, Artificial Sequence; identical to SEQ ID NO: 3038
  PAP__Homo_sapiens__AAT11159

SEQ ID NO: 3046 - RNA, 528 nt, Artificial Sequence; identical to SEQ ID NO: 3039
  derived and/or modified sequence opt1 from PAP__Homo_sapiens__AAT11159

SEQ ID NO: 3047 - RNA, 528 nt, Artificial Sequence; identical to SEQ ID NO: 3040
  derived and/or modified sequence opt2 from PAP__Homo_sapiens__AAT11159

SEQ ID NO: 3048 - RNA, 528 nt, Artificial Sequence; identical to SEQ ID NO: 3041
  derived and/or modified sequence opt3 from PAP__Homo_sapiens__AAT11159

SEQ ID NO: 3049 - RNA, 528 nt, Artificial Sequence; identical to SEQ ID NO: 3042
  derived and/or modified sequence opt4 from PAP__Homo_sapiens__AAT11159

SEQ ID NO: 3050 - RNA, 528 nt, Artificial Sequence; identical to SEQ ID NO: 3043
  derived and/or modified sequence opt5 from PAP__Homo_sapiens__AAT11159

SEQ ID NO: 3051 - protein, 126 aa, Artificial Sequence
  PATE__Homo_sapiens__Q8WXA2
MDKSLLLELPILLCCFRALSGSLSMRNDAVNEIVAVKNNFPVIEIVQCRMCHLQFPGEKCSRGRGICTATTEEACMVGRMFKRDGNPWLTFMGCLKNCADVKGIRWSVYLVNFRCCRSHDLCNEDL

SEQ ID NO: 3052 - RNA, 381 nt, Artificial Sequence
  PATE__Homo_sapiens__AAH39863
auggacaagucccucuugcuggaacuccccauccugcucugcugcuuuagggcauuaucuggaucacuuucaaugagaaaugaugcagucaaugaaauaguugcugugaaaaacaauuuuccugugauagaaauuguucaguguaggaugugccaccuccaguucccaggagaaaagugcuccagaggaagaggaauaugcacagcaacaacagaagaggccugcaugguuggaaggauguucaaaagggaugguaaucccugguuaaccuucaugggcugccuaaagaacugugcugaugugaaaggcauaagguggagugucuauuuggugaacuucaggugcugcaggagccaugaccugugcaaugaagaccuuuag

SEQ ID NO: 3053 - RNA, 381 nt, Artificial Sequence
  derived and/or modified sequence opt1 from PATE__Homo_sapiens__AAH39863
auggacaagagccugcuccuggagcugcccauccuccugugcugcuuccgcgcccuguccggcagccucuccaugcggaacgacgccgugaacgagaucgucgcggugaagaacaacuucccggugaucgagaucguccagugccgcaugugccaccuccaguuccccggggagaagugcagccggggccgcgggaucugcaccgccaccacggaggaggccugcauggugggccggauguucaagcgcgacgggaaccccuggcugaccuucaugggcugccugaagaacugcgccgacgugaagggcauccggugguccgucuaccuggugaacuuccgcugcugccggagccacgaccugugcaacgaggaccucuga

SEQ ID NO: 3054 - RNA, 381 nt, Artificial Sequence
  derived and/or modified sequence opt2 from PATE__Homo_sapiens__AAH39863
auggacaagucccuccuccucgagcuccccauccuccucugcugcuuccgcgcccucuccggcucccucuccaugcgcaacgacgccgucaacgagaucgucgccgucaagaacaacuuccccgucaucgagaucguccagugccgcaugugccaccuccaguuccccggcgagaagugcucccgcggccgcggcaucugcaccgccaccaccgaggaggccugcauggucggccgcauguucaagcgcgacggcaaccccuggcucaccuucaugggcugccucaagaacugcgccgacgucaagggcauccgcugguccgucuaccucgucaacuuccgcugcugccgcucccacgaccucugcaacgaggaccucuga

SEQ ID NO: 3055 - RNA, 381 nt, Artificial Sequence
  derived and/or modified sequence opt3 from PATE__Homo_sapiens__AAH39863
auggacaagagccugcuccuugagcugcccaucuuguuaugcuguuucagagcccuguccggcucucuaucaaugaggaacgaugcugugaaugaaauugucgcaguuaaaaacaauuuuccugugauagagaucguacagugccggaugugucaccuccaauucccaggggaaaagugcagucgcggacgagguauuuguaccgccacaacugaggaagcgugcauggugggccguauguuuaaaagagacgggaacccguggcugacguucaugggaugucuuaagaauugcgcugaugucaaaggcaucagguggagcguguaccugguuaacuuucgguguugccgcucccaugacuuguguaaugaggaucucuga

SEQ ID NO: 3056 - RNA, 381 nt, Artificial Sequence
  derived and/or modified sequence opt4 from PATE__Homo_sapiens__AAH39863
auggacaagagccugcugcuggagcugcccauccugcugugcugcuucagagcccugagcggcagccugagcaugagaaacgacgccgugaacgagaucguggccgugaagaacaacuuccccgugaucgagaucgugcagugcagaaugugccaccugcaguuccccggcgagaagugcagcagaggcagaggcaucugcaccgccaccaccgaggaggccugcauggugggcagaauguucaagagagacggcaaccccuggcugaccuucaugggcugccugaagaacugcgccgacgugaagggcaucagauggagcguguaccuggugaacuucagaugcugcagaagccacgaccugugcaacgaggaccuguga

SEQ ID NO: 3057 - RNA, 381 nt, Artificial Sequence
  derived and/or modified sequence opt5 from PATE__Homo_sapiens__AAH39863
auggacaagagccugcuccuggagcuucccauccugcucugcuguuucagagcccuguccggcucucuuagcaugcggaacgaugcugugaaugaaauugucgccguuaaaaacaauuuuccugugaucgagauugugcagugccgcaugugucaucugcaauucccgggggaaaagugcuccagaggacggggcaucuguaccgcgacaacggaggaggcuugcauggucgggcgcauguuuaaaagagacggaaaccccuggcucaccuucaugggcugucugaagaauugcgccgaugugaaagggauucgguggucuguuuaccuggugaacuuucgcuguugcagaagccacgaccucuguaaugaagaucuguga

SEQ ID NO: 3058 - protein, 479 aa, Artificial Sequence
  PAX3__Homo_sapiens__P23760
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSKPWTF

SEQ ID NO: 3059 - RNA, 1440 nt, Artificial Sequence
  PAX3__Homo_sapiens__CCDS42826.1
augaccacgcuggccggcgcugugcccaggaugaugcggccgggcccggggcagaacuacccgcguagcggguucccgcuggaaguguccacuccccucggccagggccgcgucaaccagcucggcgguguuuuuaucaacggcaggccgcugcccaaccacauccgccacaagaucguggagauggcccaccacggcauccggcccugcgucaucucgcgccagcugcgcgugucccacggcugcgucuccaagauccugugcagguaccaggagacuggcuccauacguccuggugccaucggcggcagcaagcccaagcaggugacaacgccugacguggagaagaaaauugaggaauacaaaagagagaacccgggcauguucagcugggaaauccgagacaaauuacucaaggacgcggucugugaucgaaacaccgugccgucagugaguuccaucagccgcauccugagaaguaaauucgggaaaggugaagaggaggaggccgacuuggagaggaaggaggcagaggaaagcgagaagaaggccaaacacagcaucgacggcauccugagcgagcgagccucagcaccccaaucagaugaaggcucugauauugacucugaaccagauuuaccacuaaagaggaaacagcgcagaagccgaaccaccuucacagcagaacagcuggaggaacuggagcgugcuuuugagagaacucauuacccugacauuuauacuagggaggaacuggcccagagggcgaagcucaccgaggcccgaguacaggucugguuuagcaaccgccgugcaagauggaggaagcaagcuggggccaaucaacugauggcuuucaaccaucucauucccgggggguucccucccacugccaugccgaccuugccaacguaccagcugucggagaccucuuaccagcccacaucuauuccacaagcugugucagaucccagcagcaccguucacagaccucaaccgcuuccuccaagcacuguacaccaaagcacgauuccuuccaacccagacagcagcucugccuacugccuccccagcaccaggcauggauuuuccagcuauacagacagcuuugugccuccgucggggcccuccaaccccaugaaccccaccauuggcaauggccucucaccucagguaaugggacuccugaccaaccacggugggguaccucaucagccccagacugauuacgcgcucuccccucucaccgggggucuggaaccuaccaccacggugucggccagcugcagucagagacuagaccauaugaagagcuuggacagucugccaacaucucaguccuacuguccacccaccuauagcaccacaggcuacaguauggacccugucacaggcuaccaauaugggcaguauggacaaaguaagccuuggacuuuuuag

SEQ ID NO: 3060 - RNA, 1440 nt, Artificial Sequence
  derived and/or modified sequence opt1 from PAX3__Homo_sapiens__CCDS42826.1
augaccacccuggccggcgccgugccccgcaugaugcggccggggcccggccagaacuacccccgcagcggguucccccucgaggucuccacgccgcugggccaggggcgggugaaccagcugggcggcguguucaucaacgggcgcccccuccccaaccacauccggcacaagaucgucgagauggcgcaccacggcauccgccccugcgugaucagccggcagcugcgcgugucccacgggugcgucagcaagauccugugccgguaccaggagaccggcuccauccgcccgggggccaucggcggcagcaagcccaagcaggucaccacccccgacguggagaagaagaucgaggaguacaagcgggagaaccccgggauguucuccugggagauccgcgacaagcuccugaaggacgccgugugcgaccggaacacggugccgagcguguccagcaucucccgcauccugcggagcaaguucggcaagggggaggaggaggaggccgaccucgagcgcaaggaggccgaggaguccgagaagaaggcgaagcacagcaucgacggcauccuguccgagcgggccagcgcgccccaguccgacgagggcagcgacaucgacuccgagcccgaccugccccucaagcgcaagcagcggcgcagccggaccaccuucaccgccgagcagcuggaggagcuggagcgcgccuucgagcgcacgcacuacccggacaucuacacccgggaggagcucgcccagcgcgccaagcugaccgaggcccggguccaggugugguucagcaaccgccgggcccgcuggcggaagcaggcgggggccaaccagcugauggccuucaaccaccucauccccggcggguucccgcccaccgccaugcccacgcugcccaccuaccagcuguccgagaccagcuaccagcccaccuccaucccccaggccgugagcgacccguccagcacgguccaccgcccccagccccugcccccguccaccgugcaccagagcaccauccccuccaaccccgacagcuccagcgcguacugccucccguccacccggcacggcuucagcuccuacacggacagcuucgugccgcccuccgggcccagcaaccccaugaaccccaccaucggcaacggccuguccccgcaggucauggggcuccugaccaaccacggcggggugccccaccagccccagaccgacuacgcccugagcccccucacgggcgggcuggagcccaccaccaccgugagcgccuccugcagccagcgccuggaccacaugaagucccucgacagccugcccacgucccagagcuacugcccgcccaccuacuccaccaccggcuacagcauggaccccgucacgggcuaccaguacgggcaguacggccaguccaagcccuggaccuucuga

SEQ ID NO: 3061 - RNA, 1440 nt, Artificial Sequence
  derived and/or modified sequence opt2 from PAX3__Homo_sapiens__CCDS42826.1
augaccacccucgccggcgccgucccccgcaugaugcgccccggccccggccagaacuacccccgcuccggcuucccccucgaggucuccaccccccucggccagggccgcgucaaccagcucggcggcgucuucaucaacggccgcccccuccccaaccacauccgccacaagaucgucgagauggcccaccacggcauccgccccugcgucaucucccgccagcuccgcgucucccacggcugcgucuccaagauccucugccgcuaccaggagaccggcuccauccgccccggcgccaucggcggcuccaagcccaagcaggucaccacccccgacgucgagaagaagaucgaggaguacaagcgcgagaaccccggcauguucuccugggagauccgcgacaagcuccucaaggacgccgucugcgaccgcaacaccguccccuccgucuccuccaucucccgcauccuccgcuccaaguucggcaagggcgaggaggaggaggccgaccucgagcgcaaggaggccgaggaguccgagaagaaggccaagcacuccaucgacggcauccucuccgagcgcgccuccgccccccaguccgacgagggcuccgacaucgacuccgagcccgaccucccccucaagcgcaagcagcgccgcucccgcaccaccuucaccgccgagcagcucgaggagcucgagcgcgccuucgagcgcacccacuaccccgacaucuacacccgcgaggagcucgcccagcgcgccaagcucaccgaggcccgcguccaggucugguucuccaaccgccgcgcccgcuggcgcaagcaggccggcgccaaccagcucauggccuucaaccaccucauccccggcggcuucccccccaccgccaugcccacccuccccaccuaccagcucuccgagaccuccuaccagcccaccuccaucccccaggccgucuccgaccccuccuccaccguccaccgcccccagccccucccccccuccaccguccaccaguccaccauccccuccaaccccgacuccuccuccgccuacugccuccccuccacccgccacggcuucuccuccuacaccgacuccuucgucccccccuccggccccuccaaccccaugaaccccaccaucggcaacggccucuccccccaggucaugggccuccucaccaaccacggcggcgucccccaccagccccagaccgacuacgcccucuccccccucaccggcggccucgagcccaccaccaccgucuccgccuccugcucccagcgccucgaccacaugaagucccucgacucccuccccaccucccaguccuacugcccccccaccuacuccaccaccggcuacuccauggaccccgucaccggcuaccaguacggccaguacggccaguccaagcccuggaccuucuga

SEQ ID NO: 3062 - RNA, 1440 nt, Artificial Sequence
  derived and/or modified sequence opt3 from PAX3__Homo_sapiens__CCDS42826.1
augaccacacuggccggcgcugugcccagaaugaugaggccugggccaggacagaacuacccgcggagcgguuucccccucgaggucuccacuccucuuggccaagggcgcguuaaucagcugggaggcguguuuaucaacggucgaccauugcccaaucacauucgucauaagauaguagaaauggcacaccaugggaucagaccuugcgugauuucuaggcaguuacgggucucacacggaugcgugaguaaaauccugugccgcuaucaggagacgggcagcauuagaccaggcgccaucgggggauccaagcccaaacaaguuaccacaccugacguggaaaagaaaauagaggaauacaagagggagaacccagguauguucucuugggagauccgggauaagcuacucaaagacgcggucugugaucgcaauacugugccgucgguaucaagcauuagucgaauccugagauccaaguuuggcaaaggggaagaggaagaggcugaccuugagaggaaggaagccgaggaaucugagaaaaaggcaaagcauagcauugauggaauccuguccgaacgggccucagcuccccagagugacgagggcagcgauauagacucugagccugauuugccacucaaacguaagcagcgcagauccaggaccacauucaccgcagaacagcuggaggaacuggagcgggccuuugaacgaacucacuaucccgacauuuacacacgcgaggagcucgcucaaagagccaaauuaaccgaagcgaggguucaggugugguucucaaaccggcgcgcaagauggaggaagcaggccggugcuaaucagcugauggccuuuaaccaccuuaucccugggggauucccacccacggcaaugccgacuuugccuaccuaucaacugagcgagacaaguuaccagcccacuucuauuccacaggcugucuccgauccuagcucgaccgugcaucguccccaaccacuacccccuucuacagugcaccaguccaccaucccaucaaauccggacaguagcuccgccuauugccuccccucuacgcggcauggcuuuagcucauacacugauaguuucgucccuccauccggccccagcaacccuaugaauccaacaaucgggaacggacugucuccccagguuaugggucuucugaccaaucacggcggggugccgcaccagccucaaacugacuacgcguugucaccacucacaggaggccuggaacccaccacgaccguaagugccagcuguucccagcgauuagaccauaugaaaucucuggauucgcucccuacaagccaguccuauugucccccaacuuacucaaccacagguuauaguauggacccugugacuggguaccaguauggccaauacggacagucuaagcccuggaccuuuuga

SEQ ID NO: 3063 - RNA, 1440 nt, Artificial Sequence
  derived and/or modified sequence opt4 from PAX3__Homo_sapiens__CCDS42826.1
augaccacccuggccggcgccgugcccagaaugaugagacccggccccggccagaacuaccccagaagcggcuucccccuggaggugagcaccccccugggccagggcagagugaaccagcugggcggcguguucaucaacggcagaccccugcccaaccacaucagacacaagaucguggagauggcccaccacggcaucagacccugcgugaucagcagacagcugagagugagccacggcugcgugagcaagauccugugcagauaccaggagaccggcagcaucagacccggcgccaucggcggcagcaagcccaagcaggugaccacccccgacguggagaagaagaucgaggaguacaagagagagaaccccggcauguucagcugggagaucagagacaagcugcugaaggacgccgugugcgacagaaacaccgugcccagcgugagcagcaucagcagaauccugagaagcaaguucggcaagggcgaggaggaggaggccgaccuggagagaaaggaggccgaggagagcgagaagaaggccaagcacagcaucgacggcauccugagcgagagagccagcgccccccagagcgacgagggcagcgacaucgacagcgagcccgaccugccccugaagagaaagcagagaagaagcagaaccaccuucaccgccgagcagcuggaggagcuggagagagccuucgagagaacccacuaccccgacaucuacaccagagaggagcuggcccagagagccaagcugaccgaggccagagugcaggugugguucagcaacagaagagccagauggagaaagcaggccggcgccaaccagcugauggccuucaaccaccugauccccggcggcuucccccccaccgccaugcccacccugcccaccuaccagcugagcgagaccagcuaccagcccaccagcaucccccaggccgugagcgaccccagcagcaccgugcacagaccccagccccugccccccagcaccgugcaccagagcaccauccccagcaaccccgacagcagcagcgccuacugccugcccagcaccagacacggcuucagcagcuacaccgacagcuucgugccccccagcggccccagcaaccccaugaaccccaccaucggcaacggccugagcccccaggugaugggccugcugaccaaccacggcggcgugccccaccagccccagaccgacuacgcccugagcccccugaccggcggccuggagcccaccaccaccgugagcgccagcugcagccagagacuggaccacaugaagagccuggacagccugcccaccagccagagcuacugcccccccaccuacagcaccaccggcuacagcauggaccccgugaccggcuaccaguacggccaguacggccagagcaagcccuggaccuucuga

SEQ ID NO: 3064 - RNA, 1440 nt, Artificial Sequence
  derived and/or modified sequence opt5 from PAX3__Homo_sapiens__CCDS42826.1
augaccacacuggccggcgcugugcccagaaugaugcggccugggccgggacagaacuacccccgcagcggcuucccucucgaggucuccacgccccuggggcaaggaagaguuaaucagcuuggcgggguguuuaucaacggacggccucugcccaaucacauucgccauaagaucguggaaauggcccaccauggcauuagaccuugcgucaucucucggcagcuccgcgugagccacggcuguguuuccaaaauucugugcagauaucaggagaccgggucuauccggccgggagcgaucggcgggagcaagcccaaacaagugacaaccccugacgucgaaaagaaaauugaggaauacaagcgcgagaaccccggaauguucuccugggagaucagagauaaacuucugaaggacgcugugugugaucggaauacaguuccuucugugagcuccauuagccgcauccucagaucuaaguuuggcaaaggggaagaggaagaggccgaccuggagcggaaggaagccgaggaauccgagaaaaaggcuaagcauagcauugauggaauccugucugaacgcgccuccgcuccccagagcgacgagggcucugauauugacuccgagccggaucucccucugaaaagaaagcagcggagaagccgcaccacauucaccgccgaacagcuugaggaacuggagcgggcguuugaaagaacgcacuaucccgacaucuacacccgcgaggagcucgcccaacgggcuaaacugacagaagccagaguccaggugugguucuccaaccgccgggcuagauggcgcaagcaggccggcgcgaaucagcuuauggccuuuaaccaccugaucccugggggauucccucccaccgcuaugcccacacucccgaccuaucaacugucugagacgagcuaccagcccacauccauuccucaggccgugagcgaucccucuuccaccguccaucggccucaaccccugccgccuagcacaguucaccagucuaccauccccagcaauccugacuccucuagcgcuuauugccuccccuccaccagacauggcuuuagcucuuacacagauuccuucgugccucccagcgggccgucuaacccuaugaaucccacgauuggaaacggccuguccccucaggugauggggcuucugaccaaucacggaggcgucccccaccagccgcaaacagacuacgcccucagcccccugaccggcgggcuugaaccuacaaccacgguguccgccucuuguagccagcgccuggaccauaugaaaucccucgauucucugcccacaagccaguccuauugcccucccaccuacagcaccacaggauauucuauggacccuguuaccggcuaccaguaugggcaauacggacaguccaagcccuggacauuuuga

SEQ ID NO: 3065 - protein, 391 aa, Artificial Sequence
  PAX5__Homo_sapiens__Q02548
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 3066 - RNA, 1176 nt, Artificial Sequence
  PAX5__Homo_sapiens__AAA58397
auggauuuagagaaaaauuauccgacuccucggaccagcaggacaggacauggaggagugaaucagcuuggggggguuuuugugaauggacggccacucccggauguaguccgccagaggauaguggaacuugcucaucaaggugucaggcccugcgacaucuccaggcagcuucgggucagccaugguugugucagcaaaauucuuggcagguauuaugagacaggaagcaucaagccugggguaauuggaggauccaaaccaaaggucgccacacccaaagugguggaaaaaaucgcugaauauaaacgccaaaaucccaccauguuugccugggagaucagggaccggcugcuggcagagcgggugugugacaaugacaccgugccuagcgucaguuccaucaacaggaucauccggacaaaaguacagcagccacccaaccaaccagucccagcuuccagucacagcauaguguccacuggcuccgugacgcagguguccucggugagcacggauucggccggcucgucguacuccaucagcggcauccugggcaucacgucccccagcgccgacaccaacaagcgcaagagagacgaagguauucaggagucuccggugccgaacggccacucgcuuccgggcagagacuuccuccggaagcagaugcggggagacuuguucacacagcagcagcuggaggugcuggaccgcguguuugagaggcagcacuacucagacaucuucaccaccacagagcccaucaagcccgagcagaccacagaguauucagccauggccucgcuggcuggugggcuggacgacaugaaggccaaucuggccagccccaccccugcugacaucgggagcagugugccaggcccgcaguccuaccccauugugacaggccgugacuuggcgagcacgacccuccccggguacccuccacacgucccccccgcuggacagggcagcuacucagcaccgacgcugacagggauggugccugggagugaguuuuccgggagucccuacagccacccucaguauuccucguacaacgacuccuggagguuccccaacccggggcugcuuggcucccccuacuauuauagcgcugccgcccgaggagccgccccaccugcagccgccacugccuaugaccgucacuga

SEQ ID NO: 3067 - RNA, 1176 nt, Artificial Sequence
  derived and/or modified sequence opt1 from PAX5__Homo_sapiens__AAA58397
auggaccuggagaagaacuaccccacgccccgcaccagccggaccggccacgggggcgugaaccagcucgggggcgucuucgugaacgggcgcccccugcccgacgugguccggcagcgcaucguggagcuggcccaccagggcgugcggcccugcgacaucucccgccagcuccgggucagccacggcugcguguccaagauccuggggcgcuacuacgagaccggcagcaucaagccgggggugaucggcggguccaagcccaaggucgccacccccaaggugguggagaagaucgcggaguacaagcggcagaaccccaccauguucgccugggagauccgcgaccggcugcucgccgagcgcgucugcgacaacgacacggugccgagcguguccagcaucaaccggaucauccgcaccaagguccagcagccgcccaaccagcccgugcccgccuccagccacuccaucgugagcaccggcuccgucacccaggugagcuccgugagcacggacuccgccggcagcuccuacagcaucagcgggauccugggcaucaccucccccagcgcggacaccaacaagcggaagcgcgacgaggggauccaggagucccccguccccaacggccacagccugccgggccgggacuuccuccgcaagcagaugcgcggggaccuguucacccagcagcagcuggaggugcucgaccggguguucgagcggcagcacuacuccgacaucuucacgaccaccgagcccaucaagcccgagcagaccacggaguacagcgccauggccucccuggccggcgggcuggacgacaugaaggcgaaccucgccagccccaccccggccgacaucggcuccagcguccccgggccccaguccuaccccaucgugaccggccgcgaccuggccagcaccacgcugccgggcuacccgccccacgucccgcccgccgggcagggcuccuacagcgcgcccacccucaccgggauggugcccggcuccgaguucagcgggucccccuacagccacccccaguacuccagcuacaacgacagcuggcgcuuccccaaccccggccugcugggcuccccguacuacuacagcgccgccgcccgcggggccgcgccgcccgccgccgccaccgccuacgaccggcacuga

SEQ ID NO: 3068 - RNA, 1176 nt, Artificial Sequence
  derived and/or modified sequence opt2 from PAX5__Homo_sapiens__AAA58397
auggaccucgagaagaacuaccccaccccccgcaccucccgcaccggccacggcggcgucaaccagcucggcggcgucuucgucaacggccgcccccuccccgacgucguccgccagcgcaucgucgagcucgcccaccagggcguccgccccugcgacaucucccgccagcuccgcgucucccacggcugcgucuccaagauccucggccgcuacuacgagaccggcuccaucaagcccggcgucaucggcggcuccaagcccaaggucgccacccccaaggucgucgagaagaucgccgaguacaagcgccagaaccccaccauguucgccugggagauccgcgaccgccuccucgccgagcgcgucugcgacaacgacaccguccccuccgucuccuccaucaaccgcaucauccgcaccaagguccagcagccccccaaccagcccguccccgccuccucccacuccaucgucuccaccggcuccgucacccaggucuccuccgucuccaccgacuccgccggcuccuccuacuccaucuccggcauccucggcaucaccucccccuccgccgacaccaacaagcgcaagcgcgacgagggcauccaggagucccccguccccaacggccacucccuccccggccgcgacuuccuccgcaagcagaugcgcggcgaccucuucacccagcagcagcucgagguccucgaccgcgucuucgagcgccagcacuacuccgacaucuucaccaccaccgagcccaucaagcccgagcagaccaccgaguacuccgccauggccucccucgccggcggccucgacgacaugaaggccaaccucgccucccccacccccgccgacaucggcuccuccguccccggcccccaguccuaccccaucgucaccggccgcgaccucgccuccaccacccuccccggcuaccccccccacgucccccccgccggccagggcuccuacuccgcccccacccucaccggcaugguccccggcuccgaguucuccggcucccccuacucccacccccaguacuccuccuacaacgacuccuggcgcuuccccaaccccggccuccucggcucccccuacuacuacuccgccgccgcccgcggcgccgccccccccgccgccgccaccgccuacgaccgccacuga

SEQ ID NO: 3069 - RNA, 1176 nt, Artificial Sequence
  derived and/or modified sequence opt3 from PAX5__Homo_sapiens__AAA58397
auggaccuggagaagaacuaccccaccccuagaacaagcaggacuggccacgggggagugaaucagcucgguggcgucuucguuaacgggcggccacuuccggaugugguacgccaacgaaucguggaacuggcccaucagggaguccgucccugcgacauuuccagacaguugagggugucucacggcuguguuucaaaaauauuaggucgguauuacgagacggggaguaucaagccuggagugauuggcggcagcaaaccaaaggucgcuacccccaaagugguagaaaagaucgcagaguauaagcgccagaauccuacaauguuugccugggaaauuagagauaggcugcuagcggagcggguuugcgacaacgauacugugccauccgucucuucgaucaaucgcauaauccgaaccaaagugcaacagcccccuaaccagccagugccggcuucaagccauaguauugucuccacagggucuguuacccaggugagcuccguaucaacugacagugccggaagcucuuacuccaucucagguauucucggcaucacaagccccagugcagauaccaauaagagaaaaagggacgaggggauacaagaaucuccugugccaaacggacacucccugcccggccgggauuuccuucguaagcagaugcgcggugaccuguuuacgcagcagcaauuggagguccucgauagaguguucgaaaggcagcauuauagcgacauuuuuacuaccacagagccuaucaaaccagagcagacuaccgaauacucggccauggcuucucuggcagggggacuggaugacaugaaggccaaucucgcuucccccacaccggccgacauuggcucaaguguuccuggcccccaaagcuauccaaucgugaccgggcgggauuuagcguccacgacucugccuggauaucccccacacgugcccccugcaggucagggcucuuacagcgccccaacacuuaccgggauggucccgggaucagaguucaguggcucccccuacagccacccucaguacucuucauauaacgacaguuggcgauuuccaaaucccgguuugcuggggagcccuuacuauuacuccgcugccgcacgcggcgcugccccacccgcggccgcaacugcuuaugauagacauuga

SEQ ID NO: 3070 - RNA, 1176 nt, Artificial Sequence
  derived and/or modified sequence opt4 from PAX5__Homo_sapiens__AAA58397
auggaccuggagaagaacuaccccacccccagaaccagcagaaccggccacggcggcgugaaccagcugggcggcguguucgugaacggcagaccccugcccgacguggugagacagagaaucguggagcuggcccaccagggcgugagacccugcgacaucagcagacagcugagagugagccacggcugcgugagcaagauccugggcagauacuacgagaccggcagcaucaagcccggcgugaucggcggcagcaagcccaagguggccacccccaaggugguggagaagaucgccgaguacaagagacagaaccccaccauguucgccugggagaucagagacagacugcuggccgagagagugugcgacaacgacaccgugcccagcgugagcagcaucaacagaaucaucagaaccaaggugcagcagccccccaaccagcccgugcccgccagcagccacagcaucgugagcaccggcagcgugacccaggugagcagcgugagcaccgacagcgccggcagcagcuacagcaucagcggcauccugggcaucaccagccccagcgccgacaccaacaagagaaagagagacgagggcauccaggagagccccgugcccaacggccacagccugcccggcagagacuuccugagaaagcagaugagaggcgaccuguucacccagcagcagcuggaggugcuggacagaguguucgagagacagcacuacagcgacaucuucaccaccaccgagcccaucaagcccgagcagaccaccgaguacagcgccauggccagccuggccggcggccuggacgacaugaaggccaaccuggccagccccacccccgccgacaucggcagcagcgugcccggcccccagagcuaccccaucgugaccggcagagaccuggccagcaccacccugcccggcuaccccccccacgugccccccgccggccagggcagcuacagcgcccccacccugaccggcauggugcccggcagcgaguucagcggcagccccuacagccacccccaguacagcagcuacaacgacagcuggagauuccccaaccccggccugcugggcagccccuacuacuacagcgccgccgccagaggcgccgccccccccgccgccgccaccgccuacgacagacacuga

SEQ ID NO: 3071 - RNA, 1176 nt, Artificial Sequence
  derived and/or modified sequence opt5 from PAX5__Homo_sapiens__AAA58397
auggaccuggagaagaacuaccccaccccuagaacaagccggacgggccacgggggagugaaucagcucggcggggucuucguuaacggacgcccgcugcccgauguggugagacaacggaucgucgaacuugcccaucagggcgugcgcccuugcgacauuuccagacagcugcggguuucucacgggugugugagcaaaauccucggacgcuauuacgagaccggcuccauuaagcccggcgucaucgggggaucuaaaccuaagguggcuacacccaaaguuguggaaaagauugccgaguauaagagacagaauccuaccauguuugcgugggaaauccgggaucgccugcuugcugagagagucugcgacaacgauacagugccgagcguguccucuaucaaucggauuauccgcaccaaaguccaacagcccccuaaccagcccguuccugccagcucccauagcauugugucuacaggcuccgugacccaggucagcucuguguccacggacagcgccgggucuuccuacagcaucuccggcauucugggaaucaccucucccagcgcugauacaaauaagagaaaacgggacgaggggauucaagaauccccgguuccuaacggacacagccuccccggccgcgauuuccugagaaagcagaugcggggcgaccuguuuacccagcagcaacucgaggugcuggauagagucuucgaacgccagcauuauucugacaucuuuacaaccacggagccuaucaaacccgagcagacaaccgaauacuccgccauggcuagccuugccgggggacuggaugacaugaaggcgaaucucgccucucccacacccgcugacauuggcagcuccgugccggggccccaaucuuauccuaucguuaccggacgggaucuggccagcaccacacuucccggcuacccuccccacgugccgccugcugggcagggauccuacagcgcccccacgcugaccggcauggucccuggcucugaguucuccgggagccccuauucucacccucaguacuccagcuauaacgacuccuggagauuucccaauccgggacuccugggcucuccuuacuauuacagcgcggccgcucgcggggccgcuccucccgccgccgcuacagcguaugaucggcauuga

SEQ ID NO: 3072 - protein, 290 aa, Artificial Sequence
  PD1L1__Homo_sapiens__Q9NZQ7
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 3073 - RNA, 873 nt, Artificial Sequence
  PD1L1__Homo_sapiens__AAF25807
augaggauauuugcugucuuuauauucaugaccuacuggcauuugcugaacgcauuuacugucacgguucccaaggaccuauaugugguagaguaugguagcaauaugacaauugaaugcaaauucccaguagaaaaacaauuagaccuggcugcacuaauugucuauugggaaauggaggauaagaacauuauucaauuugugcauggagaggaagaccugaagguucagcauaguagcuacagacagagggcccggcuguugaaggaccagcucucccugggaaaugcugcacuucagaucacagaugugaaauugcaggaugcagggguguaccgcugcaugaucagcuaugguggugccgacuacaagcgaauuacugugaaagucaaugccccauacaacaaaaucaaccaaagaauuuugguuguggauccagucaccucugaacaugaacugacaugucaggcugagggcuaccccaaggccgaagucaucuggacaagcagugaccaucaaguccugagugguaagaccaccaccaccaauuccaagagagaggagaagcuuuucaaugugaccagcacacugagaaucaacacaacaacuaaugagauuuucuacugcacuuuuaggagauuagauccugaggaaaaccauacagcugaauuggucaucccagaacuaccucuggcacauccuccaaaugaaaggacucacuugguaauucugggagccaucuuauuaugccuugguguagcacugacauucaucuuccguuuaagaaaagggagaaugauggaugugaaaaaauguggcauccaagauacaaacucaaagaagcaaagugauacacauuuggaggagacguaa

SEQ ID NO: 3074 - RNA, 873 nt, Artificial Sequence
  derived and/or modified sequence opt1 from PD1L1__Homo_sapiens__AAF25807
augcgcaucuucgccguguucaucuucaugaccuacuggcaccuccucaacgccuucaccgucacggugcccaaggaccuguacguggucgaguacggcagcaacaugaccaucgagugcaaguucccgguggagaagcagcuggaccucgcggcccugaucguguacugggagauggaggacaagaacaucauccaguucguccacggggaggaggaccugaaggugcagcacuccagcuaccggcagcgcgcccggcuccugaaggaccagcugucccucggcaacgccgcccugcagaucaccgacgugaagcugcaggacgcgggggucuaccgcugcaugaucagcuacggcggggccgacuacaagcggaucaccgugaaggugaacgcccccuacaacaagaucaaccagcgcauccucgucguggaccccgugacguccgagcacgagcugaccugccaggccgagggcuaccccaaggcggaggucaucuggaccagcuccgaccaccaggugcugagcggcaagaccacgaccaccaacuccaagcgggaggagaagcuguucaacgugaccagcacgcugcgcaucaacaccaccaccaacgagaucuucuacugcacguuccggcgccuggacccggaggagaaccacaccgccgagcucgucauccccgagcugccccuggcccacccgcccaacgagcggacccaccucgugauccugggggccauccugcucugccugggcguggcccugaccuucaucuuccgccuccggaaggggcgcaugauggacgucaagaagugcggcauccaggacacgaacuccaagaagcagagcgacacccaccuggaggagaccuga

SEQ ID NO: 3075 - RNA, 873 nt, Artificial Sequence
  derived and/or modified sequence opt2 from PD1L1__Homo_sapiens__AAF25807
augcgcaucuucgccgucuucaucuucaugaccuacuggcaccuccucaacgccuucaccgucaccguccccaaggaccucuacgucgucgaguacggcuccaacaugaccaucgagugcaaguuccccgucgagaagcagcucgaccucgccgcccucaucgucuacugggagauggaggacaagaacaucauccaguucguccacggcgaggaggaccucaagguccagcacuccuccuaccgccagcgcgcccgccuccucaaggaccagcucucccucggcaacgccgcccuccagaucaccgacgucaagcuccaggacgccggcgucuaccgcugcaugaucuccuacggcggcgccgacuacaagcgcaucaccgucaaggucaacgcccccuacaacaagaucaaccagcgcauccucgucgucgaccccgucaccuccgagcacgagcucaccugccaggccgagggcuaccccaaggccgaggucaucuggaccuccuccgaccaccagguccucuccggcaagaccaccaccaccaacuccaagcgcgaggagaagcucuucaacgucaccuccacccuccgcaucaacaccaccaccaacgagaucuucuacugcaccuuccgccgccucgaccccgaggagaaccacaccgccgagcucgucauccccgagcucccccucgcccacccccccaacgagcgcacccaccucgucauccucggcgccauccuccucugccucggcgucgcccucaccuucaucuuccgccuccgcaagggccgcaugauggacgucaagaagugcggcauccaggacaccaacuccaagaagcaguccgacacccaccucgaggagaccuga

SEQ ID NO: 3076 - RNA, 873 nt, Artificial Sequence
  derived and/or modified sequence opt3 from PD1L1__Homo_sapiens__AAF25807
augagaaucuucgccguguuuauuuucaugaccuacuggcaccuccucaacgcuuuuacagucacuguucccaaggaccuuuaugugguagaguacggcagcaauaugacgauagaaugcaaauucccuguggagaagcagcuggauuuggcagccuuaaucgucuauugggaaauggaggacaaaaacauuauccaauuugugcauggggaagaggaucugaagguucagcacuccucuuacaggcagcgggcgcgccuacucaaagaccagcugucacuuggaaaugcugcccugcaaauuaccgaugugaaguugcaggacgccggugucuaucgauguaugaucaguuacggcggggcagauuauaagcguauaacagugaaaguaaacgcuccauacaauaagaucaaccagaggauucucguuguggacccggucacuagcgagcaugaacugaccugccaggcagagggauaccccaaagccgaagugaucuggacauccucugaucaccaagugcugucgggcaagaccacuacaaccaauucaaaaagagaggagaagcuguucaacgucacgagcacuuuacggauuaauaccacaacuaacgaaaucuuuuauuguaccuuccgcagacuggacccugaggaaaaucauacagcugagcuuguuauaccagaauugccccuggcccacccuccaaacgagaggacccaccuagugauucucggugcgauccugcuuugccuggggguagcauugacguuuauuuuccggcuccgcaagggacgaaugauggaugugaaaaaguguggcauccaggacacuaauaguaaaaagcaguccgauacacaucuggaggaaaccuga

SEQ ID NO: 3077 - RNA, 873 nt, Artificial Sequence
  derived and/or modified sequence opt4 from PD1L1__Homo_sapiens__AAF25807
augagaaucuucgccguguucaucuucaugaccuacuggcaccugcugaacgccuucaccgugaccgugcccaaggaccuguacgugguggaguacggcagcaacaugaccaucgagugcaaguuccccguggagaagcagcuggaccuggccgcccugaucguguacugggagauggaggacaagaacaucauccaguucgugcacggcgaggaggaccugaaggugcagcacagcagcuacagacagagagccagacugcugaaggaccagcugagccugggcaacgccgcccugcagaucaccgacgugaagcugcaggacgccggcguguacagaugcaugaucagcuacggcggcgccgacuacaagagaaucaccgugaaggugaacgcccccuacaacaagaucaaccagagaauccuggugguggaccccgugaccagcgagcacgagcugaccugccaggccgagggcuaccccaaggccgaggugaucuggaccagcagcgaccaccaggugcugagcggcaagaccaccaccaccaacagcaagagagaggagaagcuguucaacgugaccagcacccugagaaucaacaccaccaccaacgagaucuucuacugcaccuucagaagacuggaccccgaggagaaccacaccgccgagcuggugauccccgagcugccccuggcccacccccccaacgagagaacccaccuggugauccugggcgccauccugcugugccugggcguggcccugaccuucaucuucagacugagaaagggcagaaugauggacgugaagaagugcggcauccaggacaccaacagcaagaagcagagcgacacccaccuggaggagaccuga

SEQ ID NO: 3078 - RNA, 873 nt, Artificial Sequence
  derived and/or modified sequence opt5 from PD1L1__Homo_sapiens__AAF25807
augagaaucuucgccguguuuauuuucaugaccuacuggcaccuccucaacgcuuuuacagucacgguucccaaggaccuguaugugguggaguacggcagcaauaugaccaucgaaugcaaauucccugucgagaagcagcuugaucuggccgcgcucauuguguauugggaaauggaggacaaaaacaucauucaauuuguucauggggaagaggaucugaaggugcagcacuccucuuaccggcagcgcgcuagacuucugaaagaccagcucagccugggaaaugccgcccugcaaaucacagaugucaagcuccaggacgcuggcguguaucgguguaugaucuccuacgggggagccgauuauaagcgcauuaccguuaaagugaacgcuccguacaauaagaucaaccagcggauucuggucguggaccccgugacaucugagcaugaacuuaccugccaggccgagggcuacccuaaagcggaagucaucuggacaagcuccgaucaccaaguucugucugggaagaccacgaccacaaauagcaaaagagaggagaagcuguucaacgugaccuccacacugcgcauuaauaccacgacaaacgaaaucuuuuauuguaccuucagacggcuugaccccgaggaaaaucauacagccgagcuggugauuccugaacucccccuggcucacccuccgaacgagcgcacccaccuggucauccucggagccauccugcuuugccugggcguggcucucaccuuuauuuucagacugcggaagggccgcaugauggauguuaaaaagugugggauccaggacacaaauagcaaaaagcagucugauacgcaucuugaggaaaccuga

SEQ ID NO: 3079 - protein, 288 aa, Artificial Sequence
  PDCD1__Homo_sapiens__Q15116
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 3080 - RNA, 867 nt, Artificial Sequence
  PDCD1__Homo_sapiens__AAH74740
augcagaucccacaggcgcccuggccagucgucugggcggugcuacaacugggcuggcggccaggaugguucuuagacuccccagacaggcccuggaacccccccaccuucuccccagcccugcucguggugaccgaaggggacaacgccaccuucaccugcagcuucuccaacacaucggagagcuucgugcuaaacugguaccgcaugagccccagcaaccagacggacaagcuggccgcuuuccccgaggaccgcagccagcccggccaggacugccgcuuccgugucacacaacugcccaacgggcgugacuuccacaugagcguggucagggcccggcgcaaugacagcggcaccuaccucuguggggccaucucccuggcccccaaggcgcagaucaaagagagccugcgggcagagcucagggugacagagagaagggcagaagugcccacagcccaccccagccccucacccaggccagccggccaguuccaaacccuggugguuggugucgugggcggccugcugggcagccuggugcugcuagucuggguccuggccgucaucugcucccgggccgcacgagggacaauaggagccaggcgcaccggccagccccugaaggaggaccccucagccgugccuguguucucuguggacuauggggagcuggauuuccaguggcgagagaagaccccggagccccccgugcccugugucccugagcagacggaguaugccaccauugucuuuccuagcggaaugggcaccucaucccccgcccgcaggggcucagccgacggcccucggagugcccagccacugaggccugaggauggacacugcucuuggccccucuga

SEQ ID NO: 3081 - RNA, 867 nt, Artificial Sequence
  derived and/or modified sequence opt1 from PDCD1__Homo_sapiens__AAH74740
augcagaucccccaggccccguggcccguggucugggccgugcugcagcucggcuggcgccccgggugguuccuggacagccccgaccggccguggaacccgcccaccuucucccccgcgcugcucguggucaccgagggcgacaacgccacguucacgugcagcuucuccaacaccagcgaguccuucgugcugaacugguaccgcaugagccccuccaaccagaccgacaagcuggccgccuuccccgaggaccggagccagcccgggcaggacugccgcuuccgggugacccagcuccccaacggccgcgacuuccacauguccgucgugcgggcccgccggaacgacagcgggaccuaccugugcggcgcgaucucccuggccccgaaggcccagaucaaggagagccuccgcgccgagcugcgggugaccgagcgccgggcggagguccccaccgcccaccccucccccagcccgcgccccgccggccaguuccagacgcugguggugggggucgugggcgggcuccugggcucccuggugcuccuggucugggugcuggccgugaucugcagccgggccgcgcgcgggaccaucggcgcccggcgcaccggccagccccucaaggaggaccccuccgccgucccgguguucagcguggacuacggggagcuggacuuccaguggcgggagaagacccccgagccgcccguccccugcgugcccgagcagacggaguacgccaccaucguguuccccuccggcauggggaccagcagccccgcccgccggggcuccgcggacggcccgcgcagcgcccagccccugcgccccgaggacgggcacugcuccuggccgcucuga

SEQ ID NO: 3082 - RNA, 867 nt, Artificial Sequence
  derived and/or modified sequence opt2 from PDCD1__Homo_sapiens__AAH74740
augcagaucccccaggcccccuggcccgucgucugggccguccuccagcucggcuggcgccccggcugguuccucgacucccccgaccgccccuggaacccccccaccuucucccccgcccuccucgucgucaccgagggcgacaacgccaccuucaccugcuccuucuccaacaccuccgaguccuucguccucaacugguaccgcaugucccccuccaaccagaccgacaagcucgccgccuuccccgaggaccgcucccagcccggccaggacugccgcuuccgcgucacccagcuccccaacggccgcgacuuccacauguccgucguccgcgcccgccgcaacgacuccggcaccuaccucugcggcgccaucucccucgcccccaaggcccagaucaaggagucccuccgcgccgagcuccgcgucaccgagcgccgcgccgagguccccaccgcccaccccucccccuccccccgccccgccggccaguuccagacccucgucgucggcgucgucggcggccuccucggcucccucguccuccucgucuggguccucgccgucaucugcucccgcgccgcccgcggcaccaucggcgcccgccgcaccggccagccccucaaggaggaccccuccgccguccccgucuucuccgucgacuacggcgagcucgacuuccaguggcgcgagaagacccccgagccccccguccccugcguccccgagcagaccgaguacgccaccaucgucuuccccuccggcaugggcaccuccucccccgcccgccgcggcuccgccgacggcccccgcuccgcccagccccuccgccccgaggacggccacugcuccuggccccucuga

SEQ ID NO: 3083 - RNA, 867 nt, Artificial Sequence
  derived and/or modified sequence opt3 from PDCD1__Homo_sapiens__AAH74740
augcagaucccccaagccccuuggccaguggucugggcuguucugcagcucggcuggagaccggggugguuccuugacagccccgauaggccuuggaacccacccaccuuuuccccugcacuguuggugguaacagagggagacaaugccacuuucacgugcucuuuuucaaacaccagugagagcuucguguuaaauugguaccggauguccccaucuaaccagacagauaagcuggcggcuuuucccgaagaccgcucgcagccuggucaagauugucgauuccgugucacucagcuaccaaauggcagagacuuucacaugucagugguuagggcccggcgcaacgauagcgggaccuaucucugcggagcaauuagucuggccccgaaagcucagauaaaggaaucccuuagagcagagcugagggugacagaacggcgcgccgagguccccaccgcucauccuucuccaagcccccgaccugccggccaguuccaaacuuuggugguagguguugucgggggacuccugggcucccuggugcucuuagugugggugcuggcggucaucuguucaagagcagccaggggcacaauuggggcucggcguaccggacagccacuuaaagaggaccccagugccguuccgguguuuagcguagauuacggugaauuggacuuccaguggcgcgagaagacgccugaacccccagugccuugcguccccgagcagacugaguaugcaaccaucguguuuccaucuggcauggggacauccucacccgcuagaaggggaagcgccgauggcccucggagugcgcaaccacugcgaccggaagacggucacuguucuuggccccuauga

SEQ ID NO: 3084 - RNA, 867 nt, Artificial Sequence
  derived and/or modified sequence opt4 from PDCD1__Homo_sapiens__AAH74740
augcagaucccccaggcccccuggcccguggugugggccgugcugcagcugggcuggagacccggcugguuccuggacagccccgacagacccuggaacccccccaccuucagccccgcccugcugguggugaccgagggcgacaacgccaccuucaccugcagcuucagcaacaccagcgagagcuucgugcugaacugguacagaaugagccccagcaaccagaccgacaagcuggccgccuuccccgaggacagaagccagcccggccaggacugcagauucagagugacccagcugcccaacggcagagacuuccacaugagcguggugagagccagaagaaacgacagcggcaccuaccugugcggcgccaucagccuggcccccaaggcccagaucaaggagagccugagagccgagcugagagugaccgagagaagagccgaggugcccaccgcccaccccagccccagccccagacccgccggccaguuccagacccugguggugggcguggugggcggccugcugggcagccuggugcugcuggugugggugcuggccgugaucugcagcagagccgccagaggcaccaucggcgccagaagaaccggccagccccugaaggaggaccccagcgccgugcccguguucagcguggacuacggcgagcuggacuuccaguggagagagaagacccccgagccccccgugcccugcgugcccgagcagaccgaguacgccaccaucguguuccccagcggcaugggcaccagcagccccgccagaagaggcagcgccgacggccccagaagcgcccagccccugagacccgaggacggccacugcagcuggccccuguga

SEQ ID NO: 3085 - RNA, 867 nt, Artificial Sequence
  derived and/or modified sequence opt5 from PDCD1__Homo_sapiens__AAH74740
augcagaucccccaagccccuuggccgguggucugggcuguucugcagcucggcuggagacccgggugguuccuggacagcccugaucggcccuggaacccucccaccuuuuccccugcccuucugguggugacagagggagacaaugcgacguuuaccugcucuuucagcaacacauccgaaucuuucguccucaauugguaccgcaugagcccguccaaccagaccgauaagcuggcugccuuucccgaggacagaucucagccuggccaagauugucgguuccgcgugacacagcuucccaaugggagagacuuucacaugagcguugugcgggcccgcagaaacgauuccggaaccuaucugugcggcgcuauuagccucgccccuaaagcucagaucaaggaaucucugcgggccgagcugcgcgucacagaaagacgggcggaggugcccaccgcccauccguccccuagcccccgcccugcugggcaguuccaaacgcucguugugggagucgugggcggccugcuugggucucuggugcuccuggucuggguucuugccgugauuuguuccagagcugcccggggaaccaucggcgcgcgcagaacagggcagccccugaaagaggaccccagcgccgugccugucuuuucuguggauuacggagaacucgacuuccaguggcgggagaagaccccggaacccccuguucccugcgugccugagcagacagaguaugcuaccauugucuuucccuccggcauggggacgagcuccccggccagacgcggaucugcugauggcccucggagcgcccaaccccugagaccugaagacggccacuguuccuggccccuguga

SEQ ID NO: 3086 - protein, 335 aa, Artificial Sequence
  PDEF__Homo_sapiens__O95238
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSAAWMKERTSPGAIHYCASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 3087 - RNA, 1008 nt, Artificial Sequence
  PDEF__Homo_sapiens__AAC95296
augggcagcgccagcccgggucugagcagcguaucccccagccaccuccugcugccccccgacacggugucgcggacaggcuuggagaaggcggcagcgggggcagugggucucgagagacgggacuggagucccaguccacccgccacgcccgagcagggccuguccgccuucuaccucuccuacuuugacaugcuguacccugaggacagcagcugggcagccaaggccccuggggccagcagucgggaggagccaccugaggagccugagcagugcccggucauugacagccaagccccagcgggcagccuggacuuggugcccggcgggcugaccuuggaggagcacucgcuggagcaggugcaguccaugguggugggcgaagugcucaaggacaucgagacggccugcaagcugcucaacaucaccgcagaucccauggacuggagccccagcaaugugcagaaguggcuccuguggacagagcaccaauaccggcugccccccaugggcaaggccuuccaggagcuggcgggcaaggagcugugcgccaugucggaggagcaguuccgccagcgcucgccccuggguggggaugugcugcacgcccaccuggacaucuggaagucagcggccuggaugaaagagcggacuucaccuggggcgauucacuacugugccucgaccagugaggagagcuggaccgacagcgagguggacucaucaugcuccgggcagcccauccaccuguggcaguuccucaaggaguugcuacucaagccccacagcuauggccgcuucauuagguggcucaacaaggagaagggcaucuucaaaauugaggacucagcccagguggcccggcuguggggcauccgcaagaaccgucccgccaugaacuacgacaagcugagccgcuccauccgccaguauuacaagaagggcaucauccggaagccagacaucucccagcgccucgucuaccaguucgugcaccccaucuga

SEQ ID NO: 3088 - RNA, 1008 nt, Artificial Sequence
  derived and/or modified sequence opt1 from PDEF__Homo_sapiens__AAC95296
augggcagcgccucccccgggcugagcuccgugagcccgucccaccuccugcugccgcccgacaccgucagccgcaccggccucgagaaggccgcggccggggccgugggccuggagcggcgcgacuggucccccagcccgcccgccacgcccgagcaggggcuguccgccuucuaccucagcuacuucgacaugcuguaccccgaggacuccagcugggcggccaaggcccccggcgccuccagccgggaggagccgcccgaggagcccgagcagugccccgugaucgacucccaggcgcccgccggcagccuggaccucguccccgggggccugacccuggaggagcacucccucgagcagguccagagcaugguggugggggaggugcugaaggacaucgagaccgccugcaagcugcucaacaucaccgccgaccccauggacugguccccgagcaacgugcagaaguggcugcuguggacggagcaccaguaccgccucccgcccaugggcaaggccuuccaggagcuggcggggaaggagcugugcgccaugagcgaggagcaguuccggcagcgcagcccccucggcggcgacguccugcacgcccaccuggacaucuggaaguccgccgccuggaugaaggagcggaccucccccggggcgauccacuacugcgccagcaccuccgaggagagcuggaccgacuccgagguggacagcuccugcagcggccagcccauccaccucuggcaguuccugaaggagcugcuccugaagccccacuccuacgggcgcuucauccgguggcugaacaaggagaagggcaucuucaagaucgaggacagcgcccagguggcccgccucuggggcauccggaagaaccgccccgccaugaacuacgacaagcugucccggagcauccgccaguacuacaagaaggggaucauccggaagccggacaucucccagcgccuggucuaccaguucgugcaccccaucuga

SEQ ID NO: 3089 - RNA, 1008 nt, Artificial Sequence
  derived and/or modified sequence opt2 from PDEF__Homo_sapiens__AAC95296
augggcuccgccucccccggccucuccuccgucucccccucccaccuccuccucccccccgacaccgucucccgcaccggccucgagaaggccgccgccggcgccgucggccucgagcgccgcgacuggucccccuccccccccgccacccccgagcagggccucuccgccuucuaccucuccuacuucgacaugcucuaccccgaggacuccuccugggccgccaaggcccccggcgccuccucccgcgaggagccccccgaggagcccgagcagugccccgucaucgacucccaggcccccgccggcucccucgaccucguccccggcggccucacccucgaggagcacucccucgagcagguccaguccauggucgucggcgagguccucaaggacaucgagaccgccugcaagcuccucaacaucaccgccgaccccauggacuggucccccuccaacguccagaaguggcuccucuggaccgagcaccaguaccgccucccccccaugggcaaggccuuccaggagcucgccggcaaggagcucugcgccauguccgaggagcaguuccgccagcgcuccccccucggcggcgacguccuccacgcccaccucgacaucuggaaguccgccgccuggaugaaggagcgcaccucccccggcgccauccacuacugcgccuccaccuccgaggaguccuggaccgacuccgaggucgacuccuccugcuccggccagcccauccaccucuggcaguuccucaaggagcuccuccucaagccccacuccuacggccgcuucauccgcuggcucaacaaggagaagggcaucuucaagaucgaggacuccgcccaggucgcccgccucuggggcauccgcaagaaccgccccgccaugaacuacgacaagcucucccgcuccauccgccaguacuacaagaagggcaucauccgcaagcccgacaucucccagcgccucgucuaccaguucguccaccccaucuga

SEQ ID NO: 3090 - RNA, 1008 nt, Artificial Sequence
  derived and/or modified sequence opt3 from PDEF__Homo_sapiens__AAC95296
augggcagcgccucccccgggcugucuucagugaguccuagccaccuccuucugccaccggacaccgucuccagaacaggauuggagaaggcugcagccggugcgguuggcuuagaaaggcgggauuggucucccucgccuccagcuacucccgagcaggggcugucagccuucuaccuaagcuauuuugacaugcucuacccugaagauaguuccugggcagccaaagcuccaggagcaucuagccgcgaggaacccccugaggagccagaacaaugcccggugaucgacucccaggcccccgcuggcucacuggaucuuguaccuggugggcugacguuggaggaacauagucucgaacaggugcagagcauggucgugggagagguucugaaggacauugaaaccgccuguaaacugcucaacauaacagcggauccaauggacuggucucccuccaaugugcaaaagugguuacuguggacugagcaccaguaucgacuuccuccaaugggcaaagcauuccaggaauuggccggcaaggagcugugcgcuaugucagaggagcaguuucgucaaagaagcccccuagggggagauguccuccaugcccaccuggacaucuggaagagugcagcuuggaugaaagagaggaccucuccgggugccauucauuacugugcguccacaagcgaagagucguggaccgauucugaaguggacuccucaugcaguggccagccuauccaccuuuggcaguuccugaaggaguugcuccugaaaccccacagcuaugggcgguuuauucgcugguuaaacaaggaaaaaggaaucuucaagauagaggauuccgcccagguagcaagacuguggggcaucaggaagaaucggccagcuaugaacuacgacaaacucucucgcagcauucgacaauauuacaagaaagguaucauuagaaagccugacaucucacagaggcuuguuuaccaguuugugcaucccauauga

SEQ ID NO: 3091 - RNA, 1008 nt, Artificial Sequence
  derived and/or modified sequence opt4 from PDEF__Homo_sapiens__AAC95296
augggcagcgccagccccggccugagcagcgugagccccagccaccugcugcugccccccgacaccgugagcagaaccggccuggagaaggccgccgccggcgccgugggccuggagagaagagacuggagccccagcccccccgccacccccgagcagggccugagcgccuucuaccugagcuacuucgacaugcuguaccccgaggacagcagcugggccgccaaggcccccggcgccagcagcagagaggagccccccgaggagcccgagcagugccccgugaucgacagccaggcccccgccggcagccuggaccuggugcccggcggccugacccuggaggagcacagccuggagcaggugcagagcaugguggugggcgaggugcugaaggacaucgagaccgccugcaagcugcugaacaucaccgccgaccccauggacuggagccccagcaacgugcagaaguggcugcuguggaccgagcaccaguacagacugccccccaugggcaaggccuuccaggagcuggccggcaaggagcugugcgccaugagcgaggagcaguucagacagagaagcccccugggcggcgacgugcugcacgcccaccuggacaucuggaagagcgccgccuggaugaaggagagaaccagccccggcgccauccacuacugcgccagcaccagcgaggagagcuggaccgacagcgagguggacagcagcugcagcggccagcccauccaccuguggcaguuccugaaggagcugcugcugaagccccacagcuacggcagauucaucagauggcugaacaaggagaagggcaucuucaagaucgaggacagcgcccagguggccagacuguggggcaucagaaagaacagacccgccaugaacuacgacaagcugagcagaagcaucagacaguacuacaagaagggcaucaucagaaagcccgacaucagccagagacugguguaccaguucgugcaccccaucuga

SEQ ID NO: 3092 - RNA, 1008 nt, Artificial Sequence
  derived and/or modified sequence opt5 from PDEF__Homo_sapiens__AAC95296
augggcagcgccucccccgggcugucuagcguguccccuucucaccuccugcuuccgcccgacaccgucagcagaacaggacuggagaaggcugccgcgggcgcuguugggcucgaacggcgcgauugguccccuucucccccugccacgcccgagcagggacugagcgccuucuaccuuuccuauuuugacaugcuguacccugaagauagcucuugggcugccaaagcuccgggcgccuccagcagagaggaacccccugaggagcccgaacaaugcccugugaucgacucucaggcgcccgccgggucccucgaucuggugccgggaggccugacccucgaggaacauagccuggagcagguccagucuauggugguuggcgaggugcuuaaggacauugaaacagcuuguaaacugcucaacaucaccgccgauccuauggacuggucccccagcaauguccaaaaguggcugcuuuggacagagcaccaguaucggcugccucccauggggaaggcuuuccaggaacucgccggaaaggagcugugcgcgauguccgaggaacaguuucgccaaagaucuccccugggcggggaugugcuccaugcccaccuggacauuuggaaaagcgcugccuggaugaaagagcggaccuccccuggagcuauccauuacugugccagcacaucugaagaguccuggaccgauagcgaaguugacucuagcugcuccggccagccgauucaccuuuggcaguuccugaaggagcuccugcuuaaaccccacucuuaugggcgcuuuaucagauggcugaacaaggaaaaaggaaucuucaagauugaggauagcgcccagguggcucggcucuggggcauccgcaagaauagaccugcgaugaacuacgacaaacugucccggagcauucgccaauauuacaagaaaggcaucauuagaaagcccgacaucucucagcggcuggucuaccaguuugugcauccuauuuga

SEQ ID NO: 3093 - protein, 738 aa, Artificial Sequence
  PECA1__Homo_sapiens__P16284
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 3094 - RNA, 2217 nt, Artificial Sequence
  PECA1__Homo_sapiens__AAA36429
augcagccgaggugggcccaaggggccacgauguggcuuggaguccugcugacccuucugcucuguucaagccuugagggucaagaaaacucuuucacaaucaacaguguugacaugaagagccugccggacuggacggugcaaaaugggaagaaccugacccugcagugcuucgcggaugucagcaccaccucucacgucaagccucagcaccagaugcuguucuauaaggaugacgugcuguuuuacaacaucuccuccaugaagagcacagagaguuauuuuauuccugaaguccggaucuaugacucagggacauauaaauguacugugauugugaacaacaaagagaaaaccacugcagaguaccagcuguugguggaaggagugcccagucccagggugacacuggacaagaaagaggccauccaaggugggaucgugagggucaacuguucugucccagaggaaaaggccccaauacacuucacaauugaaaaacuugaacuaaaugaaaaaauggucaagcugaaaagagagaagaauucucgagaccagaauuuugugauacuggaauuccccguugaggaacaggaccgcguuuuauccuuccgaugucaagcuaggaucauuucugggauccauaugcagaccucagaaucuaccaagagugaacuggucaccgugacggaauccuucucuacacccaaguuccacaucagccccaccggaaugaucauggaaggagcucagcuccacauuaagugcaccauucaagugacucaccuggcccaggaguuuccagaaaucauaauucagaaggacaaggcgauuguggcccacaacagacauggcaacaaggcuguguacucagucauggccaugguggagcacaguggcaacuacacgugcaaaguggaguccagccgcauauccaaggucagcagcaucguggucaacauaacagaacuauuuuccaagcccgaacuggaaucuuccuucacacaucuggaccaaggugaaagacugaaccuguccugcuccaucccaggagcaccuccagccaacuucaccauccagaaggaagauacgauugugucacagacucaagauuucaccaagauagccucaaagucggacagugggacguauaucugcacugcagguauugacaaaguggucaagaaaagcaacacaguccagauagucguaugugaaaugcucucccagcccaggauuucuuaugaugcccaguuugaggucauaaaaggacagaccaucgaaguccguugcgaaucgaucaguggaacuuugccuauuucuuaccaacuuuuaaaaacaaguaaaguuuuggagaauaguaccaagaacucaaaugauccugcgguauucaaagacaaccccacugaagacgucgaauaccaguguguugcagauaauugccauucccaugccaaaauguuaagugagguucugagggugaaggugauagccccgguggaugagguccagauuucuauccugucaaguaaggugguggagucuggagaggacauugugcugcaaugugcugugaaugaaggaucuggucccaucaccuauaaguuuuacagagaaaaagagggcaaacccuucuaucaaaugaccucaaaugccacccaggcauuuuggaccaagcagaaggcuagcaaggaacaggagggagaguauuacugcacagccuucaacagagccaaccacgccuccaguguccccagaagcaaaauacugacagucagagucauucuugccccauggaagaaaggacuuauugcagugguuaucaucggagugaucauugcucucuugaucauugcggccaaauguuauuuucugaggaaagccaaggccaagcagaugccaguggaaauguccaggccagcaguaccacuucugaacuccaacaacgagaaaaugucagaucccaauauggaagcuaacagucauuacggucacaaugacgaugucagaaaccaugcaaugaaaccaauaaaugauaauaaagagccucugaacucagacgugcaguacacggaaguucaaguguccucagcugagucucacaaagaucuaggaaagaaggacacagagacaguguacagugaaguccggaaagcugucccugaugccguggaaagcagauacucuagaacggaaggcucccuugauggaacuuag

SEQ ID NO: 3095 - RNA, 2217 nt, Artificial Sequence
  derived and/or modified sequence opt1 from PECA1__Homo_sapiens__AAA36429
augcagccccgcugggcccagggcgccaccauguggcugggggugcuccugacccugcuccugugcagcucccuggagggccaggagaacagcuucacgaucaacuccgucgacaugaagucccucccggacuggaccgugcagaacgggaagaaccugacccugcagugcuucgcggacgugagcaccacgagccacgucaagccccagcaccagaugcuguucuacaaggacgacguccucuucuacaacaucuccagcaugaaguccaccgagagcuacuucauccccgaggugcggaucuacgacuccggcaccuacaagugcaccgugaucgugaacaacaaggagaagacgaccgccgaguaccagcugcucguggaggggguccccagcccgcgcgugacccuggacaagaaggaggccauccagggcggcaucgugcgggucaacugcuccgugcccgaggagaaggcccccauccacuucaccaucgagaagcuggagcucaacgagaagauggugaagcugaagcgcgagaagaacagccgggaccagaacuucgucauccuggaguuccccguggaggagcaggaccgcgugcucuccuuccggugccaggcccgcaucaucagcgggauccacaugcagacguccgagagcaccaaguccgagcuggucaccgugaccgagagcuucagcacgccgaaguuccacaucucccccaccggcaugaucauggagggggcgcagcugcacaucaagugcaccauccaggugacccaccucgcccaggaguuccccgagaucaucauccagaaggacaaggccaucgucgcccacaaccggcacggcaacaaggcgguguacagcgugauggccauggucgagcacuccgggaacuacacgugcaagguggagagcucccgcaucagcaaggucuccagcaucguggugaacaucaccgagcuguucuccaagcccgagcuggagagcuccuucacccaccucgaccagggcgagcggcugaaccugagcugcuccaucccgggcgccccgcccgccaacuucaccauccagaaggaggacacgaucgucagccagacccaggacuucaccaagaucgccuccaagagcgacuccgggaccuacaucugcacggcgggcaucgacaagguggugaagaaguccaacaccguccagaucguggugugcgagaugcucagccagccccgcaucagcuacgacgcccaguucgaggucaucaaggggcagaccaucgaggugcggugcgagagcaucuccggcacccugcccaucagcuaccagcugcucaagacguccaaggugcuggagaacagcaccaagaacuccaacgaccccgccgucuucaaggacaaccccaccgaggacguggaguaccagugcguggccgacaacugccacagccacgccaagaugcuguccgagguccuccgcgugaaggugaucgcgcccgucgacgaggugcagaucagcauccuguccagcaagguggucgaguccggcgaggacaucgugcugcagugcgccgugaacgaggggagcggcccgaucaccuacaaguucuaccgggagaaggaggggaagcccuucuaccagaugacguccaacgccacccaggccuucuggaccaagcagaaggccagcaaggagcaggagggcgaguacuacugcaccgcguucaaccgcgccaaccacgccuccagcgucccccgguccaagauccucaccgugcgcgugauccuggcccccuggaagaaggggcugaucgccgucgugaucaucggcgugaucaucgcgcuccugaucaucgccgccaagugcuacuuccugcggaaggccaaggcgaagcagaugccggucgagaugagccgccccgccgugccccuccugaacagcaacaacgagaagauguccgaccccaacauggaggccaacagccacuacggccacaacgacgacgugcggaaccacgccaugaagccgaucaacgacaacaaggagccccugaacuccgacguccaguacacggagguccaggugagcuccgccgagagccacaaggaccucgggaagaaggacaccgagaccguguacuccgaggugcgcaaggcggugcccgacgccgucgagagccgcuacucccggaccgagggcagccuggacgggacguga

SEQ ID NO: 3096 - RNA, 2217 nt, Artificial Sequence
  derived and/or modified sequence opt2 from PECA1__Homo_sapiens__AAA36429
augcagccccgcugggcccagggcgccaccauguggcucggcguccuccucacccuccuccucugcuccucccucgagggccaggagaacuccuucaccaucaacuccgucgacaugaagucccuccccgacuggaccguccagaacggcaagaaccucacccuccagugcuucgccgacgucuccaccaccucccacgucaagccccagcaccagaugcucuucuacaaggacgacguccucuucuacaacaucuccuccaugaaguccaccgaguccuacuucauccccgagguccgcaucuacgacuccggcaccuacaagugcaccgucaucgucaacaacaaggagaagaccaccgccgaguaccagcuccucgucgagggcguccccuccccccgcgucacccucgacaagaaggaggccauccagggcggcaucguccgcgucaacugcuccguccccgaggagaaggcccccauccacuucaccaucgagaagcucgagcucaacgagaagauggucaagcucaagcgcgagaagaacucccgcgaccagaacuucgucauccucgaguuccccgucgaggagcaggaccgcguccucuccuuccgcugccaggcccgcaucaucuccggcauccacaugcagaccuccgaguccaccaaguccgagcucgucaccgucaccgaguccuucuccacccccaaguuccacaucucccccaccggcaugaucauggagggcgcccagcuccacaucaagugcaccauccaggucacccaccucgcccaggaguuccccgagaucaucauccagaaggacaaggccaucgucgcccacaaccgccacggcaacaaggccgucuacuccgucauggccauggucgagcacuccggcaacuacaccugcaaggucgaguccucccgcaucuccaaggucuccuccaucgucgucaacaucaccgagcucuucuccaagcccgagcucgaguccuccuucacccaccucgaccagggcgagcgccucaaccucuccugcuccauccccggcgccccccccgccaacuucaccauccagaaggaggacaccaucgucucccagacccaggacuucaccaagaucgccuccaaguccgacuccggcaccuacaucugcaccgccggcaucgacaaggucgucaagaaguccaacaccguccagaucgucgucugcgagaugcucucccagccccgcaucuccuacgacgcccaguucgaggucaucaagggccagaccaucgagguccgcugcgaguccaucuccggcacccuccccaucuccuaccagcuccucaagaccuccaagguccucgagaacuccaccaagaacuccaacgaccccgccgucuucaaggacaaccccaccgaggacgucgaguaccagugcgucgccgacaacugccacucccacgccaagaugcucuccgagguccuccgcgucaaggucaucgcccccgucgacgagguccagaucuccauccucuccuccaaggucgucgaguccggcgaggacaucguccuccagugcgccgucaacgagggcuccggccccaucaccuacaaguucuaccgcgagaaggagggcaagcccuucuaccagaugaccuccaacgccacccaggccuucuggaccaagcagaaggccuccaaggagcaggagggcgaguacuacugcaccgccuucaaccgcgccaaccacgccuccuccgucccccgcuccaagauccucaccguccgcgucauccucgcccccuggaagaagggccucaucgccgucgucaucaucggcgucaucaucgcccuccucaucaucgccgccaagugcuacuuccuccgcaaggccaaggccaagcagaugcccgucgagaugucccgccccgccgucccccuccucaacuccaacaacgagaagauguccgaccccaacauggaggccaacucccacuacggccacaacgacgacguccgcaaccacgccaugaagcccaucaacgacaacaaggagccccucaacuccgacguccaguacaccgagguccaggucuccuccgccgagucccacaaggaccucggcaagaaggacaccgagaccgucuacuccgagguccgcaaggccguccccgacgccgucgagucccgcuacucccgcaccgagggcucccucgacggcaccuga

SEQ ID NO: 3097 - RNA, 2217 nt, Artificial Sequence
  derived and/or modified sequence opt3 from PECA1__Homo_sapiens__AAA36429
augcagcccagaugggcccaaggcgcuaccauguggcugggggugcuccuuacacuguuguuaugcagcucccuggagggacaggaaaacucuuucacuaucaauucagucgacaugaagagucuaccugauuggacgguucagaacgguaaaaaucucacccugcaguguuuugcagacgugagcacaacuucccacguaaagccacaacaucagaugcuuuucuacaaagaugacgugcuguuuuauaacauuucuucgaugaagucaaccgagagcuacuucauaccggaagucaggaucuaugauaguggcacauacaaaugcaccgugauuguuaauaacaaggagaagacuacagccgaauaucaguugcucguggaggggguccccuccccucgggugacccuggacaaaaaggaggcgauccagggaggcauuguacgcguuaauuguucugugccagaagagaaagcucccauccacuuuacgauagaaaagcuggagcucaacgagaaaauggucaaguuaaagcgagaaaagaauagccgugaucaaaacuucgugauccuggaguuuccuguggaggagcaggacagaguccuuuccuucaggugccaggcccggauuaucucagguauucauaugcagaccagugaaagcacuaagucugaguugguuacagugacugaguccuuuucaaccccaaaauuccacaucagccccacagggaugauaauggaaggagcacaacugcauauuaaguguaccauccagguaacgcaccuagcccaggaguuuccugaaauuaucauccaaaaagauaaggcuauuguggcacacaaucgccauggcaacaaagccgucuacagugugauggcuaugguugagcacucuggcaauuauacuugcaagguggaauccagcagaauaucgaaggucucuuccaucgugguaaacauuacagaacucuucucaaaaccagagcuggaaaguagcuuuacccaucuugaccagggggagaggcugaauuuguccuguucuaucccgggagcucccccugcgaacuucacuauacagaaggaagauacaauuguuagccagacccaagacuucacgaaaaucgcaucaaagagugauuccgguaccuacaucugcacagccggcauugacaaaguggucaaaaagagcaacacugugcagaucgucgugugugagaugcucucucagccacggauuucauacgacgcucaguuugaaguuauaaaagggcaaaccaucgaggugcgcugcgagaguauuagcggaacacugcccaucuccuaucaguuacugaagacuucuaaaguacucgaaaauucgaccaagaacagcaaugauccugccgucuucaaagacaacccaacagaggauguggaauaccaguguguugcagacaauugccacucccacgcuaagaugcuuucagaggugcugcgagucaaggugaucgcccccguagaugaggugcagauuaguauauugucuagcaaaguugucgaauccggcgaggacaucgugcuacaaugcgcggugaacgaagguucagggccgauuaccuauaaguuuuacagagagaaagaaggaaagccuuucuaucagaugacuagcaaugccacgcaggcauuuuggacaaaacagaaggcuucuaaggagcaagagggcgaauacuauuguaccgccuucaacagggcuaaucaugccuccagugucccccggagcaaaauccugacuguucgugugauucucgcaccauggaagaaaggccugaucgccgugguaauaaucggggucauuaucgcccuucugauuaucgcggcaaagugcuacuuuuugcgcaaagccaaggcuaaacagaugccuguggagaugucuagacccgccguuccacuccugaacuccaauaacgaaaagaugucagaucccaauauggaggcaaacagucacuacggacauaaugacgaugugaggaaccacgccaugaagccuauaaacgacaauaaagaaccauuaaacagcgauguccaguauaccgaggugcaaguuucguccgcugagucucauaaggaccuggguaaaaaggacacagaaaccguguacagcgagguacggaaagccgucccggaugcaguggaaucacgauauagucgcacugagggcucccuagacgggacauga

SEQ ID NO: 3098 - RNA, 2217 nt, Artificial Sequence
  derived and/or modified sequence opt4 from PECA1__Homo_sapiens__AAA36429
augcagcccagaugggcccagggcgccaccauguggcugggcgugcugcugacccugcugcugugcagcagccuggagggccaggagaacagcuucaccaucaacagcguggacaugaagagccugcccgacuggaccgugcagaacggcaagaaccugacccugcagugcuucgccgacgugagcaccaccagccacgugaagccccagcaccagaugcuguucuacaaggacgacgugcuguucuacaacaucagcagcaugaagagcaccgagagcuacuucauccccgaggugagaaucuacgacagcggcaccuacaagugcaccgugaucgugaacaacaaggagaagaccaccgccgaguaccagcugcugguggagggcgugcccagccccagagugacccuggacaagaaggaggccauccagggcggcaucgugagagugaacugcagcgugcccgaggagaaggcccccauccacuucaccaucgagaagcuggagcugaacgagaagauggugaagcugaagagagagaagaacagcagagaccagaacuucgugauccuggaguuccccguggaggagcaggacagagugcugagcuucagaugccaggccagaaucaucagcggcauccacaugcagaccagcgagagcaccaagagcgagcuggugaccgugaccgagagcuucagcacccccaaguuccacaucagccccaccggcaugaucauggagggcgcccagcugcacaucaagugcaccauccaggugacccaccuggcccaggaguuccccgagaucaucauccagaaggacaaggccaucguggcccacaacagacacggcaacaaggccguguacagcgugauggccaugguggagcacagcggcaacuacaccugcaagguggagagcagcagaaucagcaaggugagcagcaucguggugaacaucaccgagcuguucagcaagcccgagcuggagagcagcuucacccaccuggaccagggcgagagacugaaccugagcugcagcauccccggcgccccccccgccaacuucaccauccagaaggaggacaccaucgugagccagacccaggacuucaccaagaucgccagcaagagcgacagcggcaccuacaucugcaccgccggcaucgacaagguggugaagaagagcaacaccgugcagaucguggugugcgagaugcugagccagcccagaaucagcuacgacgcccaguucgaggugaucaagggccagaccaucgaggugagaugcgagagcaucagcggcacccugcccaucagcuaccagcugcugaagaccagcaaggugcuggagaacagcaccaagaacagcaacgaccccgccguguucaaggacaaccccaccgaggacguggaguaccagugcguggccgacaacugccacagccacgccaagaugcugagcgaggugcugagagugaaggugaucgcccccguggacgaggugcagaucagcauccugagcagcaaggugguggagagcggcgaggacaucgugcugcagugcgccgugaacgagggcagcggccccaucaccuacaaguucuacagagagaaggagggcaagcccuucuaccagaugaccagcaacgccacccaggccuucuggaccaagcagaaggccagcaaggagcaggagggcgaguacuacugcaccgccuucaacagagccaaccacgccagcagcgugcccagaagcaagauccugaccgugagagugauccuggcccccuggaagaagggccugaucgccguggugaucaucggcgugaucaucgcccugcugaucaucgccgccaagugcuacuuccugagaaaggccaaggccaagcagaugcccguggagaugagcagacccgccgugccccugcugaacagcaacaacgagaagaugagcgaccccaacauggaggccaacagccacuacggccacaacgacgacgugagaaaccacgccaugaagcccaucaacgacaacaaggagccccugaacagcgacgugcaguacaccgaggugcaggugagcagcgccgagagccacaaggaccugggcaagaaggacaccgagaccguguacagcgaggugagaaaggccgugcccgacgccguggagagcagauacagcagaaccgagggcagccuggacggcaccuga

SEQ ID NO: 3099 - RNA, 2217 nt, Artificial Sequence
  derived and/or modified sequence opt5 from PECA1__Homo_sapiens__AAA36429
augcagcccagaugggcccaaggcgcuaccauguggcugggggugcuccugacacuucugcucugcagcucccuggagggacaggaaaacucuuucacgaucaauagcgucgacaugaagucccuuccugauuggaccguucagaacggcaaaaaucugacacuccaguguuuugccgacgugucuaccacaagccacgugaagccgcaacaucagaugcuguucuacaaagaugacguccuguuuuauaacauuuccucuaugaaaagcaccgaguccuacuucauccccgaagugcggauuuaugauagcgggacauacaaaugcaccguuaucgugaauaacaaggagaagacgaccgcggaauaucagcuccuggucgagggagugccuucuccccgcguuacacuugacaaaaaggaggcuauucagggcgggaucgugagagucaauuguuccgugccugaagagaaagcccccauccacuuuaccauugaaaagcuggagcucaacgagaaaauggugaagcugaagcgggaaaagaauagccgcgaucaaaacuucgucauccuugaguuuccuguugaggagcaggacagagugcugucuuuccggugccaggcccgcauuaucuccggcauucauaugcagacaagcgaaucuaccaaguccgagcucgugacggucacagagagcuuuuccaccccgaaauuccacaucucucccacaggaaugauuauggaaggcgcucaacugcauaucaaguguaccauccaggugacccaccuggcccaggaguuuccugaaauuaucauucaaaaagauaaggcuaucguugcccacaauagacaugggaacaaagcgguguacagcgucauggccaugguggagcacuccggaaauuauacaugcaagguugaaagcucucggauuuccaaggugagcucuaucgucgugaacaucacggaacucuucagcaaacccgagcuggaauccucuuuuacccaucuugaccagggcgagcgccugaaucucagcuguuccauuccuggggcucccccggccaacuucacaauccagaaggaagauaccauugucagccagacacaagacuucaccaaaaucgcuucuaaguccgauagcggaacguacauuugcacagccggcaucgacaaagugguuaagaagucuaacaccgugcagaucgucgugugugagaugcugucccagccuagaauuagcuacgacgcgcaguuugaaguuaucaaagggcaaaccauugaggugcggugcgaguccaucucuggaacacuucccauuagcuaucagcugcucaagaccuccaaaguccuggaaaauucuacaaagaacagcaaugauccugccguguucaaagacaaccccacggaggauguggaauaccaguguguugcugacaauugccacucccacgccaagaugcugagcgagguccuccgcgugaaggugaucgcucccgucgaugaggugcagauuucuauccuguccagcaaaguuguggaaucuggcgaggacaucguccuucaaugcgccgugaacgaaggcuccgggccuauuaccuauaaguuuuacagagagaaagaaggaaagccguucuaucagaugacaagcaaugccacccaggcuuuuuggacaaaacagaaggcgucuaaggagcaagagggcgaauacuauuguaccgccuucaaccgggcuaaucaugccagcuccguuccccgcagcaaaauccugacggugagagucauucucgccccuuggaagaaagggcugaucgcugugguuauuaucggagugaucauugcccuucugaucauugcggcuaagugcuacuuucuccggaaagccaaggccaaacagaugcccgucgagaugucuagaccugcugugccccugcugaacuccaauaacgaaaagaugagcgauccgaauauggaggccaacucccacuacggccauaaugacgaugugcgcaaccacgcuaugaagccuaucaacgacaauaaagaaccccucaacucugauguccaguauaccgagguucaagugagcuccgccgagucucauaaggaccuggggaaaaaggacacagaaaccguguacagcgagguccggaaagcggugccugaugccguugaauccagauauucucgcacagagggaagccuugacggcaccuga

SEQ ID NO: 3100 - protein, 911 aa, Artificial Sequence
  PGCB__Homo_sapiens__Q96GW7
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 3101 - RNA, 2736 nt, Artificial Sequence
  PGCB__Homo_sapiens__AAG23134
auggcccagcuguuccugccccugcuggcagcccugguccuggcccaggcuccugcagcuuuagcagauguucuggaaggagacagcucagaggaccgcgcuuuucgcgugcgcaucgcgggcgacgcgccacugcagggcgugcucggcggcgcccucaccaucccuugccacguccacuaccugcggccaccgccgagccgccgggcugugcugggcucuccgcgggucaaguggacuuuccugucccggggccgggaggcagaggugcugguggcgcggggagugcgcgucaaggugaacgaggccuaccgguuccgcguggcacugccugcguacccagcgucgcucaccgacgucucccuggcgcugagcgagcugcgccccaacgacucagguaucuaucgcugugagguccagcacggcaucgaugacagcagcgacgcuguggaggucaaggucaaaggggucgucuuucucuaccgagagggcucugcccgcuaugcuuucuccuuuucuggggcccaggaggccugugcccgcauuggagcccacaucgccaccccggagcagcucuaugccgccuaccuugggggcuaugagcaaugugaugcuggcuggcugucggaucagaccgugagguaucccauccagaccccacgagaggccuguuacggagacauggauggcuuccccgggguccggaacuauggugugguggacccggaugaccucuaugauguguacuguuaugcugaagaccuaaauggagaauuguuccugggugacccuccagagaagcugacauuggaggaagcacgggcguacugccaggagcggggugcagagauugccaccacgggccaacuguaugcagccugggaugguggccuggaccacugcagcccaggguggcuagcugauggcagugugcgcuaccccaucgucacacccagccagcgcuguggugggggcuugccuggugucaagacucucuuccucuuccccaaccagacuggcuuccccaauaagcacagccgcuucaacgucuacugcuuccgagacucggcccagccuucugccaucccugaggccuccaacccagccuccaacccagccucugauggacuagaggcuaucgucacagugacagagacccuggaggaacugcagcugccucaggaagccacagagagugaaucccguggggccaucuacuccauccccaucauggaggacggaggagguggaagcuccacuccagaagacccagcagaggccccuaggacgcuccuagaauuugaaacacaauccaugguaccgcccacgggguucucagaagaggaagguaaggcauuggaggaagaagagaaauaugaagaugaagaagagaaagaggaggaagaagaagaggaggagguggaggaugaggcucugugggcauggcccagcgagcucagcagcccgggcccugaggccucucuccccacugagccagcagcccaggaggagucacucucccaggcgccagcaagggcaguccugcagccuggugcaucaccacuuccugauggagagucagaagcuuccaggccuccaaggguccauggaccaccuacugagacucugcccacucccagggagaggaaccuagcauccccaucaccuuccacucugguugaggcaagagaggugggggaggcaacuggugguccugagcuaucuggggucccucgaggagagagcgaggagacaggaagcuccgagggugccccuucccugcuuccagccacacgggccccugaggguaccagggagcuggaggcccccucugaagauaauucuggaagaacugccccagcagggaccucagugcaggcccagccagugcugcccacugacagcgccagccgagguggaguggccgugguccccgcaucaggugacuguguccccagccccugccacaauggugggacaugcuuggaggaggaggaagggguccgcugccuaugucugccuggcuaugggggggaccugugcgauguuggccuccgcuucugcaaccccggcugggacgccuuccagggcgccugcuacaagcacuuuuccacacgaaggagcugggaggaggcagagacccagugccggauguacggcgcgcaucuggccagcaucagcacacccgaggaacaggacuucaucaacaaccgguaccgggaguaccaguggaucggacucaacgacaggaccaucgaaggcgacuucuuguggucggauggcgucccccugcucuaugagaacuggaacccugggcagccugacagcuacuuccugucuggagagaacugcguggucaugguguggcaugaucagggacaauggagugacgugcccugcaacuaccaccuguccuacaccugcaagauggggcugguguccugugggccgccaccggagcugccccuggcucaaguguucggccgcccacggcugcgcuaugagguggacacugugcuucgcuaccggugccgggaaggacuggcccagcgcaaucugccgcugauccgaugccaagagaacggucguugggaggccccccagaucuccugugugcccagaagaccugcccgagcucugcacccagaggaggacccagaaggacgucaggggaggcuacugggacgcuggaaggcgcuguugauccccccuuccagccccaugccaggucccuag

SEQ ID NO: 3102 - RNA, 2736 nt, Artificial Sequence
  derived and/or modified sequence opt1 from PGCB__Homo_sapiens__AAG23134
auggcccagcuguuccucccccugcuggccgcgcucgugcuggcccaggccccggccgcccuggcggacguccucgagggcgacagcuccgaggaccgcgccuuccgggugcgcaucgccggggacgcgccccugcagggcgugcucgggggcgcccugaccauccccugccacguccacuaccugcggcccccgcccagccgccgggccgugcuggggagcccccgcgugaaguggaccuuccucucccggggccgcgaggccgagguccugguggcccggggcgugcgcgucaaggugaacgaggccuaccgguuccgcguggcgcugcccgccuacccggccucccucacggacgucagccuggcccuguccgagcuccggcccaacgacagcgggaucuaccgcugcgaggugcagcacggcaucgacgacuccagcgacgccguggaggucaaggugaaggggguggucuuccuguaccgggagggcuccgcgcgcuacgccuucagcuucuccggggcccaggaggccugcgcccggaucggcgcgcacaucgccacccccgagcagcuguacgccgccuaccucggcggguacgagcagugcgacgccggcuggcugagcgaccagaccgugcgcuaccccauccagaccccgcgggaggcgugcuacggggacauggacggcuuccccggcgugcgcaacuacggggucguggaccccgacgaccuguacgacguguacugcuacgccgaggaccucaacggcgagcuguuccugggggacccgcccgagaagcucacgcuggaggaggcccgggccuacugccaggagcgcggcgcggagaucgccaccaccgggcagcuguacgccgccugggacggcggccucgaccacugcucccccggguggcuggccgacggcagcguccgcuaccccaucgugacccccucccagcggugcgggggcgggcugccgggcgucaagacccucuuccuguuccccaaccagaccggcuuccccaacaagcacagccgcuucaacguguacugcuuccgggacuccgcgcagcccagcgccaucccggaggccagcaaccccgccuccaaccccgccagcgacgggcuggaggcgaucgugaccgucaccgagacgcucgaggagcugcagcugccccaggaggccaccgaguccgagagccgcggcgccaucuacuccaucccgaucauggaggacgggggcgggggcagcuccacccccgaggaccccgccgaggccccgcggacccuccuggaguucgagacgcagagcauggugccgcccaccggcuucuccgaggaggaggggaaggcgcuggaggaggaggagaaguacgaggacgaggaggagaaggaggaggaggaggaggaggaggagguggaggacgaggcccucugggccuggcccagcgagcuguccagccccggccccgaggccucccugcccaccgagcccgcggcccaggaggagagccucucccaggccccggcccgcgccguccugcagcccggggcgagcccccugcccgacggcgaguccgaggccagccggccgccccgcgugcacggcccgcccaccgagacgcuccccacgccccgggagcgcaaccuggccucccccagccccagcacccugguggaggcccgggaggucggggaggccaccggcgggccggagcuguccggcgugccccgcggggagagcgaggagacgggcuccagcgagggcgcgcccucccuccugcccgccacccgggccccggaggggacccgcgagcuggaggcccccagcgaggacaacuccggccggaccgcccccgcggggacgagcgugcaggcccagccgguccuccccaccgacuccgccagccgcggcgggguggccgugguccccgcguccggcgacugcgugcccagcccgugccacaacggcgggaccugccuggaggaggaggagggcgugcggugccugugccuccccggguacggcggggaccugugcgacgucggccugcgcuucugcaaccccggcugggacgccuuccagggggccugcuacaagcacuucuccacccggcgcagcugggaggaggccgagacgcagugccgcauguacggcgcccaccucgcguccaucagcacccccgaggagcaggacuucaucaacaaccgguaccgcgaguaccaguggaucgggcugaacgaccggaccaucgagggcgacuuccugugguccgacggggugccgcuccuguacgagaacuggaaccccggccagcccgacagcuacuuccugagcggcgagaacugcguggucaugguguggcacgaccaggggcagugguccgacgugcccugcaacuaccaccucagcuacacgugcaagaugggccuggucuccugcgggccgccgcccgagcugccccucgcccagguguucggccgcccccggcugcgcuacgagguggacaccguccugcgguaccgcugccgggagggccucgcccagcgcaaccugccccugauccggugccaggagaacgggcgcugggaggcgccccagaucagcugcgugccccggcgcccggcccgggcccuccaccccgaggaggaccccgagggccgccaggggcggcugcugggccgcuggaaggcccuccugaucccgcccuccagccccaugcccgggcccuga

SEQ ID NO: 3103 - RNA, 2736 nt, Artificial Sequence
  derived and/or modified sequence opt2 from PGCB__Homo_sapiens__AAG23134
auggcccagcucuuccucccccuccucgccgcccucguccucgcccaggcccccgccgcccucgccgacguccucgagggcgacuccuccgaggaccgcgccuuccgcguccgcaucgccggcgacgccccccuccagggcguccucggcggcgcccucaccauccccugccacguccacuaccuccgccccccccccucccgccgcgccguccucggcuccccccgcgucaaguggaccuuccucucccgcggccgcgaggccgagguccucgucgcccgcggcguccgcgucaaggucaacgaggccuaccgcuuccgcgucgcccuccccgccuaccccgccucccucaccgacgucucccucgcccucuccgagcuccgccccaacgacuccggcaucuaccgcugcgagguccagcacggcaucgacgacuccuccgacgccgucgaggucaaggucaagggcgucgucuuccucuaccgcgagggcuccgcccgcuacgccuucuccuucuccggcgcccaggaggccugcgcccgcaucggcgcccacaucgccacccccgagcagcucuacgccgccuaccucggcggcuacgagcagugcgacgccggcuggcucuccgaccagaccguccgcuaccccauccagaccccccgcgaggccugcuacggcgacauggacggcuuccccggcguccgcaacuacggcgucgucgaccccgacgaccucuacgacgucuacugcuacgccgaggaccucaacggcgagcucuuccucggcgacccccccgagaagcucacccucgaggaggcccgcgccuacugccaggagcgcggcgccgagaucgccaccaccggccagcucuacgccgccugggacggcggccucgaccacugcucccccggcuggcucgccgacggcuccguccgcuaccccaucgucacccccucccagcgcugcggcggcggccuccccggcgucaagacccucuuccucuuccccaaccagaccggcuuccccaacaagcacucccgcuucaacgucuacugcuuccgcgacuccgcccagcccuccgccauccccgaggccuccaaccccgccuccaaccccgccuccgacggccucgaggccaucgucaccgucaccgagacccucgaggagcuccagcucccccaggaggccaccgaguccgagucccgcggcgccaucuacuccauccccaucauggaggacggcggcggcggcuccuccacccccgaggaccccgccgaggccccccgcacccuccucgaguucgagacccaguccauggucccccccaccggcuucuccgaggaggagggcaaggcccucgaggaggaggagaaguacgaggacgaggaggagaaggaggaggaggaggaggaggaggaggucgaggacgaggcccucugggccuggcccuccgagcucuccucccccggccccgaggccucccuccccaccgagcccgccgcccaggaggagucccucucccaggcccccgcccgcgccguccuccagcccggcgccuccccccuccccgacggcgaguccgaggccucccgccccccccgcguccacggcccccccaccgagacccuccccaccccccgcgagcgcaaccucgccucccccucccccuccacccucgucgaggcccgcgaggucggcgaggccaccggcggccccgagcucuccggcgucccccgcggcgaguccgaggagaccggcuccuccgagggcgcccccucccuccuccccgccacccgcgcccccgagggcacccgcgagcucgaggcccccuccgaggacaacuccggccgcaccgcccccgccggcaccuccguccaggcccagcccguccuccccaccgacuccgccucccgcggcggcgucgccgucguccccgccuccggcgacugcguccccucccccugccacaacggcggcaccugccucgaggaggaggagggcguccgcugccucugccuccccggcuacggcggcgaccucugcgacgucggccuccgcuucugcaaccccggcugggacgccuuccagggcgccugcuacaagcacuucuccacccgccgcuccugggaggaggccgagacccagugccgcauguacggcgcccaccucgccuccaucuccacccccgaggagcaggacuucaucaacaaccgcuaccgcgaguaccaguggaucggccucaacgaccgcaccaucgagggcgacuuccucugguccgacggcgucccccuccucuacgagaacuggaaccccggccagcccgacuccuacuuccucuccggcgagaacugcgucgucauggucuggcacgaccagggccagugguccgacguccccugcaacuaccaccucuccuacaccugcaagaugggccucgucuccugcggccccccccccgagcucccccucgcccaggucuucggccgcccccgccuccgcuacgaggucgacaccguccuccgcuaccgcugccgcgagggccucgcccagcgcaaccucccccucauccgcugccaggagaacggccgcugggaggccccccagaucuccugcgucccccgccgccccgcccgcgcccuccaccccgaggaggaccccgagggccgccagggccgccuccucggccgcuggaaggcccuccucaucccccccuccucccccaugcccggccccuga

SEQ ID NO: 3104 - RNA, 2736 nt, Artificial Sequence
  derived and/or modified sequence opt3 from PGCB__Homo_sapiens__AAG23134
auggcccagcuguuccucccccuucuggcugcauugguguuagcccaagcgccugcugcccuggcagacguccuagagggcgauagcuccgaagacagagccuuuaggguucggaucgcuggggaugcaccacuccagggagugcuggguggcgcccuuaccauuccgugccacguacauuaccugcgacccccuccaucucgccgugcuguguuggggucacccagagucaaguggacauuccucaguaggggacgggaggccgaagugcugguugcgcgcggcgugagagucaaagugaacgaggcauauagguuucggguagcccugccugcuuacccagccagccucacugacguuuccuuagcacugucugaacuucgccccaaugauucggguauauaucgaugugaggugcagcacgggaucgacgauucaagcgacgcugucgaggugaaggugaaaggagucguuuucuuguacagagaaggcagugccagguaugcguuuuccuucucuggcgcccaggaggcaugcgcucggauuggggcccauaucgcuacgccugaacaacuguacgccgcauaucuaggagguuacgagcagugugaugccggcuggcucagcgaccagaccgugcguuacccaauucagacaccgcgcgaggcuugcuauggggauauggacggauuucccggcguaagaaacuacgguguggucgauccugacgaccuguaugauguguacuguuaugcggaagaccuuaauggggagcuguucuugggagauccacccgaaaagcucacucuggaggaagcaagggccuacugccaagagcggggcgcugagaucgccaccacaggccaguuauaugcagccugggacgggggacuggaucacuguuccccugguuggcucgcugacggcucaguucgauacccaauagugacccccagucagcgcugcgggggaggccuuccgggugucaaaacucuguuuuuguucccuaaccagacaggguuucccaauaagcauagcagauucaacguguacuguuuuagggauucugcccaaccauccgcaaucccugaagcgucaaaucccgcuagcaacccagccagugacggccuagaggcaauuguaaccguuacggaaacucuggaggaacuccagcugccccaggaggccaccgagucugaaucccggggagcuaucuauagcauuccuaucauggaggauggcgggggagguucgucuacaccagaagacccggccgaggcaccccgcacucuucuggaguucgaaacccaauccauggugccuccaacaggcuucucagaggaagaggggaaggcuuuggaagaggaggaaaaauacgaggaugaagaggaaaaggaggaggaagaggaagaggaagaggucgaggacgaagcccucugggcguggcccagugagcugagcuccccuggaccagaagccucuuuacccaccgagccggcugcacaggaagagagccugucacaggccccugcuagagccgugcuacagccaggcgcaaguccccucccugacggugaguccgaagcgagcaggcccccacguguccacgggccucccacggagacucugccaacaccgcgggaacgaaaucuugccucuccuucacccaguaccuugguggaggcuagagagguuggcgaagccacuggaggcccagagcugagcggggugcccaggggagaauccgaggaaacagguucuucggagggcgcaccuagccuccugccagcuacccgcgcccccgaggggacgcgggaacuugaggcaccuuccgaagauaacucaggaagaaccgccccggcuggcacaaguguacaagcgcagccaguccugcccacugacucugccagcaggggugggguggcaguugugccugcuuccggcgauugcgucccaucacccugucacaauggagggaccugcuuggaggaagaggagggcgugcgcugccucugucugccuggauauggcggugacuuaugcgauguagggcugcgauuuuguaacccgggaugggacgccuuccagggcgccugcuacaaacauuuuagcacacggcguucuugggaagaggcugaaacucaguguagaauguauggugcacaccuagccuccauaaguacccccgaggaacaagauuucauuaauaacagguaccgcgaguaucaguggaucggccucaaugaccggacaauugagggggauuuucuguggagcgacggagugccacuuuuguacgaaaacuggaacccuggccagcccgauucuuacuuccuguccggggagaauugcguugucaugguguggcaugaccagggacaauggucagaugugccauguaacuaucaccucaguuauaccugcaagaugggccuggucagcugugguccucccccagaauuaccgcuggcgcagguuuuugggagaccuaggcuucgauacgagguggacacuguguugcgcuaccggugcagagagggacucgcucagaggaaucugccccuaauccguugucaggaaaacggccgcugggaggccccacaaaucucgugcguaccccggagaccugcaagggcccugcacccagaagaggaccccgaaggucgacagggccggcuccuggggcgcuggaaagcucuuuugauuccuccguccucuccaaugcccggaccuuga

SEQ ID NO: 3105 - RNA, 2736 nt, Artificial Sequence
  derived and/or modified sequence opt4 from PGCB__Homo_sapiens__AAG23134
auggcccagcuguuccugccccugcuggccgcccuggugcuggcccaggcccccgccgcccuggccgacgugcuggagggcgacagcagcgaggacagagccuucagagugagaaucgccggcgacgccccccugcagggcgugcugggcggcgcccugaccauccccugccacgugcacuaccugagacccccccccagcagaagagccgugcugggcagccccagagugaaguggaccuuccugagcagaggcagagaggccgaggugcugguggccagaggcgugagagugaaggugaacgaggccuacagauucagaguggcccugcccgccuaccccgccagccugaccgacgugagccuggcccugagcgagcugagacccaacgacagcggcaucuacagaugcgaggugcagcacggcaucgacgacagcagcgacgccguggaggugaaggugaagggcgugguguuccuguacagagagggcagcgccagauacgccuucagcuucagcggcgcccaggaggccugcgccagaaucggcgcccacaucgccacccccgagcagcuguacgccgccuaccugggcggcuacgagcagugcgacgccggcuggcugagcgaccagaccgugagauaccccauccagacccccagagaggccugcuacggcgacauggacggcuuccccggcgugagaaacuacggcgugguggaccccgacgaccuguacgacguguacugcuacgccgaggaccugaacggcgagcuguuccugggcgacccccccgagaagcugacccuggaggaggccagagccuacugccaggagagaggcgccgagaucgccaccaccggccagcuguacgccgccugggacggcggccuggaccacugcagccccggcuggcuggccgacggcagcgugagauaccccaucgugacccccagccagagaugcggcggcggccugcccggcgugaagacccuguuccuguuccccaaccagaccggcuuccccaacaagcacagcagauucaacguguacugcuucagagacagcgcccagcccagcgccauccccgaggccagcaaccccgccagcaaccccgccagcgacggccuggaggccaucgugaccgugaccgagacccuggaggagcugcagcugccccaggaggccaccgagagcgagagcagaggcgccaucuacagcauccccaucauggaggacggcggcggcggcagcagcacccccgaggaccccgccgaggcccccagaacccugcuggaguucgagacccagagcauggugccccccaccggcuucagcgaggaggagggcaaggcccuggaggaggaggagaaguacgaggacgaggaggagaaggaggaggaggaggaggaggaggagguggaggacgaggcccugugggccuggcccagcgagcugagcagccccggccccgaggccagccugcccaccgagcccgccgcccaggaggagagccugagccaggcccccgccagagccgugcugcagcccggcgccagcccccugcccgacggcgagagcgaggccagcagaccccccagagugcacggcccccccaccgagacccugcccacccccagagagagaaaccuggccagccccagccccagcacccugguggaggccagagaggugggcgaggccaccggcggccccgagcugagcggcgugcccagaggcgagagcgaggagaccggcagcagcgagggcgcccccagccugcugcccgccaccagagcccccgagggcaccagagagcuggaggcccccagcgaggacaacagcggcagaaccgcccccgccggcaccagcgugcaggcccagcccgugcugcccaccgacagcgccagcagaggcggcguggccguggugcccgccagcggcgacugcgugcccagccccugccacaacggcggcaccugccuggaggaggaggagggcgugagaugccugugccugcccggcuacggcggcgaccugugcgacgugggccugagauucugcaaccccggcugggacgccuuccagggcgccugcuacaagcacuucagcaccagaagaagcugggaggaggccgagacccagugcagaauguacggcgcccaccuggccagcaucagcacccccgaggagcaggacuucaucaacaacagauacagagaguaccaguggaucggccugaacgacagaaccaucgagggcgacuuccuguggagcgacggcgugccccugcuguacgagaacuggaaccccggccagcccgacagcuacuuccugagcggcgagaacugcguggugaugguguggcacgaccagggccaguggagcgacgugcccugcaacuaccaccugagcuacaccugcaagaugggccuggugagcugcggccccccccccgagcugccccuggcccagguguucggcagacccagacugagauacgagguggacaccgugcugagauacagaugcagagagggccuggcccagagaaaccugccccugaucagaugccaggagaacggcagaugggaggccccccagaucagcugcgugcccagaagacccgccagagcccugcaccccgaggaggaccccgagggcagacagggcagacugcugggcagauggaaggcccugcugaucccccccagcagccccaugcccggccccuga

SEQ ID NO: 3106 - RNA, 2736 nt, Artificial Sequence
  derived and/or modified sequence opt5 from PGCB__Homo_sapiens__AAG23134
auggcccagcuguuccucccccugcuugcugcccuggugcucgcgcaagcuccugccgcccuggcugacguccuugagggcgauagcuccgaagacagagccuuucggguucgcaucgcuggggaugccccgcugcagggagugcucggcggggcgcugaccauucccugccacgugcauuaccugagaccucccccuucucggcgcgccguccucggaagccccagagugaaguggacauuccugucccggggccgcgaggcugaaguucuuguggccagagggguccgggugaaaguuaacgaggcuuaucgcuuuagaguggcccugccugcguacccggccucucucacggacgucagccuggcucuuuccgaacugcggcccaaugauucuggaaucuaucgcugugaggugcagcacggcauugacgauagcuccgacgccguggaggucaagguuaaaggcgugguguuccucuacagagaagggagcgcucgguaugccuuuucuuucuccggagcccaggaggcuugcgcgcgcaucggcgcccauauugcuaccccugaacaacuguacgccgccuaucugggcggauacgagcagugugaugcuggcuggcucagcgaccagacagucagauaccccauccagaccccucgggaggccugcuauggggauauggacggauuucccggcgugagaaacuacggcguuguggauccggacgaccuguaugaugucuacuguuaugcggaagaccuuaauggggagcuguuccucggagauccucccgaaaagcugacacuugaggaagcucgcgccuacugccaagagcggggcgccgagaucgcuaccacagggcagcuguaugccgcuugggacggaggccucgaucacuguucuccuggguggcuggccgacggauccgugagauaccccauuguuacccccagccagcgcugcggcggcgggcugccuggagugaaaacgcucuuucuguucccgaaccagaccggcuuucccaauaagcauucucgguucaacgucuacuguuuuagagauuccgcgcaaccuagcgccauccccgaagccuccaauccugccucuaaccccgcuagcgacgggcuugaggccauugugacagucaccgaaacacuggaggaacuccagcugccgcaggaggcgaccgaguccgaaagccgcggagccaucuauucuauuccuaucauggaggauggcgggggcggauccagcacgcccgaagacccugcugaggcuccccggacacuucuggaguucgaaacccaaucuauggugccucccacaggcuucagcgaggaagaggggaaggcucucgaagaggaggaaaaauacgaggaugaagaggaaaaggaggaggaagaggaagaggaagagguugaggacgaagcccugugggccuggccguccgagcugucuagcccuggacccgaggcuucccuccccaccgaaccugcggcccaggaagagagccugucucaggcuccggccagagccgugcuucagcccggcgcuuccccucugcccgacggggagagcgaagccucucgcccuccccggguccacggaccucccaccgagacacucccgacgccuagagaacgcaaucuggcgucccccagcccuuccacccugguggaggcucgggagguuggcgaagccacagggggccccgagcuuucuggagugccgagaggcgaaagcgaggaaaccggguccucugagggagccccuagccuccugcccgcuacacgggccccugagggcacccgcgaacuggaggcgcccuccgaagauaacagcgggagaacggcucccgccggaacaucuguccaagcccagccugugcucccgaccgacuccgcuagccggggcgggguggccguuguccccgcuucuggcgauugcgugccuucccccugucacaauggagggaccugccuggaggaagaggagggggugagaugccuuugucugccuggauauggcggggaccucugcgaugucggacugcgcuuuuguaaccccggcugggacgccuuccagggggcgugcuacaaacauuuuagcacacggagaucuugggaagaggccgaaacccagugucgcauguauggcgcucaccuggccagcauuuccacaccugaggaacaagauuucaucaauaacagauaccgggaguaucaguggaucggacuuaaugaccgcacgauugagggcgauuuucucuggagcgacggggugccgcugcuguacgaaaacuggaaccccggacagccugauucuuacuuccucuccggcgagaauugcguugugauggucuggcaugaccaggggcaauggagcgaugugcccuguaacuaucaccuguccuauaccugcaagaugggacuuguuucuuguggcccucccccggaacugccucucgcucagguguuuggcagaccccggcugcgcuacgaggucgacacagugcugagauaccggugccgcgaggggcuugcccagagaaaucucccccugauccggugucaggaaaacggacgcugggaggccccucaaauuagcugcguucccagacggccugcuagagcgcugcacccggaagaggaccccgaaggccgccaggggcggcuccugggaagauggaaagcccuucugaucccucccuccucuccuaugcccggcccguga

SEQ ID NO: 3107 - protein, 1106 aa, Artificial Sequence
  PGFRB__Homo_sapiens__P09619
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 3108 - RNA, 3321 nt, Artificial Sequence
  PGFRB__Homo_sapiens__AAA60049
augcggcuuccgggugcgaugccagcucuggcccucaaaggcgagcugcuguugcugucucuccuguuacuucuggaaccacagaucucucagggccuggucgucacacccccggggccagagcuuguccucaaugucuccagcaccuucguucugaccugcucggguucagcuccgguggugugggaacggaugucccaggagcccccacaggaaauggccaaggcccaggauggcaccuucuccagcgugcucacacugaccaaccucacugggcuagacacgggagaauacuuuugcacccacaaugacucccguggacuggagaccgaugagcggaaacggcucuacaucuuugugccagaucccaccgugggcuuccucccuaaugaugccgaggaacuauucaucuuucucacggaaauaacugagaucaccauuccaugccgaguaacagacccacagcugguggugacacugcacgagaagaaaggggacguugcacugccuguccccuaugaucaccaacguggcuuuucugguaucuuugaggacagaagcuacaucugcaaaaccaccauuggggacagggagguggauucugaugccuacuaugucuacagacuccaggugucauccaucaacgucucugugaacgcagugcagacugugguccgccagggugagaacaucacccucaugugcauugugaucgggaaugagguggucaacuucgaguggacauacccccgcaaagaaagugggcggcugguggagccggugacugacuuccucuuggauaugccuuaccacauccgcuccauccugcacauccccagugccgaguuagaagacucggggaccuacaccugcaaugugacggagagugugaaugaccaucaggaugaaaaggccaucaacaucaccgugguugagagcggcuacgugcggcuccugggagaggugggcacacuacaauuugcugagcugcaucggagccggacacugcagguaguguucgaggccuacccaccgcccacuguccugugguucaaagacaaccgcacccugggcgacuccagcgcuggcgaaaucgcccuguccacgcgcaacgugucggagacccgguaugugucagagcugacacugguucgcgugaagguggcagaggcuggccacuacaccaugcgggccuuccaugaggaugcugagguccagcucuccuuccagcuacagaucaaugucccuguccgagugcuggagcuaagugagagccacccugacaguggggaacagacaguccgcugucguggccggggcaugccccagccgaacaucaucuggucugccugcagagaccucaaaagguguccacgugagcugccgcccacgcugcuggggaacaguuccgaagaggagagccagcuggagacuaacgugacguacugggaggaggagcaggaguuugagguggugagcacacugcgucugcagcacguggaucggccacugucggugcgcugcacgcugcgcaacgcugugggccaggacacgcaggaggucaucguggugccacacuccuugcccuuuaaggugguggugaucucagccauccuggcccugguggugcucaccaucaucucccuuaucauccucaucaugcuuuggcagaagaagccacguuacgagauccgauggaaggugauugagucugugagcucugacggccaugaguacaucuacguggaccccaugcagcugcccuaugacuccacgugggagcugccgcgggaccagcuugugcugggacgcacccucggcucuggggccuuugggcaggugguggaggccacggcucauggccugagccauucucaggccacgaugaaaguggccgucaagaugcuuaaauccacagcccgcagcagugagaagcaagcccuuaugucggagcugaagaucaugagucaccuugggccccaccugaacguggucaaccuguugggggccugcaccaaaggaggacccaucuauaucaucacugaguacugccgcuacggagaccugguggacuaccugcaccgcaacaaacacaccuuccugcagcaccacuccgacaagcgccgcccgcccagcgcggagcucuacagcaaugcucugcccguugggcucccccugcccagccauguguccuugaccggggagagcgacgguggcuacauggacaugagcaaggacgagucgguggacuaugugcccaugcuggacaugaaaggagacgucaaauaugcagacaucgaguccuccaacuacauggccccuuacgauaacuacguucccucugccccugagaggaccugccgagcaacuuugaucaacgagucuccagugcuaagcuacauggaccucgugggcuucagcuaccagguggccaauggcauggaguuucuggccuccaagaacugcguccacagagaccuggcggcuaggaacgugcucaucugugaaggcaagcuggucaagaucugugacuuuggccuggcucgagacaucaugcgggacucgaauuacaucuccaaaggcagcaccuuuuugccuuuaaaguggauggcuccggagagcaucuucaacagccucuacaccacccugagcgacgugugguccuucgggauccugcucugggagaucuucaccuuggguggcaccccuuacccagagcugcccaugaacgagcaguucuacaaugccaucaaacgggguuaccgcauggcccagccugcccaugccuccgacgagaucuaugagaucaugcagaagugcugggaagagaaguuugagauucggccccccuucucccagcuggugcugcuucucgagagacuguugggcgaagguuacaaaaagaaguaccagcagguggaugaggaguuucugaggagugaccacccagccauccuucggucccaggcccgcuugccuggguuccauggccuccgaucuccccuggacaccagcuccguccucuauacugccgugcagcccaaugagggugacaacgacuauaucaucccccugccugaccccaaacccgagguugcugacgagggcccacuggaggguucccccagccuagccagcuccacccugaaugaagucaacaccuccucaaccaucuccugugacagcccccuggagccccaggacgaaccagagccagagccccagcuugagcuccagguggagccggagccagagcuggaacaguugccggauucggggugcccugcgccucgggcggaagcagaggauagcuuccuguag

SEQ ID NO: 3109 - RNA, 3321 nt, Artificial Sequence
  derived and/or modified sequence opt1 from PGFRB__Homo_sapiens__AAA60049
augcgccugcccggcgccaugccggcccucgcgcugaagggggagcugcuccugcugagccuccugcugcuccuggagccccagaucucccagggccugguggucaccccgcccgggcccgagcucgugcugaacgugagcuccaccuucguccugacgugcagcggcuccgcccccguggugugggagcggaugagccaggagccgccccaggagauggccaaggcccaggacgggaccuucuccagcguccucacccugaccaaccugacgggccucgacaccggcgaguacuucugcacccacaacgacucccgcgggcuggagaccgacgagcggaagcgccuguacaucuucgugcccgaccccacggugggcuuccuccccaacgacgccgaggagcuguucaucuuccugaccgagaucaccgagaucaccauccccugccgggucacggacccgcagcucguggugacccugcacgagaagaagggggacgucgcgcugcccgugcccuacgaccaccagcgcggcuucagcgggaucuucgaggaccgguccuacaucugcaagaccaccaucggcgaccgcgagguggacagcgacgccuacuacgucuaccggcuccagguguccagcaucaacguguccgucaacgccgugcagacggugguccgccagggcgagaacaucacccugaugugcaucgugaucgggaacgagguggucaacuucgaguggaccuacccccggaaggagagcggccgccugguggagccggucaccgacuuccuccuggacaugcccuaccacauccgguccauccugcacauccccagcgccgagcucgaggacuccgggacguacacgugcaacgugaccgagagcgugaacgaccaccaggacgagaaggcgaucaacaucaccgucguggagagcggcuacgugcgccugcugggcgaggucgggacccuccaguucgccgagcugcaccggucccgcacccuccaggugguguucgaggccuacccgccgcccaccguccugugguucaaggacaaccggacccugggcgacagcuccgccggggagaucgcccugagcacgcgcaacguguccgagacccgguacgugagcgagcucacccugguccgcgugaagguggcggaggccggccacuacaccaugcgggccuuccacgaggacgccgagguccagcuguccuuccagcuccagaucaacgugcccgugcgcguccuggagcugagcgagucccaccccgacagcggggagcagacggugcgcugccggggccgcggcaugccccagcccaacaucaucugguccgccugccgggaccucaagcgcugcccccgggagcugcccccgacccugcuggggaacagcuccgaggaggagagccagcucgagaccaacgugaccuacugggaggaggagcaggaguucgaggucguguccacgcugcgccugcagcacguggaccggccccucagcguccgcugcacccugcggaacgcggugggccaggacacccaggaggugaucgucgugccccacucccugccguucaagguggucgugaucagcgccauccucgcccuggugguccugaccaucaucucccucaucauccugaucaugcuguggcagaagaagccccgcuacgagauccgguggaaggugaucgagagcgugagcuccgacgggcacgaguacaucuacgucgaccccaugcagcuccccuacgacagcaccugggagcugccgcgcgaccagcuggugcucggccggacgcugggguccggcgccuucggccagguggucgaggccaccgcgcacgggcugagccacucccaggccaccaugaagguggccgugaagaugcucaagagcaccgcccgcuccagcgagaagcaggcccugauguccgagcugaagaucaugagccaccucggcccccaccugaacgucgugaaccugcucggggcgugcacgaagggcgggcccaucuacaucaucaccgaguacugccgguacggcgaccugguggacuaccugcaccgcaacaagcacaccuuccuccagcaccacuccgacaagcggcggcccccgagcgccgagcuguacuccaacgcccugcccgucggccucccccugcccagccacgugucccugaccggggagagcgacggcggguacauggacauguccaaggacgagagcguggacuacgucccgaugcucgacaugaagggcgacgugaaguacgccgacaucgagagcuccaacuacauggcgcccuacgacaacuacgugcccagcgcccccgagcgcacgugccgcgccacccugaucaacgaguccccgguccugagcuacauggaccucgugggcuucuccuaccaggucgccaacgggauggaguuccuggccagcaagaacugcgugcaccgcgaccuggcggcccggaacgugcucaucugcgagggcaagcuggucaagaucugcgacuucgggcuggcccgcgacaucaugcgggacuccaacuacaucagcaagggcuccaccuuccucccccugaaguggauggcccccgagagcaucuucaacucccuguacaccacgcucagcgacgugugguccuucgggauccugcugugggagaucuucacccucggcggcacccccuacccggagcugcccaugaacgagcaguucuacaacgccaucaagcgcggguaccggauggcgcagcccgcccacgccagcgacgagaucuacgagaucaugcagaagugcugggaggagaaguucgagauccggcccccguucucccagcuggugcuccugcuggagcgccuccugggcgagggguacaagaagaaguaccagcaggucgacgaggaguuccugcgcagcgaccaccccgccauccuccggucccaggcccgccugcccggcuuccacgggcugcggagcccgcucgacaccuccagcgugcuguacacggcggugcagcccaacgagggcgacaacgacuacaucaucccccugcccgacccgaagcccgaggucgccgacgagggcccccucgaggggagccccucccuggccagcuccacccugaacgaggugaacaccagcuccaccaucagcugcgacuccccgcucgagccccaggacgagcccgagcccgagccgcagcuggagcuccagguggagcccgagcccgagcuggagcagcugcccgacagcggcugcccggcgccccgcgccgaggccgaggacuccuuccuguga

SEQ ID NO: 3110 - RNA, 3321 nt, Artificial Sequence
  derived and/or modified sequence opt2 from PGFRB__Homo_sapiens__AAA60049
augcgccuccccggcgccaugcccgcccucgcccucaagggcgagcuccuccuccucucccuccuccuccuccucgagccccagaucucccagggccucgucgucaccccccccggccccgagcucguccucaacgucuccuccaccuucguccucaccugcuccggcuccgcccccgucgucugggagcgcaugucccaggagcccccccaggagauggccaaggcccaggacggcaccuucuccuccguccucacccucaccaaccucaccggccucgacaccggcgaguacuucugcacccacaacgacucccgcggccucgagaccgacgagcgcaagcgccucuacaucuucguccccgaccccaccgucggcuuccuccccaacgacgccgaggagcucuucaucuuccucaccgagaucaccgagaucaccauccccugccgcgucaccgacccccagcucgucgucacccuccacgagaagaagggcgacgucgcccuccccguccccuacgaccaccagcgcggcuucuccggcaucuucgaggaccgcuccuacaucugcaagaccaccaucggcgaccgcgaggucgacuccgacgccuacuacgucuaccgccuccaggucuccuccaucaacgucuccgucaacgccguccagaccgucguccgccagggcgagaacaucacccucaugugcaucgucaucggcaacgaggucgucaacuucgaguggaccuacccccgcaaggaguccggccgccucgucgagcccgucaccgacuuccuccucgacaugcccuaccacauccgcuccauccuccacauccccuccgccgagcucgaggacuccggcaccuacaccugcaacgucaccgaguccgucaacgaccaccaggacgagaaggccaucaacaucaccgucgucgaguccggcuacguccgccuccucggcgaggucggcacccuccaguucgccgagcuccaccgcucccgcacccuccaggucgucuucgaggccuaccccccccccaccguccucugguucaaggacaaccgcacccucggcgacuccuccgccggcgagaucgcccucuccacccgcaacgucuccgagacccgcuacgucuccgagcucacccucguccgcgucaaggucgccgaggccggccacuacaccaugcgcgccuuccacgaggacgccgagguccagcucuccuuccagcuccagaucaacguccccguccgcguccucgagcucuccgagucccaccccgacuccggcgagcagaccguccgcugccgcggccgcggcaugccccagcccaacaucaucugguccgccugccgcgaccucaagcgcugcccccgcgagcucccccccacccuccucggcaacuccuccgaggaggagucccagcucgagaccaacgucaccuacugggaggaggagcaggaguucgaggucgucuccacccuccgccuccagcacgucgaccgcccccucuccguccgcugcacccuccgcaacgccgucggccaggacacccaggaggucaucgucgucccccacucccuccccuucaaggucgucgucaucuccgccauccucgcccucgucguccucaccaucaucucccucaucauccucaucaugcucuggcagaagaagccccgcuacgagauccgcuggaaggucaucgaguccgucuccuccgacggccacgaguacaucuacgucgaccccaugcagcuccccuacgacuccaccugggagcucccccgcgaccagcucguccucggccgcacccucggcuccggcgccuucggccaggucgucgaggccaccgcccacggccucucccacucccaggccaccaugaaggucgccgucaagaugcucaaguccaccgcccgcuccuccgagaagcaggcccucauguccgagcucaagaucaugucccaccucggcccccaccucaacgucgucaaccuccucggcgccugcaccaagggcggccccaucuacaucaucaccgaguacugccgcuacggcgaccucgucgacuaccuccaccgcaacaagcacaccuuccuccagcaccacuccgacaagcgccgcccccccuccgccgagcucuacuccaacgcccuccccgucggccucccccuccccucccacgucucccucaccggcgaguccgacggcggcuacauggacauguccaaggacgaguccgucgacuacguccccaugcucgacaugaagggcgacgucaaguacgccgacaucgaguccuccaacuacauggcccccuacgacaacuacguccccuccgcccccgagcgcaccugccgcgccacccucaucaacgagucccccguccucuccuacauggaccucgucggcuucuccuaccaggucgccaacggcauggaguuccucgccuccaagaacugcguccaccgcgaccucgccgcccgcaacguccucaucugcgagggcaagcucgucaagaucugcgacuucggccucgcccgcgacaucaugcgcgacuccaacuacaucuccaagggcuccaccuuccucccccucaaguggauggcccccgaguccaucuucaacucccucuacaccacccucuccgacgucugguccuucggcauccuccucugggagaucuucacccucggcggcacccccuaccccgagcuccccaugaacgagcaguucuacaacgccaucaagcgcggcuaccgcauggcccagcccgcccacgccuccgacgagaucuacgagaucaugcagaagugcugggaggagaaguucgagauccgcccccccuucucccagcucguccuccuccucgagcgccuccucggcgagggcuacaagaagaaguaccagcaggucgacgaggaguuccuccgcuccgaccaccccgccauccuccgcucccaggcccgccuccccggcuuccacggccuccgcuccccccucgacaccuccuccguccucuacaccgccguccagcccaacgagggcgacaacgacuacaucaucccccuccccgaccccaagcccgaggucgccgacgagggcccccucgagggcucccccucccucgccuccuccacccucaacgaggucaacaccuccuccaccaucuccugcgacuccccccucgagccccaggacgagcccgagcccgagccccagcucgagcuccaggucgagcccgagcccgagcucgagcagcuccccgacuccggcugccccgccccccgcgccgaggccgaggacuccuuccucuga

SEQ ID NO: 3111 - RNA, 3321 nt, Artificial Sequence
  derived and/or modified sequence opt3 from PGFRB__Homo_sapiens__AAA60049
augagacugcccggcgccaugccugcucucgcacuuaagggggagcuguuguuacugagccuacuccugcuucuggaaccacagaucucccaaggauugguggucaccccgcccgguccugagcucguucugaacgugucuucaacauucguacugacuugcaguggcagcgccccaguggucugggaaaggaugucccaggagcccccucaggaaauggcgaaagcucaggacgggacguuuucuucggugcucaccuuaacaaaucugacuggacuugauaccggcgaguacuucuguacacacaacgacucacgggguuuggagaccgaugaacgcaagcgacuguauauuuuuguuccagaccccacugugggguuccuaccuaaugaugccgaggaacucuuuauauuccugacagagaucaccgagauuacgaucccaugccgugucacugacccgcaacuugugguaacccugcaugaaaagaagggagauguugcauugcccgugccuuacgaccaccagagaggcuuuagcggcauuuucgaggauaggaguuauaucuguaaaacaacuauaggggaccgggaagucgauuccgacgccuacuauguguaccgccuccaggugucuagcaucaacgucuccguuaaugcugugcagaccguagugagacaaggagagaacauuacacugaugugcaucgucauugguaaugaagugguuaacuuugaguggaccuauccaaggaaggagucaggccgguuaguggaacccgucacggauuuccugcucgacaugccuuaccauauccgcaguauacuucacauuccaagcgcagagcuggaagacucugggacuuacacauguaaugugaccgaguccguaaacgaucaucaggacgaaaaggccaucaauauuacuguuguggagucaggauauguccgauugcuaggcgagguggguacacugcaguuugcugaacuccacagaagcaggacccugcaggucguguucgaggccuaucccccgccuacgguucuuugguuuaaagauaaccggacccugggggacaguucugcgggagaaaucgcauuguccacacguaaugugagcgagacucgcuacguaucggaacucacccuggucagagugaagguugccgaggcuggccacuacacaaugagggccuuccaugaggaugcagaagugcaauuaucuuuccagcugcagaucaacguccccgugcggguacuagagcucuccgaaucacacccagacaguggcgagcaaacugugcgaugccgcgggagaggaaugccucagcccaauauuauauggagcgcuuguagggaucugaaacggugcccacgcgagcuucccccuaccuugcuggguaacuccucugaagaggaaagccagcucgagacaaacguuaccuauugggaagaggagcaggaauuugaggucgugucaacucugagacuucaacauguggacaggccacugaguguccguuguacguugcggaaugccguuggccaggauacacaggaagugaucgugguaccgcacucccuccccuucaaggucgugguuauuagcgcgauccuggccuuagugguccugaccauaauuucucuaaucauccucauuaugcuguggcagaaaaagccucgauacgagaucagauggaaggugauugaaucaguuaguagcgacgggcacgaguauauauacguggauccaaugcaacuucccuacgacuccacuugggaguugccuagggaccagcugguacucggacgcacccugggcucuggugcauuugggcaggucguggaagcuacagcccauggcuuaucgcacagccaggcuaccaugaaaguggccgucaagaugcugaaauccacugcacggucaagugagaagcaagcccuuaugucugaauugaaaaucaugagccaucucggaccacaccugaacguugugaaucuacugggcgcuugcacaaaagggggacccauuuauaucaucacggaguacuguagauauggugaucucguagacuaccugcauaggaacaaacacaccuuccuucagcaccauuccgauaagcgccgaccgccuucagcggaauuguauagcaaugcacugccagugggcuuaccccucccuucucacgucucccugacuggggagagugacggaggcuacauggauaugagcaaggacgagucuguggauuauguucccaugcuugacaugaaaggugaugugaaguacgccgacauugaauccucaaacuacauggcuccauaugauaauuacgucccuagugcccccgagcggacaugccgugcaacccugauaaacgaaagcccaguguugucguauauggaccucguuggguuuuccuaccagguggccaauggcauggaguuccuggcuucuaaaaacugcguccauagagaucuagccgcaaggaauguacugaucugugagggaaagcucgugaaaauuugcgacuuuggccuggcgcgcgacaucaugcgggauagcaacuauauuucaaaggggaguacauuccuuccguugaaguggauggcuccugaauccaucuuuaauucucuguacacuaccuuaagcgacguuugguccuucggaauacuccugugggagaucuuuacgcuugguggcacccccuauccagaacugcccaugaacgagcaguucuacaaugccauuaaaagaggguacaggauggcacaaccugcccacgcuucagaugaaaucuaugagauuaugcagaaguguugggaggaaaaauuugagauccgaccacccuucagccagcuagugcuccuguuggaacgccuguuaggagagggcuacaagaaaaaguaucaacaggucgacgaagaguuccuccggagugaucacccugccauacugagaucucaggcaaggcuuccggguuuucaugggcugcguuccccauuggacacaagcucggugcucuacacugcuguacagcccaacgagggcgauaacgacuauauuaucccucugccagaucccaagccugaaguggccgacgagggaccgcuagaaggcucacccucucuggcgaguuccacccuuaaugaggucaacacaagcucuacuauuagcugcgauuccccacucgaaccucaagacgagcccgagccagaaccucagcuggaguugcagguugaacccgagccagagcuggaacaguuaccggauucaggguguccugcuccccgcgccgaggcagaagacaguuuccucuga

SEQ ID NO: 3112 - RNA, 3321 nt, Artificial Sequence
  derived and/or modified sequence opt4 from PGFRB__Homo_sapiens__AAA60049
augagacugcccggcgccaugcccgcccuggcccugaagggcgagcugcugcugcugagccugcugcugcugcuggagccccagaucagccagggccugguggugaccccccccggccccgagcuggugcugaacgugagcagcaccuucgugcugaccugcagcggcagcgcccccguggugugggagagaaugagccaggagcccccccaggagauggccaaggcccaggacggcaccuucagcagcgugcugacccugaccaaccugaccggccuggacaccggcgaguacuucugcacccacaacgacagcagaggccuggagaccgacgagagaaagagacuguacaucuucgugcccgaccccaccgugggcuuccugcccaacgacgccgaggagcuguucaucuuccugaccgagaucaccgagaucaccauccccugcagagugaccgacccccagcugguggugacccugcacgagaagaagggcgacguggcccugcccgugcccuacgaccaccagagaggcuucagcggcaucuucgaggacagaagcuacaucugcaagaccaccaucggcgacagagagguggacagcgacgccuacuacguguacagacugcaggugagcagcaucaacgugagcgugaacgccgugcagaccguggugagacagggcgagaacaucacccugaugugcaucgugaucggcaacgagguggugaacuucgaguggaccuaccccagaaaggagagcggcagacugguggagcccgugaccgacuuccugcuggacaugcccuaccacaucagaagcauccugcacauccccagcgccgagcuggaggacagcggcaccuacaccugcaacgugaccgagagcgugaacgaccaccaggacgagaaggccaucaacaucaccgugguggagagcggcuacgugagacugcugggcgaggugggcacccugcaguucgccgagcugcacagaagcagaacccugcaggugguguucgaggccuaccccccccccaccgugcugugguucaaggacaacagaacccugggcgacagcagcgccggcgagaucgcccugagcaccagaaacgugagcgagaccagauacgugagcgagcugacccuggugagagugaagguggccgaggccggccacuacaccaugagagccuuccacgaggacgccgaggugcagcugagcuuccagcugcagaucaacgugcccgugagagugcuggagcugagcgagagccaccccgacagcggcgagcagaccgugagaugcagaggcagaggcaugccccagcccaacaucaucuggagcgccugcagagaccugaagagaugccccagagagcugccccccacccugcugggcaacagcagcgaggaggagagccagcuggagaccaacgugaccuacugggaggaggagcaggaguucgagguggugagcacccugagacugcagcacguggacagaccccugagcgugagaugcacccugagaaacgccgugggccaggacacccaggaggugaucguggugccccacagccugcccuucaaggugguggugaucagcgccauccuggcccugguggugcugaccaucaucagccugaucauccugaucaugcuguggcagaagaagcccagauacgagaucagauggaaggugaucgagagcgugagcagcgacggccacgaguacaucuacguggaccccaugcagcugcccuacgacagcaccugggagcugcccagagaccagcuggugcugggcagaacccugggcagcggcgccuucggccaggugguggaggccaccgcccacggccugagccacagccaggccaccaugaagguggccgugaagaugcugaagagcaccgccagaagcagcgagaagcaggcccugaugagcgagcugaagaucaugagccaccugggcccccaccugaacguggugaaccugcugggcgccugcaccaagggcggccccaucuacaucaucaccgaguacugcagauacggcgaccugguggacuaccugcacagaaacaagcacaccuuccugcagcaccacagcgacaagagaagaccccccagcgccgagcuguacagcaacgcccugcccgugggccugccccugcccagccacgugagccugaccggcgagagcgacggcggcuacauggacaugagcaaggacgagagcguggacuacgugcccaugcuggacaugaagggcgacgugaaguacgccgacaucgagagcagcaacuacauggcccccuacgacaacuacgugcccagcgcccccgagagaaccugcagagccacccugaucaacgagagccccgugcugagcuacauggaccuggugggcuucagcuaccagguggccaacggcauggaguuccuggccagcaagaacugcgugcacagagaccuggccgccagaaacgugcugaucugcgagggcaagcuggugaagaucugcgacuucggccuggccagagacaucaugagagacagcaacuacaucagcaagggcagcaccuuccugccccugaaguggauggcccccgagagcaucuucaacagccuguacaccacccugagcgacguguggagcuucggcauccugcugugggagaucuucacccugggcggcacccccuaccccgagcugcccaugaacgagcaguucuacaacgccaucaagagaggcuacagaauggcccagcccgcccacgccagcgacgagaucuacgagaucaugcagaagugcugggaggagaaguucgagaucagaccccccuucagccagcuggugcugcugcuggagagacugcugggcgagggcuacaagaagaaguaccagcagguggacgaggaguuccugagaagcgaccaccccgccauccugagaagccaggccagacugcccggcuuccacggccugagaagcccccuggacaccagcagcgugcuguacaccgccgugcagcccaacgagggcgacaacgacuacaucaucccccugcccgaccccaagcccgagguggccgacgagggcccccuggagggcagccccagccuggccagcagcacccugaacgaggugaacaccagcagcaccaucagcugcgacagcccccuggagccccaggacgagcccgagcccgagccccagcuggagcugcagguggagcccgagcccgagcuggagcagcugcccgacagcggcugccccgcccccagagccgaggccgaggacagcuuccuguga

SEQ ID NO: 3113 - RNA, 3321 nt, Artificial Sequence
  derived and/or modified sequence opt5 from PGFRB__Homo_sapiens__AAA60049
augagacugcccggcgccaugccugcucucgcccugaagggggagcuucugcuccugagccuucugcuccugcuggaaccgcagaucucccaaggacucguggucacacccccuggccccgagcugguucuuaacgugucuagcaccuucgugcugacgugcuccgggucugcgccugucgugugggaacggaugagccaggagcccccucaggaaauggcuaaagcccaggacggaaccuuuuccucuguucucacacugaccaaucuuacaggccuggauaccggggaguacuucuguacacacaacgacagccgcggacucgagaccgaugaaagaaagcggcuguauauuuuugugccggaccccacggucggcuuccugccuaaugaugccgaggaacucuuuaucuuccugaccgagauuacagagaucaccauucccugccgcgugacagacccucaacuuguugugacccugcaugaaaagaagggcgaugucgcucuccccgugccguacgaccaccagagaggguuuuccggaaucuucgaggaucggagcuauaucuguaaaacgacaauuggcgaccgcgaaguggauucugacgccuacuaugucuacagacugcagguuuccagcaucaacgugucugugaaugcuguccagaccgugguucggcaaggggagaacauuacacuuaugugcaucgugauuggaaaugaagucgugaacuuugaguggaccuauccucgcaaggaguccggcagacugguugaacccgugaccgauuuccuccuggacaugccuuaccauauccggagcauucugcacauccccucugccgagcucgaagacuccgggacauacacguguaaugucaccgagagcgugaacgaucaucaggacgaaaaggcgaucaauauuacagucguggaguccggauauguucgccugcuuggcgaggugggcacccugcaguuugccgaacuccacagaucucggacacugcaggucguguucgaggcuuaucccccuccgaccguucuuugguuuaaagauaaccgcacgcugggggacagcuccgccggagaaaucgcucucagcacaagaaaugugucugagacccgguacgucuccgaacugacccuggugagagugaagguugccgaggcgggccacuacacaaugcgcgccuuccaugaggaugcugaaguccaacucagcuuccagcugcagauuaacgugcccgugcggguccuugagcugucugaaagccacccugacuccggggagcaaaccgugagaugccgcggacggggcaugccccagccuaauaucauuuggucugccuguagagaucucaaacgcugcccccgggagcugccgccuacacugcuugggaacagcuccgaagaggaaagccagcucgagacgaacguuaccuauugggaagaggagcaggaauuugagguggucucuacacugagacugcaacauguggaccgcccccucuccguucgguguacccugagaaaugcugugggacaggauacacaggaagucaucgugguuccucacagccuucccuucaagguggucgugaucucugccauucuggcccucgugguccugaccaucauuucccugaucauucuuaucaugcucuggcagaaaaagccucgcuacgagauccgguggaagguuauugaaagcguguccucugacggccacgaguauaucuacguggaucccaugcaacugccguacgacagcacgugggagcugccuagagaccagcucguccugggccggacccuuggguccggagcuuuuggccaggugguugaagcgacagcccaugggcugucucacagccaggcuaccaugaaaguggccgucaagaugcucaaauccacagcccgcagcucugagaagcaagcucugauguccgaacugaaaauuaugagccaucuuggaccccaccucaacgugguuaaucugcugggcgccugcaccaaagggggccccaucuauauuaucacggaguacuguagauauggagaucucguggacuaccugcaucggaacaaacacacauuccuucagcaccauucugauaagagacgcccuccguccgcggaacuguauagcaaugcucuccccgucggccugccucugcccucucacgugagccuuaccggggaguccgacggaggcuacauggauaugagcaaggacgagucuguugauuaugugccuaugcucgacaugaaaggggaugucaaguacgccgacauugaauccagcaacuacauggcccccuaugauaauuacgugccuuccgcucccgagcggacaugcagagccacccugaucaacgaaucuccggugcugagcuauauggaccucgucggauuuuccuaccagguugcuaauggcauggaguuccuggccucuaaaaacugcgugcaucgcgaucuugcggccagaaaugugcugaucugugaggggaagcucgucaaaauuugcgacuuuggccuggcucgggacaucaugcgcgauagcaacuauauuuccaagggaucuaccuuccugccucuuaaguggauggcccccgaaagcaucuuuaauucccuguacacaacgcucagcgacguguggucuuucggcauucugcucugggagaucuuuacccuugggggaacaccuuaucccgaacugccgaugaacgagcaguucuacaaugcuaucaaaagaggcuaccggauggcccaaccugcgcacgccuccgaugaaauuuaugagaucaugcagaaguguugggaggaaaaauuugagauuagacccccuuucagccagcugguucuccugcuggaacgccuucugggggagggauacaagaaaaaguaucaacagguggacgaagaguuccuccggucugaucaccccgcuauccugcgcucccaggccagacuccccggcuuucaugggcugcggagcccucuugacaccucuuccguccuguacacagcugugcagccgaacgagggcgauaacgacuauauuaucccccucccugaucccaagccugaaguugccgacgagggaccccuggaaggcagcccuucccuggccagcucuacccuuaaugaggugaacacgagcuccacaaucucuugcgauagcccgcuggaaccccaagacgagccugagcccgaaccucagcucgagcugcaggucgaacccgagccggagcucgaacagcugccugauuccgggugucccgcuccccgcgcggaggccgaagacucuuuccuuuga

SEQ ID NO: 3114 - protein, 313 aa, Artificial Sequence
  Pim-1_-Kinase__Homo_sapiens__A0A024RD25
MLLSKINSLAHLRAAPCNDLHATKLAPGKEKEPLESQYQVGPLLGSGGFGSVYSGIRVSDNLPVAIKHVEKDRISDWGELPNGTRVPMEVVLLKKVSSGFSGVIRLLDWFERPDSFVLILERPEPVQDLFDFITERGALQEELARSFFWQVLEAVRHCHNCGVLHRDIKDENILIDLNRGELKLIDFGSGALLKDTVYTDFDGTRVYSPPEWIRYHRYHGRSAAVWSLGILLYDMVCGDIPFEHDEEIIRGQVFFRQRVSSECQHLIRWCLALRPSDRPTFEEIQNHPWMQDVLLPQETAEIHLHSLSPGPSK

SEQ ID NO: 3115 - RNA, 942 nt, Artificial Sequence
  Pim-1_-Kinase__Homo_sapiens__EAX03935
augcucuuguccaaaaucaacucgcuugcccaccugcgcgccgcgcccugcaacgaccugcacgccaccaagcuggcgcccggcaaggagaaggagccccuggagucgcaguaccaggugggcccgcuacugggcagcggcggcuucggcucggucuacucaggcauccgcgucuccgacaacuugccgguggccaucaaacacguggagaaggaccggauuuccgacuggggagagcugccuaauggcacucgagugcccauggaagugguccugcugaagaaggugagcucggguuucuccggcgucauuaggcuccuggacugguucgagaggcccgacaguuucguccugauccuggagaggcccgagccggugcaagaucucuucgacuucaucacggaaaggggagcccugcaagaggagcuggcccgcagcuucuucuggcaggugcuggaggccgugcggcacugccacaacugcggggugcuccaccgcgacaucaaggacgaaaacauccuuaucgaccucaaucgcggcgagcucaagcucaucgacuucgggucgggggcgcugcucaaggacaccgucuacacggacuucgaugggacccgaguguauagcccuccagaguggauccgcuaccaucgcuaccauggcaggucggcggcagucuggucccuggggauccugcuguaugauaugguguguggagauauuccuuucgagcaugacgaagagaucaucaggggccagguuuucuucaggcagagggucucuucagaaugucagcaucucauuagauggugcuuggcccugagaccaucagauaggccaaccuucgaagaaauccagaaccauccauggaugcaagauguucuccugccccaggaaacugcugagauccaccuccacagccugucgccggggcccagcaaauag

SEQ ID NO: 3116 - RNA, 942 nt, Artificial Sequence
  derived and/or modified sequence opt1 from Pim-1_-Kinase__Homo_sapiens__EAX03935
augcugcucagcaagaucaacucccuggcccaccuccgcgccgcgcccugcaacgaccugcacgccaccaagcuggccccgggcaaggagaaggagccccuggagagccaguaccagguggggccccuccugggcuccgggggcuucgggagcgucuacuccggcauccgggugagcgacaaccugcccguggccaucaagcacgucgagaaggaccgcaucuccgacuggggcgagcucccgaacgggacccgggugcccauggaggugguccugcugaagaaggugagcuccggcuucagcggggugauccgccuccuggacugguucgagcggcccgacuccuucguccugauccucgagcgccccgagccggugcaggaccuguucgacuucaucacggagcggggcgcccugcaggaggagcucgcgcgcagcuucuucuggcagguccuggaggccgugcggcacugccacaacugcggggugcugcaccgcgacaucaaggacgagaacauccucaucgaccugaaccggggcgagcugaagcucaucgacuucggcuccggggcccugcugaaggacaccguguacaccgacuucgacggcacccgcgucuacagcccgcccgaguggauccgguaccaccgcuaccacgggcgguccgccgcgguguggagccucggcauccugcuguacgacauggugugcggcgacauccccuucgagcacgacgaggagaucauccgcgggcaggucuucuuccggcagcgcguguccagcgagugccagcaccucauccgguggugccuggcccugcgccccuccgaccggcccacguucgaggagauccagaaccaccccuggaugcaggacgugcuccugccccaggagaccgccgagauccaccuccacagccugagcccgggccccuccaaguga

SEQ ID NO: 3117 - RNA, 942 nt, Artificial Sequence
  derived and/or modified sequence opt2 from Pim-1_-Kinase__Homo_sapiens__EAX03935
augcuccucuccaagaucaacucccucgcccaccuccgcgccgcccccugcaacgaccuccacgccaccaagcucgcccccggcaaggagaaggagccccucgagucccaguaccaggucggcccccuccucggcuccggcggcuucggcuccgucuacuccggcauccgcgucuccgacaaccuccccgucgccaucaagcacgucgagaaggaccgcaucuccgacuggggcgagcuccccaacggcacccgcguccccauggaggucguccuccucaagaaggucuccuccggcuucuccggcgucauccgccuccucgacugguucgagcgccccgacuccuucguccucauccucgagcgccccgagcccguccaggaccucuucgacuucaucaccgagcgcggcgcccuccaggaggagcucgcccgcuccuucuucuggcagguccucgaggccguccgccacugccacaacugcggcguccuccaccgcgacaucaaggacgagaacauccucaucgaccucaaccgcggcgagcucaagcucaucgacuucggcuccggcgcccuccucaaggacaccgucuacaccgacuucgacggcacccgcgucuacuccccccccgaguggauccgcuaccaccgcuaccacggccgcuccgccgccgucuggucccucggcauccuccucuacgacauggucugcggcgacauccccuucgagcacgacgaggagaucauccgcggccaggucuucuuccgccagcgcgucuccuccgagugccagcaccucauccgcuggugccucgcccuccgccccuccgaccgccccaccuucgaggagauccagaaccaccccuggaugcaggacguccuccucccccaggagaccgccgagauccaccuccacucccucucccccggccccuccaaguga

SEQ ID NO: 3118 - RNA, 942 nt, Artificial Sequence
  derived and/or modified sequence opt3 from Pim-1_-Kinase__Homo_sapiens__EAX03935
augcugcucagcaagaucaacucccuugcccaccugagagcugcacccugcaaugacuugcaugccaccaaauuagcgccuggcaaggagaaagaaccacuggagucucaguaccaaguggggccgcuacucggaucagguggcuucgggagugucuauagcggaauuaggguuuccgauaaccugcccguggcuauaaagcacguagaaaaagaccggaucucugauuggggcgagcuuccuaaugguacacgcgugccaauggaagucgugcuguugaagaagguuucgucaggguuuagcggagugauucgacuccuggacugguucgagcgucccgauaguuuuguccugauccucgagagaccugaaccagugcaggacuuauucgauuuuauuacugagaggggcgcccugcaggaggaacuugcacgguccuucuuuuggcagguauuggaggccguucgccauugucacaacugcggcgugcugcauagagacaucaaagaugaaaauauacuaaucgaccucaacaggggagagcugaaacuuauugauuucggaucuggugcucuguugaaggacacggucuacaccgauuuugacggcacacggguguauagcccucccgaauggauccgcuaccaccgauaucacgggagauccgcagccguguggucacucgggauucuguuauacgacauggucuguggcgauaucccauucgagcaugacgaagagauaauuaggggucaaguguuuuuccggcagcguguuaguagcgagugccagcaccugauccgcuggugucucgcucuuagaccgucugauaggcccacuuuugaagagauucagaaucauccuuggaugcaagacguacuguugccacaggaaaccgccgagauccaccuacacucccugucacccgggccuagcaaguga

SEQ ID NO: 3119 - RNA, 942 nt, Artificial Sequence
  derived and/or modified sequence opt4 from Pim-1_-Kinase__Homo_sapiens__EAX03935
augcugcugagcaagaucaacagccuggcccaccugagagccgcccccugcaacgaccugcacgccaccaagcuggcccccggcaaggagaaggagccccuggagagccaguaccaggugggcccccugcugggcagcggcggcuucggcagcguguacagcggcaucagagugagcgacaaccugcccguggccaucaagcacguggagaaggacagaaucagcgacuggggcgagcugcccaacggcaccagagugcccauggagguggugcugcugaagaaggugagcagcggcuucagcggcgugaucagacugcuggacugguucgagagacccgacagcuucgugcugauccuggagagacccgagcccgugcaggaccuguucgacuucaucaccgagagaggcgcccugcaggaggagcuggccagaagcuucuucuggcaggugcuggaggccgugagacacugccacaacugcggcgugcugcacagagacaucaaggacgagaacauccugaucgaccugaacagaggcgagcugaagcugaucgacuucggcagcggcgcccugcugaaggacaccguguacaccgacuucgacggcaccagaguguacagcccccccgaguggaucagauaccacagauaccacggcagaagcgccgccguguggagccugggcauccugcuguacgacauggugugcggcgacauccccuucgagcacgacgaggagaucaucagaggccagguguucuucagacagagagugagcagcgagugccagcaccugaucagauggugccuggcccugagacccagcgacagacccaccuucgaggagauccagaaccaccccuggaugcaggacgugcugcugccccaggagaccgccgagauccaccugcacagccugagccccggccccagcaaguga

SEQ ID NO: 3120 - RNA, 942 nt, Artificial Sequence
  derived and/or modified sequence opt5 from Pim-1_-Kinase__Homo_sapiens__EAX03935
augcugcucagcaagaucaacucccuggcccaccuuagagcugcccccugcaaugaccugcaugcgaccaaacucgcuccuggcaaggagaaagaaccgcuggagucucaguaccaaguggggccccuucugggaagcggcggguucggauccgucuauucuggcauucggguuagcgauaaccucccuguggccaucaagcacguggaaaaagaccgcauuuccgauuggggagagcugcccaauggaacaagagucccuauggaagugguucugcucaagaaggugucuagcggcuuuuccggcgucauccggcugcuugacugguucgagcgccccgauagcuuugugcugauucucgagagaccugaaccgguucaggaccuguucgauuuuaucacggagcgcggggcccuucaggaggaacuggcucggucuuucuuuuggcaagugcucgaggccgucagacauugucacaacugcggagugcugcaucgggacaucaaagaugaaaauauucugaucgaccucaaccgcggcgagcugaaacuuauugauuucggguccggagcucugcucaaggacaccguguacacagauuuugacggcaccagagucuauucucccccugaauggauccgguaccaccgcuaucacgggagaagcgccgcgguuuggucccuggggauucuucuguacgacaugguguguggcgauauccccuucgagcaugacgaagagauuauccggggccagguguuuuuccgccagagagucagcucugagugccagcaccucauccgguggugucuggcccugagaccuuccgaucgccccacauuugaagagauucagaaucauccguggaugcaagacgugcuccugccucaggaaaccgcugagauccaccuucacagccugucccccgggccuucuaaguga

SEQ ID NO: 3121 - protein, 100 aa, Artificial Sequence
  Pin-1__Homo_sapiens__O15428
MADEEKLPPGWEKRMSRPSGRGYYFNHITNPSQWERPSGNSSSGGKIWQGEPARVRRSHLLVKPVKAALDLAAGNHPDQGGGPGADQRLHPEDQGRREGL

SEQ ID NO: 3122 - RNA, 303 nt, Artificial Sequence
  Pin-1__Homo_sapiens__AAB81333
auggcggacgaggagaaacugccgccuggcugggaaaagcgcaugagccgccccucaggccgaggguacuacuucaaccacaucacuaaccccagccagugggagcggcccagcgggaacagcagcaguggcggcaaaaucuggcagggggagcccgccaggguccgccgcucgcaccugcuagugaagccagucaaggcggcccucgaccuggcggcaggaaaucacccggaccaaggaggaggcccuggagcugaucagcggcuacauccagaagaucaaggcaggagagaaggacuuuga

SEQ ID NO: 3123 - RNA, 303 nt, Artificial Sequence
  derived and/or modified sequence opt1 from Pin-1__Homo_sapiens__AAB81333
auggccgacgaggagaagcugcccccgggcugggagaagcgcaugagccggcccuccgggcgcggcuacuacuucaaccacaucaccaaccccagccagugggagcggcccuccgggaacagcuccagcggcgggaagaucuggcagggcgagccggcccgcgugcggcgcucccaccuccuggucaagcccgugaaggcggcccuggaccucgccgccggcaaccaccccgaccagggcggcgggcccggggccgaccagcggcugcacccggaggaccaggggcgccgggagggccuguga

SEQ ID NO: 3124 - RNA, 303 nt, Artificial Sequence
  derived and/or modified sequence opt2 from Pin-1__Homo_sapiens__AAB81333
auggccgacgaggagaagcucccccccggcugggagaagcgcaugucccgccccuccggccgcggcuacuacuucaaccacaucaccaaccccucccagugggagcgccccuccggcaacuccuccuccggcggcaagaucuggcagggcgagcccgcccgcguccgccgcucccaccuccucgucaagcccgucaaggccgcccucgaccucgccgccggcaaccaccccgaccagggcggcggccccggcgccgaccagcgccuccaccccgaggaccagggccgccgcgagggccucuga

SEQ ID NO: 3125 - RNA, 303 nt, Artificial Sequence
  derived and/or modified sequence opt3 from Pin-1__Homo_sapiens__AAB81333
auggccgacgaggaaaagcugcccccuggcugggagaaaagaaugagcaggccauccgggcggggauacuauuucaaccacaucaccaauccgucucagugggaacgccccucagguaacaguagcuccggcgggaagauuuggcaaggagagccugcucgagugcguagaucucaucuccuugucaaaccaguuaaggcagcccuggauuuggcggcuggcaaucaccccgaccagggugggggaccuggcgccgaucagagguuacauccagaagaccagggccggcgcgaggggcuguga

SEQ ID NO: 3126 - RNA, 303 nt, Artificial Sequence
  derived and/or modified sequence opt4 from Pin-1__Homo_sapiens__AAB81333
auggccgacgaggagaagcugccccccggcugggagaagagaaugagcagacccagcggcagaggcuacuacuucaaccacaucaccaaccccagccagugggagagacccagcggcaacagcagcagcggcggcaagaucuggcagggcgagcccgccagagugagaagaagccaccugcuggugaagcccgugaaggccgcccuggaccuggccgccggcaaccaccccgaccagggcggcggccccggcgccgaccagagacugcaccccgaggaccagggcagaagagagggccuguga

SEQ ID NO: 3127 - RNA, 303 nt, Artificial Sequence
  derived and/or modified sequence opt5 from Pin-1__Homo_sapiens__AAB81333
auggccgacgaggaaaagcugcccccuggcugggagaaaagaaugagccggccguccgggcgcggauacuauuucaaccacaucaccaaucccucucagugggaaagaccuagcggcaacuccucuagcgggggaaagauuuggcaaggcgagcccgcucgggugcgcagaucccaucuccuggucaaaccuguuaaggccgcgcuugaucuggcugccgggaaucaccccgaccagggaggcggcccuggggccgaucagcggcuccauccggaagaccagggacgcagagagggccuguga

SEQ ID NO: 3128 - protein, 163 aa, Artificial Sequence
  Pin-1__Homo_sapiens__Q13526
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 3129 - RNA, 492 nt, Artificial Sequence
  Pin-1__Homo_sapiens__AAC50492
auggcggacgaggagaagcugccgcccggcugggagaagcgcaugagccgcagcucaggccgaguguacuacuucaaccacaucacuaacgccagccagugggagcggcccagcggcaacagcagcagugguggcaaaaacgggcagggggagccugccaggguccgcugcucgcaccugcuggugaagcacagccagucacggcggcccucguccuggcggcaggagaagaucacccggaccaaggaggaggcccuggagcugaucaacggcuacauccagaagaucaagucgggagaggaggacuuugagucucuggccucacaguucagcgacugcagcucagccaaggccaggggagaccugggugccuucagcagaggucagaugcagaagccauuugaagacgccucguuugcgcugcggacgggggagaugagcgggcccguguucacggauuccggcauccacaucauccuccgcacugaguga

SEQ ID NO: 3130 - RNA, 492 nt, Artificial Sequence
  derived and/or modified sequence opt1 from Pin-1__Homo_sapiens__AAC50492
auggccgacgaggagaagcugcccccgggcugggagaagcgcaugagccgguccagcgggcgcguguacuacuucaaccacaucaccaacgccucccagugggagcggcccagcggcaacuccagcuccgggggcaagaacgggcagggcgagcccgcgcgcguccggugcagccaccuccuggugaagcacucccagagccgccggcccuccagcuggcgccaggagaagaucacccggacgaaggaggaggcccuggagcucaucaacggcuacauccagaagaucaaguccggggaggaggacuucgagagccuggccucccaguucagcgacugcuccagcgccaaggcccgcggcgaccugggggcguucucccggggccagaugcagaagccguucgaggacgccagcuucgcccuccgcaccggggagaugagcggccccguguucaccgacuccggcauccacaucauccugcggaccgaguga

SEQ ID NO: 3131 - RNA, 492 nt, Artificial Sequence
  derived and/or modified sequence opt2 from Pin-1__Homo_sapiens__AAC50492
auggccgacgaggagaagcucccccccggcugggagaagcgcaugucccgcuccuccggccgcgucuacuacuucaaccacaucaccaacgccucccagugggagcgccccuccggcaacuccuccuccggcggcaagaacggccagggcgagcccgcccgcguccgcugcucccaccuccucgucaagcacucccagucccgccgccccuccuccuggcgccaggagaagaucacccgcaccaaggaggaggcccucgagcucaucaacggcuacauccagaagaucaaguccggcgaggaggacuucgagucccucgccucccaguucuccgacugcuccuccgccaaggcccgcggcgaccucggcgccuucucccgcggccagaugcagaagcccuucgaggacgccuccuucgcccuccgcaccggcgagauguccggccccgucuucaccgacuccggcauccacaucauccuccgcaccgaguga

SEQ ID NO: 3132 - RNA, 492 nt, Artificial Sequence
  derived and/or modified sequence opt3 from Pin-1__Homo_sapiens__AAC50492
auggccgacgaggaaaagcugcccccuggcugggagaaaagaaugagcagguccucugggcggguguacuauuucaaccacaucaccaaugcuucacagugggaacgcccaaguggaaacagcuccucugguggcaagaaugggcaaggagagccggcacgaguccguugcucgcaucuccuuguuaaacacucacagagcagaaggcccaguuccuggcggcaggaaaagauuacacgcacuaaagaggaggcccuggaauugauaaacggcuacauccagaagauuaagucuggugaggaagauuuugagagcuuagcgucccaauucucagacuguaguagcgcuaaagccagaggggaucugggagcauuuucuaggggccagaugcagaagccuuucgaggacgccuccuuugcucuacggacgggcgaaaugucagggccaguguucaccgauagcggaauccauauuauccuccgcacagaguga

SEQ ID NO: 3133 - RNA, 492 nt, Artificial Sequence
  derived and/or modified sequence opt4 from Pin-1__Homo_sapiens__AAC50492
auggccgacgaggagaagcugccccccggcugggagaagagaaugagcagaagcagcggcagaguguacuacuucaaccacaucaccaacgccagccagugggagagacccagcggcaacagcagcagcggcggcaagaacggccagggcgagcccgccagagugagaugcagccaccugcuggugaagcacagccagagcagaagacccagcagcuggagacaggagaagaucaccagaaccaaggaggaggcccuggagcugaucaacggcuacauccagaagaucaagagcggcgaggaggacuucgagagccuggccagccaguucagcgacugcagcagcgccaaggccagaggcgaccugggcgccuucagcagaggccagaugcagaagcccuucgaggacgccagcuucgcccugagaaccggcgagaugagcggccccguguucaccgacagcggcauccacaucauccugagaaccgaguga

SEQ ID NO: 3134 - RNA, 492 nt, Artificial Sequence
  derived and/or modified sequence opt5 from Pin-1__Homo_sapiens__AAC50492
auggccgacgaggaaaagcugcccccuggcugggagaaaagaaugagccgguccucugggcgcguguacuauuucaaccacaucaccaaugcuagccagugggaaagaccguccggaaacucuagcuccggcgggaagaauggacaaggcgagcccgcccggguccgcugcucucaucuccugguuaaacacagccaguccagacggccuagcucuuggcgccaggaaaagauuacaagaacgaaagaggaggcgcuugaacugaucaacggguacauucagaagaucaaguccggagaggaagauuuugagagccucgcuucucaauucuccgacuguagcucugccaaagcccggggcgaucugggcgcuuuuucccgcgggcagaugcagaagcccuucgaggacgccagcuuugcucuuagaaccggagaaauguccggcccuguguucacagauucugggauucauaucauccugcggaccgaguga

SEQ ID NO: 3135 - protein, 45 aa, Artificial Sequence
  Pin-1__Homo_sapiens__Q49AR7
MQKPFEDASFALRTGEMSGPVFTDSGIHIILRTECWRQTRGPNCF

SEQ ID NO: 3136 - RNA, 138 nt, Artificial Sequence
  Pin-1__Homo_sapiens__AAH31971
augcagaagccauuugaagacgccucguuugcgcugcggacgggggagaugagcgggcccguguucacggauuccggcauccacaucauccuccgcacugagugcuggaggcagacucgagggccgaauuguuucuag

SEQ ID NO: 3137 - RNA, 138 nt, Artificial Sequence
  derived and/or modified sequence opt1 from Pin-1__Homo_sapiens__AAH31971
augcagaagcccuucgaggacgccagcuucgcccugcgcaccggcgagauguccgggccgguguucaccgacagcggcauccacaucauccuccggacggagugcuggcgccagacccgggggcccaacugcuucuga

SEQ ID NO: 3138 - RNA, 138 nt, Artificial Sequence
  derived and/or modified sequence opt2 from Pin-1__Homo_sapiens__AAH31971
augcagaagcccuucgaggacgccuccuucgcccuccgcaccggcgagauguccggccccgucuucaccgacuccggcauccacaucauccuccgcaccgagugcuggcgccagacccgcggccccaacugcuucuga

SEQ ID NO: 3139 - RNA, 138 nt, Artificial Sequence
  derived and/or modified sequence opt3 from Pin-1__Homo_sapiens__AAH31971
augcagaagcccuucgaggacgccagcuuugcucugagaaccggcgaaauguccgggccuguguucacagauucuggaauccacauuauacucaggacugagugcuggcggcaaacgcgcgguccaaacuguuuuuga

SEQ ID NO: 3140 - RNA, 138 nt, Artificial Sequence
  derived and/or modified sequence opt4 from Pin-1__Homo_sapiens__AAH31971
augcagaagcccuucgaggacgccagcuucgcccugagaaccggcgagaugagcggccccguguucaccgacagcggcauccacaucauccugagaaccgagugcuggagacagaccagaggccccaacugcuucuga

SEQ ID NO: 3141 - RNA, 138 nt, Artificial Sequence
  derived and/or modified sequence opt5 from Pin-1__Homo_sapiens__AAH31971
augcagaagcccuucgaggacgccagcuuugcucugagaaccggcgaaauguccgggccuguguucacagauucuggaauccacauuauccuccggacggagugcuggcgccaaaccagaggcccgaacuguuuuuga

SEQ ID NO: 3142 - protein, 212 aa, Artificial Sequence
  PLAC1__Homo_sapiens__Q9HBJ0
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 3143 - RNA, 639 nt, Artificial Sequence
  PLAC1__Homo_sapiens__AAG22596
augaaaguuuuuaaguucauaggacugaugauccuccucaccucugcguuuucagccgguucaggacaaaguccaaugacugugcugugcuccauagacugguucauggucacagugcaccccuucaugcuaaacaacgauguguguguacacuuucaugaacuacacuugggccuggguugccccccaaaccauguucagccacacgccuaccaguucaccuaccguguuacugaauguggcaucagggccaaagcugucucucaggacaugguuaucuacagcacugagauacacuacucuucuaagggcacgccaucuaaguuugugaucccagugucaugugcugccccccaaaaguccccauggcucaccaagcccugcuccaugagaguagccagcaagagcagggccacagcccagaaggaugagaaaugcuacgagguguucagcuugucacaguccagucaaaggcccaacugcgauuguccaccuugugucuucagugaagaagagcauacccaggucccuugucaccaagcaggggcucaggaggcucaaccucugcagccaucucacuuucuugauauuucugaggauuggucucuucacacagaugauaugauuggguccauguga

SEQ ID NO: 3144 - RNA, 639 nt, Artificial Sequence
  derived and/or modified sequence opt1 from PLAC1__Homo_sapiens__AAG22596
augaagguguucaaguucaucggccugaugauccuccugaccagcgccuucuccgccgggagcggccagucccccaugaccguccugugcagcaucgacugguucauggugacggugcacccguucaugcucaacaacgacgucugcgugcacuuccacgagcugcaccuggggcucggcugcccgcccaaccacgugcagccccacgcguaccaguucaccuaccgcgucaccgagugcgggauccgggccaaggccgugucccaggacauggugaucuacagcaccgagauccacuacuccagcaagggcacgcccuccaaguucgucauccccgugagcugcgccgcgccccagaagucccccuggcugaccaagccgugcagcaugcgcguggccuccaagagccgggccaccgcccagaaggacgagaagugcuacgaggucuucucccugagccaguccagccagcgccccaacugcgacugcccgcccugcguguucuccgaggaggagcacacccaggugcccugccaccaggccggcgcgcaggaggcccagccccuccagcccagccacuuccuggacaucagcgaggacuggucccugcacacggacgacaugaucgggagcauguga

SEQ ID NO: 3145 - RNA, 639 nt, Artificial Sequence
  derived and/or modified sequence opt2 from PLAC1__Homo_sapiens__AAG22596
augaaggucuucaaguucaucggccucaugauccuccucaccuccgccuucuccgccggcuccggccagucccccaugaccguccucugcuccaucgacugguucauggucaccguccaccccuucaugcucaacaacgacgucugcguccacuuccacgagcuccaccucggccucggcugcccccccaaccacguccagccccacgccuaccaguucaccuaccgcgucaccgagugcggcauccgcgccaaggccgucucccaggacauggucaucuacuccaccgagauccacuacuccuccaagggcacccccuccaaguucgucauccccgucuccugcgccgccccccagaagucccccuggcucaccaagcccugcuccaugcgcgucgccuccaagucccgcgccaccgcccagaaggacgagaagugcuacgaggucuucucccucucccaguccucccagcgccccaacugcgacugcccccccugcgucuucuccgaggaggagcacacccagguccccugccaccaggccggcgcccaggaggcccagccccuccagcccucccacuuccucgacaucuccgaggacuggucccuccacaccgacgacaugaucggcuccauguga

SEQ ID NO: 3146 - RNA, 639 nt, Artificial Sequence
  derived and/or modified sequence opt3 from PLAC1__Homo_sapiens__AAG22596
augaagguguucaaauuuaucggccugaugauucuccuuaccagcgccuucuccgcugggucuggacagucacccaugacaguccugugcaguauagacugguuuaugguuacugugcacccuuucauguugaacaaugauguaugugugcauuuucacgaguuacaucugggucuaggcugcccaccgaaccacguccaaccccaugcauaccaguucacguauagagugaccgaaugugggaucagggccaaggcgguuagccaggacauggugauuuacuccacagagauccacuauucuucgaaaggaacuccuucaaaguuugucauuccagugagcugcgcugcaccccagaaaaguccuuggcucaccaagccauguuccaugcggguagccucuaagagccgcgccacagcucaaaaagaugaaaagugcuacgagguuuucucccugucacagaguagccagcgacccaauugugacugcccuccauguguguuuucugaagaggagcacacccaggucccgugccaucaagcaggcgcccaggaagcucagccccuucagccuucccacuuccuggauaucucagaggacuggagcuugcauacugaugacaugauagguaguauguga

SEQ ID NO: 3147 - RNA, 639 nt, Artificial Sequence
  derived and/or modified sequence opt4 from PLAC1__Homo_sapiens__AAG22596
augaagguguucaaguucaucggccugaugauccugcugaccagcgccuucagcgccggcagcggccagagccccaugaccgugcugugcagcaucgacugguucauggugaccgugcaccccuucaugcugaacaacgacgugugcgugcacuuccacgagcugcaccugggccugggcugcccccccaaccacgugcagccccacgccuaccaguucaccuacagagugaccgagugcggcaucagagccaaggccgugagccaggacauggugaucuacagcaccgagauccacuacagcagcaagggcacccccagcaaguucgugauccccgugagcugcgccgccccccagaagagccccuggcugaccaagcccugcagcaugagaguggccagcaagagcagagccaccgcccagaaggacgagaagugcuacgagguguucagccugagccagagcagccagagacccaacugcgacugcccccccugcguguucagcgaggaggagcacacccaggugcccugccaccaggccggcgcccaggaggcccagccccugcagcccagccacuuccuggacaucagcgaggacuggagccugcacaccgacgacaugaucggcagcauguga

SEQ ID NO: 3148 - RNA, 639 nt, Artificial Sequence
  derived and/or modified sequence opt5 from PLAC1__Homo_sapiens__AAG22596
augaagguguucaaauuuaucggccugaugauucuccugaccagcgccuucuccgcugggucuggacagagccccaugacaguccuuugcuccaucgacugguuuaugguuacggugcacccuuucaugcugaacaaugauguguguguccauuuucacgagcuccaucugggccuugggugcccgcccaaccacgugcaaccucaugccuaccaguucaccuauagaguuacagaauguggcauucgggcgaaggcugugucucaggacauggucaucuacagcaccgagauucacuauuccucuaaaggaacacccagcaaguuugugaucccuguuuccugcgccgcuccccagaaaagcccuuggcugaccaagccguguucuaugcgcguggccuccaagagcagagccacagcucaaaaagaugaaaagugcuacgaggucuucucucucucccagagcucucagcggcccaauugugacugcccucccuguguguuuuccgaagaggagcacacccaggugccuugccaucaagccggggcgcaggaagcccagccccugcagccgagccacuuccuggauaucuccgaggacuggucucuccauacggaugacaugauuggaagcauguga

SEQ ID NO: 3149 - protein, 661 aa, Artificial Sequence
  PMEL__Homo_sapiens__P40967
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 3150 - RNA, 1986 nt, Artificial Sequence
  PMEL__Homo_sapiens__AAB00386
auggaucuggugcuaaaaagaugccuucuucauuuggcugugauaggugcuuugcuggcugugggggcuacaaaaguacccagaaaccaggacuggcuuggugucucaaggcaacucagaaccaaagccuggaacaggcagcuguauccagaguggacagaagcccagagacuugacugcuggagagguggucaagugucccucaaggucaguaaugaugggccuacacugauuggugcaaaugccuccuucucuauugccuugaacuucccuggaagccaaaagguauugccagaugggcagguuaucugggucaacaauaccaucaucaaugggagccagguguggggaggacagccaguguauccccaggaaacugacgaugccugcaucuucccugaugguggaccuugcccaucuggcucuuggucucagaagagaagcuuuguuuaugucuggaagaccuggggccaauacuggcaaguucuagggggcccagugucugggcugagcauugggacaggcagggcaaugcugggcacacacaccauggaagugacugucuaccaucgccggggaucccggagcuaugugccucuugcucauuccagcucagccuucaccauuacugaccaggugccuuucuccgugagcgugucccaguugcgggccuuggauggagggaacaagcacuuccugagaaaucagccucugaccuuugcccuccagcuccaugaccccaguggcuaucuggcugaagcugaccucuccuacaccugggacuuuggagacaguaguggaacccugaucucucgggcacuuguggucacucauacuuaccuggagccuggcccagucacugcccaggugguccugcaggcugccauuccucucaccuccuguggcuccuccccaguuccaggcaccacagaugggcacaggccaacugcagaggccccuaacaccacagcuggccaagugccuacuacagaaguuguggguacuacaccuggucaggcgccaacugcagagcccucuggaaccacaucugugcaggugccaaccacugaagucauaagcacugcaccugugcagaugccaacugcagagagcacagguaugacaccugagaaggugccaguuucagaggucauggguaccacacuggcagagaugucaacuccagaggcuacagguaugacaccugcagagguaucaauuguggugcuuucuggaaccacagcugcacagguaacaacuacagaguggguggagaccacagcuagagagcuaccuaucccugagccugaagguccagaugccagcucaaucaugucuacggaaaguauuacagguucccugggcccccugcuggaugguacagccaccuuaaggcuggugaagagacaagucccccuggauuguguucuguaucgauaugguuccuuuuccgucacccuggacauuguccaggguauugaaagugccgagauccugcaggcugugccguccggugagggggaugcauuugagcugacuguguccugccaaggcgggcugcccaaggaagccugcauggagaucucaucgccagggugccagcccccugcccagcggcugugccagccugugcuacccagcccagccugccagcugguucugcaccagauacugaaggguggcucggggacauacugccucaaugugucucuggcugauaccaacagccuggcaguggucagcacccagcuuaucaugccuggucaagaagcaggccuugggcagguuccgcugaucgugggcaucuugcugguguugauggcugugguccuugcaucucugauauauaggcgcagacuuaugaagcaagacuucuccguaccccaguugccacauagcagcagucacuggcugcgucuaccccgcaucuucugcucuugucccauuggugagaauagcccccuccucagugggcagcaggucuga

SEQ ID NO: 3151 - RNA, 1986 nt, Artificial Sequence
  derived and/or modified sequence opt1 from PMEL__Homo_sapiens__AAB00386
auggaccuggugcucaagcgcugccugcugcaccucgccgugaucggcgcccugcuggcggugggggccaccaaggugccccggaaccaggacuggcucggcgucagccgccagcugcggaccaaggccuggaaccgccagcuguacccggaguggacggaggcccagcggcucgacugcuggcgcgggggccaggugucccugaaggugagcaacgacgggcccacccugaucggcgccaacgcguccuucagcaucgcccucaacuuccccggcucccagaagguccugcccgacggccaggugaucugggugaacaacaccaucaucaacgggagccaggucuggggcgggcagccgguguacccccaggagaccgacgacgccugcaucuuccccgacgggggccccugcccguccggcagcuggucccagaagcggagcuucguguacgucuggaagacgugggggcaguacuggcagguccugggcgggcccguguccggccucagcaucggcaccgggcgcgccaugcugggcacccacaccauggaggugacgguguaccaccggcgcgggucccggagcuacgugccccuggcgcacuccagcuccgccuucaccaucaccgaccagguccccuucagcguguccgugagccagcuccgcgcccuggacggcgggaacaagcacuuccugcggaaccagccgcucaccuucgcccugcagcugcacgaccccagcggcuaccucgccgaggcggaccuguccuacacgugggacuucggcgacagcuccgggacccugaucagccgcgcccucgucgugacccacaccuaccuggagcccggccccgugacggcccaggucgugcugcaggccgccaucccgcucaccuccugcgggagcucccccguccccggcaccaccgacgggcaccggcccacggcggaggccccgaacaccaccgccggccaggugcccaccacggagguggucggcaccacccccgggcaggcccccaccgccgagccgagcggcacgaccuccguccaggugcccaccaccgaggugaucagcacggcgcccgugcagaugcccaccgccgaguccaccgggaugaccccggagaaggugcccgucagcgaggugaugggcacgacccuggccgagauguccacccccgaggccaccgggaugaccccggccgaggugagcaucgucgugcuguccggcacgaccgcggcccaggugaccaccacggagugggucgagaccaccgcccgcgagcuccccauccccgagcccgagggcccggacgccagcuccaucaugagcaccgaguccaucacggggagccugggcccccugcucgacgggaccgcgacccugcggcuggugaagcgccaggugccccucgacugcguccuguaccgguacggcagcuucuccgugacccuggacaucgugcagggcaucgagagcgccgagauccuccaggccguccccuccggggagggcgacgccuucgagcugacggugagcugccagggcgggcugccgaaggaggccugcauggagaucuccagccccgggugccagccgcccgcgcagcgccucugccagcccgugcugcccucccccgccugccagcugguccuccaccagauccugaagggcggcagcgggaccuacugccugaacgugucccuggccgacaccaacagccucgccguggucuccacccagcugaucaugcccggccaggaggccgggcugggccaggugccgcucaucguggggauccugcugguccucauggcgguggugcuggccagccugaucuaccggcgccgccucaugaagcaggacuucuccgucccccagcugccccacagcuccagccacuggcugcggcucccccgcaucuucugcuccugcccgaucggcgagaacagcccccugcugagcggccagcaggucuga

SEQ ID NO: 3152 - RNA, 1986 nt, Artificial Sequence
  derived and/or modified sequence opt2 from PMEL__Homo_sapiens__AAB00386
auggaccucguccucaagcgcugccuccuccaccucgccgucaucggcgcccuccucgccgucggcgccaccaaggucccccgcaaccaggacuggcucggcgucucccgccagcuccgcaccaaggccuggaaccgccagcucuaccccgaguggaccgaggcccagcgccucgacugcuggcgcggcggccaggucucccucaaggucuccaacgacggccccacccucaucggcgccaacgccuccuucuccaucgcccucaacuuccccggcucccagaagguccuccccgacggccaggucaucugggucaacaacaccaucaucaacggcucccaggucuggggcggccagcccgucuacccccaggagaccgacgacgccugcaucuuccccgacggcggccccugccccuccggcuccuggucccagaagcgcuccuucgucuacgucuggaagaccuggggccaguacuggcagguccucggcggccccgucuccggccucuccaucggcaccggccgcgccaugcucggcacccacaccauggaggucaccgucuaccaccgccgcggcucccgcuccuacgucccccucgcccacuccuccuccgccuucaccaucaccgaccagguccccuucuccgucuccgucucccagcuccgcgcccucgacggcggcaacaagcacuuccuccgcaaccagccccucaccuucgcccuccagcuccacgaccccuccggcuaccucgccgaggccgaccucuccuacaccugggacuucggcgacuccuccggcacccucaucucccgcgcccucgucgucacccacaccuaccucgagcccggccccgucaccgcccaggucguccuccaggccgccaucccccucaccuccugcggcuccucccccguccccggcaccaccgacggccaccgccccaccgccgaggcccccaacaccaccgccggccagguccccaccaccgaggucgucggcaccacccccggccaggcccccaccgccgagcccuccggcaccaccuccguccagguccccaccaccgaggucaucuccaccgcccccguccagaugcccaccgccgaguccaccggcaugacccccgagaagguccccgucuccgaggucaugggcaccacccucgccgagauguccacccccgaggccaccggcaugacccccgccgaggucuccaucgucguccucuccggcaccaccgccgcccaggucaccaccaccgagugggucgagaccaccgcccgcgagcuccccauccccgagcccgagggccccgacgccuccuccaucauguccaccgaguccaucaccggcucccucggcccccuccucgacggcaccgccacccuccgccucgucaagcgccaggucccccucgacugcguccucuaccgcuacggcuccuucuccgucacccucgacaucguccagggcaucgaguccgccgagauccuccaggccguccccuccggcgagggcgacgccuucgagcucaccgucuccugccagggcggccuccccaaggaggccugcauggagaucuccucccccggcugccagccccccgcccagcgccucugccagcccguccuccccucccccgccugccagcucguccuccaccagauccucaagggcggcuccggcaccuacugccucaacgucucccucgccgacaccaacucccucgccgucgucuccacccagcucaucaugcccggccaggaggccggccucggccaggucccccucaucgucggcauccuccucguccucauggccgucguccucgccucccucaucuaccgccgccgccucaugaagcaggacuucuccgucccccagcucccccacuccuccucccacuggcuccgccucccccgcaucuucugcuccugccccaucggcgagaacuccccccuccucuccggccagcaggucuga

SEQ ID NO: 3153 - RNA, 1986 nt, Artificial Sequence
  derived and/or modified sequence opt3 from PMEL__Homo_sapiens__AAB00386
auggaccuggugcucaagagaugccuucugcacuuggccgucaucggcgcuuuacuggcaguuggggccaccaaagugcccaggaaccaggauuggcuaggaguaagccggcaacuccgcacaaaggcguggaaucgacagcuguacccugaguggacugaagcucagcgucuugacuguuggagagguggccaggugucccugaaagucucuaacgaugggccaacguugauuggagccaaugcaucauucaguauagcccucaacuuuccgggcagccaaaaggugcugcccgacggucagguuaucugggugaauaacaccauuaucaaugggucccaggucuggggaggccagccuguguauccacaagagacagaugacgcuugcauuuuccccgauggcgggccuuguccaucuggaucguggucacagaaaaggagcuuuguauacguuuggaagacuuggggucaguauuggcaagugcugggcgggcccgucaguggacucuccaucggcaccggucgggcaauguuagggacacauaccauggaagugacuguguaccaccgcagaggaucuaggagcuaugucccucuggcccauuccucaagugcuuucacaauaaccgaccagguuccauuuagcgugucuguaucccagcuucgggccuuggauggcggcaacaagcacuuccugcgcaaucagccgcuaacguuugcgcuccaacugcaugaccccucaggguaccuugcagaggccgaucugagcuauacuugggacuucggagauaguucugguaccuugaucucccgagcucucguggucacacacacuuaccuggaaccuggcccagugaccgcccagguuguguuacaggcagcuauuccccugacaagcugcgggucgucuccugucccaggaaccacggacggccacagacccacugccgaggcgccgaacacaaccgccggucaggugccuacuacagagguaguugggaccacgcccggccaagcaccaaccgcugaaccuuccggaacaacuucagugcagguccccaccacagaggugaucaguacugccccaguccagaugcccaccgcugaaagcacaggcaugaccccugagaaagugccaguuuccgaggugauggggacuacgcucgccgaaaugucuacaccggaggcaaccggaaugacucccgccgaaguaagcauugucgugcuuucagguaccacagcugcgcagguuaccacuacagaguggguggaaacgaccgcaagggagcugccuaucccagagcccgaaggcccugacgccaguuccauaaugagcacugagucuauuacagggucauugggaccacuacuggauggcaccgcuacacuccggcuggucaagcgucaagugccccuugacuguguacuguaccgcuaugguaguuuuagcgugacuuuggauaucguucaggggauugaauccgccgagauccuccaggcagucccgucuggcgaaggagacgccuucgagcugaccgugucgugccagggcggguuaccuaaagaggcuuguauggaaaucagcuccccaggaugccaacccccugcccagagacugugucagcccgugcuaccaaguccugcaugccagcucguccugcaucaaauucuuaaggguggcucagggacguacuguuugaauguuucucuggcggauaccaacagccucgcugugguguccacacagcugauaaugcccggacaggaggccggccuuggucaaguaccacugaucgucgggauuuugcucgugcugauggcaguuguguuagccucacugaucuauaggcggcgacuaaugaaacaggacuuuagcgucccgcagcucccucacucuuccagucauuggcugcgccuucccagaauauucugcagcugcccaauuggcgaaaauucucccuugcuguccggacagcaaguguga

SEQ ID NO: 3154 - RNA, 1986 nt, Artificial Sequence
  derived and/or modified sequence opt4 from PMEL__Homo_sapiens__AAB00386
auggaccuggugcugaagagaugccugcugcaccuggccgugaucggcgcccugcuggccgugggcgccaccaaggugcccagaaaccaggacuggcugggcgugagcagacagcugagaaccaaggccuggaacagacagcuguaccccgaguggaccgaggcccagagacuggacugcuggagaggcggccaggugagccugaaggugagcaacgacggccccacccugaucggcgccaacgccagcuucagcaucgcccugaacuuccccggcagccagaaggugcugcccgacggccaggugaucugggugaacaacaccaucaucaacggcagccagguguggggcggccagcccguguacccccaggagaccgacgacgccugcaucuuccccgacggcggccccugccccagcggcagcuggagccagaagagaagcuucguguacguguggaagaccuggggccaguacuggcaggugcugggcggccccgugagcggccugagcaucggcaccggcagagccaugcugggcacccacaccauggaggugaccguguaccacagaagaggcagcagaagcuacgugccccuggcccacagcagcagcgccuucaccaucaccgaccaggugcccuucagcgugagcgugagccagcugagagcccuggacggcggcaacaagcacuuccugagaaaccagccccugaccuucgcccugcagcugcacgaccccagcggcuaccuggccgaggccgaccugagcuacaccugggacuucggcgacagcagcggcacccugaucagcagagcccugguggugacccacaccuaccuggagcccggccccgugaccgcccagguggugcugcaggccgccaucccccugaccagcugcggcagcagccccgugcccggcaccaccgacggccacagacccaccgccgaggcccccaacaccaccgccggccaggugcccaccaccgagguggugggcaccacccccggccaggcccccaccgccgagcccagcggcaccaccagcgugcaggugcccaccaccgaggugaucagcaccgcccccgugcagaugcccaccgccgagagcaccggcaugacccccgagaaggugcccgugagcgaggugaugggcaccacccuggccgagaugagcacccccgaggccaccggcaugacccccgccgaggugagcaucguggugcugagcggcaccaccgccgcccaggugaccaccaccgaguggguggagaccaccgccagagagcugcccauccccgagcccgagggccccgacgccagcagcaucaugagcaccgagagcaucaccggcagccugggcccccugcuggacggcaccgccacccugagacuggugaagagacaggugccccuggacugcgugcuguacagauacggcagcuucagcgugacccuggacaucgugcagggcaucgagagcgccgagauccugcaggccgugcccagcggcgagggcgacgccuucgagcugaccgugagcugccagggcggccugcccaaggaggccugcauggagaucagcagccccggcugccagccccccgcccagagacugugccagcccgugcugcccagccccgccugccagcuggugcugcaccagauccugaagggcggcagcggcaccuacugccugaacgugagccuggccgacaccaacagccuggccguggugagcacccagcugaucaugcccggccaggaggccggccugggccaggugccccugaucgugggcauccugcuggugcugauggccguggugcuggccagccugaucuacagaagaagacugaugaagcaggacuucagcgugccccagcugccccacagcagcagccacuggcugagacugcccagaaucuucugcagcugccccaucggcgagaacagcccccugcugagcggccagcagguguga

SEQ ID NO: 3155 - RNA, 1986 nt, Artificial Sequence
  derived and/or modified sequence opt5 from PMEL__Homo_sapiens__AAB00386
auggaccuggugcucaagagaugccugcuucaccuggccgucaucggcgcucuccuggccguuggggcgaccaaagugccccggaaccaggauuggcuuggagugagccgccaacugagaacaaaggcuuggaaucggcagcucuacccugaguggacggaagcccagcgccuggacuguuggagaggcgggcaggucucccugaaagugucuaacgauggaccgacccucauuggcgccaaugcuagcuucuccaucgcccugaacuuucccgggucucaaaagguucuuccugacggacaggugauuugggucaauaacacaaucauuaauggcagccagguguggggcgggcagcccguuuauccucaagagaccgaugacgcuugcaucuuccccgauggaggcccuuguccguccgggucuuggagccagaaacgguccuuuguguacgucuggaagacauggggacaguauuggcaagugcugggcgggcccgugagcggacucucuaucggcaccggccgcgccaugcuggggacacauaccauggaagucacgguuuaccacagacggggaucccgcagcuaugugccucuugcgcauucuuccagcgccuucaccauuacagaccaggugcccuuuucugucuccgugagccagcugagagcucucgauggcgggaacaagcacuuccugcggaaucagccucugaccuuugcccuccaacugcaugaccccuccggauaccuugcugaggccgaucugucuuauacaugggacuucggcgauagcuccgggacccucaucagccgcgcgcugguugugacgcacacauaccuugaaccgggaccugucaccgcccaggugguucugcaggcugccauuccccucacaucuugcggcuccagcccugugcccggcaccaccgacgggcacagacccacagcugaggccccuaacacgaccgccggacaggucccgacaaccgagguggucggcacaacccccgggcaagcuccuacggcggaacccucuggaacaaccagcgugcagguuccuaccacagaggugaucuccaccgcccccguccagaugccgacagcugaaucuacgggcaugaccccugagaaagugcccguuagcgaggugauggggacaacccuggccgaaauguccacaccugaggccaccggcaugacgcccgcugaagucagcauuguggugcugucuggaaccacagccgcgcagguuaccacaaccgagugggucgaaacgacagcucgggagcucccuauccccgagccggaaggcccugacgccuccagcauuaugucuaccgaguccaucacagggagccugggaccccuucuggauggcaccgccacccuccgccuggugaagagacaagugccccuugacuguguccuguaccgguauggguccuuuucugugacacucgauaucguucagggaauugaaagcgcugagauccugcaggccgugccuuccggcgaaggggacgcuuucgagcugacggucucuugccagggcggacucccgaaagaggccuguauggaaauuagcucccccggcugccaaccucccgcgcagagacugugucagccugugcuucccagcccugccugccagcugguucuccaucaaauccugaaagggggaucuggcaccuacugucugaaugugucccuugcugauacaaacagccucgccgucgugucuacccagcugauuaugcccgggcaggaggcuggacugggccaaguuccgcucaucguggggauccugcuuguccugauggccguggugcucgcgucccugauuuaucgccggagacugaugaagcaggacuuuagcgucccucagcuuccccacucuagcucccauuggcuccgccugccucggaucuucugcagcugccccauuggcgaaaauucuccgcugcucuccggacagcaaguuuga

SEQ ID NO: 3156 - protein, 882 aa, Artificial Sequence
  PML__Homo_sapiens__P29590
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEAFFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 3157 - RNA, 2649 nt, Artificial Sequence
  PML__Homo_sapiens__CCDS10255.1
auggagccugcacccgcccgaucuccgaggccccagcaggaccccgcccggccccaggagcccaccaugccuccccccgagacccccucugaaggccgccagcccagccccagccccagcccuacagagcgagcccccgcuucggaggaggaguuccaguuucugcgcugccagcaaugccaggcggaagccaagugcccgaagcugcugccuugucugcacacgcugugcucaggaugccuggaggcgucgggcaugcagugccccaucugccaggcgcccuggccccuaggugcagacacacccgcccuggauaacgucuuuuucgagagucugcagcggcgccugucgguguaccggcagauuguggaugcgcaggcugugugcacccgcugcaaagagucggccgacuucuggugcuuugagugcgagcagcuccucugcgccaagugcuucgaggcacaccagugguuccucaagcacgaggcccggccccuagcagagcugcgcaaccagucggugcgugaguuccuggacggcacccgcaagaccaacaacaucuucugcuccaaccccaaccaccgcaccccuacgcugaccagcaucuacugccgaggauguuccaagccgcugugcugcucgugcgcgcuccuugacagcagccacagugagcucaagugcgacaucagcgcagagauccagcagcgacaggaggagcuggacgccaugacgcaggcgcugcaggagcaggauagugccuuuggcgcgguucacgcgcagaugcacgcggccgucggccagcugggccgcgcgcgugccgagaccgaggagcugauccgcgagcgcgugcgccaggugguagcucacgugcgggcucaggagcgcgagcugcuggaggcuguggacgcgcgguaccagcgcgacuacgaggagauggccagucggcugggccgccuggaugcugugcugcagcgcauccgcacgggcagcgcgcuggugcagaggaugaagugcuacgccucggaccaggaggugcuggacaugcacgguuuccugcgccaggcgcucugccgccugcgccaggaggagccccagagccugcaagcugccgugcgcaccgauggcuucgacgaguucaaggugcgccugcaggaccucagcucuugcaucacccaggggaaagaugcagcuguauccaagaaagccagcccagaggcugccagcacucccagggacccuauugacguugaccugcccgaggaggcagagagagugaaggcccagguucaggcccuggggcuggcugaagcccagccuauggcugugguacagucagugcccggggcacaccccgugccaguguacgccuucuccaucaaaggcccuuccuauggagaggaugucuccaauacaacgacagcccagaagaggaagugcagccagacccagugccccaggaaggucaucaagauggagucugaggaggggaaggaggcaagguuggcucggagcuccccggagcagcccaggcccagcaccuccaaggcagucucaccaccccaccuggauggaccgccuagccccaggagccccgucauaggaagugaggucuuccugcccaacagcaaccacguggccaguggcgccggggaggcagaggaacgcguuguggugaucagcagcucggaagacucagaugccgaaaacucguccucccgagagcuggaugacagcagcagugaguccagugaccuccagcuggaaggccccagcacccucaggguccuggacgagaaccuugcugacccccaagcagaagacagaccucugguuuucuuugaccucaagauugacaaugaaacccagaagauuagccagcuggcugcggugaaccgggaaagcaaguuccgcguggucauccagccugaagccuucuucagcaucuacuccaaggccgugucccuggagguggggcugcagcacuuccucagcuuucugagcuccaugcgccgcccuaucuuggccugcuacaagcugugggggccuggccucccaaacuucuuccgggcccuggaggacauuaacaggcugugggaauuccaggaggccaucucgggcuuccuggcugcccugccucucauccgggagcgugugcccggggccagcagcuucaaacucaagaaccuggcccagaccuaccuggcgagaaacaugagcgagcgcagcgccauggcugccgugcuggccaugcgugaccugugccgccuccucgaggucuccccgggcccccagcuggcccagcaugucuaccccuucaguagccugcagugcuuugccucccugcagccccuggugcaggcagcugugcugccccgggcugaggcccgccuccuggcccuacacaacgugagcuucauggagcugcugagugcacaccgccgugaccggcaggggggccugaagaaguacagccgcuaucuaagccugcagaccaccacguugcccccugcccagccugcuuucaaccugcaggcucugggcaccuacuuugaaggccuguuggaggguccggcgcuggcacgggcagaaggagucuccaccccacuugcuggccguggcuuggcagagagggccucccagcagagcuga

SEQ ID NO: 3158 - RNA, 2649 nt, Artificial Sequence
  derived and/or modified sequence opt1 from PML__Homo_sapiens__CCDS10255.1
auggagcccgccccggcccgcagcccccggccccagcaggaccccgcgcgcccgcaggagcccaccaugcccccgcccgagacccccuccgagggccggcagcccagccccuccccgagccccaccgagcgcgcccccgccuccgaggaggaguuccaguuccugcggugccagcagugccaggccgaggccaagugccccaagcuccugccgugccugcacacccucugcagcgggugccuggaggcguccggcaugcagugccccaucugccaggcccccuggccccugggggccgacaccccggcccucgacaacguguucuucgagagccugcagcgccggcuguccgucuaccgccagaucguggacgcgcaggccgugugcacccggugcaaggagagcgccgacuucuggugcuucgagugcgagcagcuccugugcgccaagugcuucgaggcccaccagugguuccugaagcacgaggcgcgcccccucgccgagcugcggaaccaguccguccgcgaguuccuggacggcacgcggaagaccaacaacaucuucugcagcaaccccaaccaccgcacccccacccucacguccaucuacugccgggggugcagcaagccgcugugcugcuccugcgcccugcucgacagcucccacagcgagcugaagugcgacaucuccgccgagauccagcagcgccaggaggagcuggacgccaugacccaggcgcuccaggagcaggacagcgccuucggcgccgugcacgcccagaugcacgccgcggugggccagcuggggcgggcccgcgccgagaccgaggagcugauccgggagcgcguccgccaggugguggcccacguccgggcccaggagcgcgagcuccuggaggcgguggacgcccgguaccagcgcgacuacgaggagauggccagccggcugggccgccucgacgccgugcugcagcggauccgcaccggguccgcgcugguccagcggaugaagugcuacgccagcgaccaggaggugcucgacaugcacggcuuccugcgccaggcccugugccggcuccgccaggaggagccccagucccugcaggccgccgugcggacggacggguucgacgaguucaagguccgccugcaggaccucagcuccugcaucacccagggcaaggacgcggccgugagcaagaaggccucccccgaggccgccagcacgccccgggacccgaucgacguggaccugcccgaggaggcggagcgcgucaaggcccaggugcaggcccugggccucgccgaggcccagcccauggcggugguccaguccgugccgggggcccaccccgugcccgucuacgccuucagcaucaagggccccuccuacggggaggacgugagcaacaccaccaccgcccagaagcggaagugcucccagacccagugcccgcgcaaggucaucaagauggagagcgaggagggcaaggaggcgcggcuggcccgcuccagccccgagcagccccggcccuccaccagcaaggccguguccccgccccaccuggacggcccgcccagcccccgcagccccgugaucggguccgaggucuuccuccccaacagcaaccacguggccuccggcgccggggaggcggaggagcgcguggucgugaucagcuccagcgaggacuccgacgccgagaacagcuccagccgggagcuggacgacuccagcuccgagagcuccgaccugcagcucgagggccccagcacgcugcgcgugcuggacgagaaccucgccgacccgcaggccgaggaccggccccuggucuucuucgaccugaagaucgacaacgagacccagaagaucucccagcuggccgcggugaaccgcgagagcaaguuccggguggucauccagcccgaggccuucuucagcaucuacuccaaggccgugagccucgagguggggcugcagcacuuccuguccuuccucagcuccaugcgccggcccauccuggccugcuacaagcuguggggcccgggccuccccaacuucuuccgcgcccuggaggacaucaaccggcugugggaguuccaggaggcgaucagcggguuccucgccgcccugccccugauccgcgagcggguccccggcgccuccagcuucaagcucaagaaccuggcgcagaccuaccuggcccgcaacauguccgagcggagcgccauggccgccgugcucgcgaugcgcgaccugugccggcugcucgagguguccccggggccccagcuggcccagcacgucuaccccuucagcucccugcagugcuucgccagccuccagccgcuggugcaggccgccgugcugccccgcgcggaggcccggcuccuggcccugcacaacgucuccuucauggagcuccugagcgcccaccgccgggaccgccagggcgggcugaagaaguacucccgguaccucagccugcagaccacgacccugccgcccgcccagcccgcguucaaccuccaggcccugggcaccuacuucgagggccugcucgaggggcccgcccuggcccgcgccgagggcguguccacgccccuggcggggcgcggccucgccgagcgggccagccagcagagcuga

SEQ ID NO: 3159 - RNA, 2649 nt, Artificial Sequence
  derived and/or modified sequence opt2 from PML__Homo_sapiens__CCDS10255.1
auggagcccgcccccgcccgcuccccccgcccccagcaggaccccgcccgcccccaggagcccaccaugcccccccccgagacccccuccgagggccgccagcccucccccucccccucccccaccgagcgcgcccccgccuccgaggaggaguuccaguuccuccgcugccagcagugccaggccgaggccaagugccccaagcuccuccccugccuccacacccucugcuccggcugccucgaggccuccggcaugcagugccccaucugccaggcccccuggccccucggcgccgacacccccgcccucgacaacgucuucuucgagucccuccagcgccgccucuccgucuaccgccagaucgucgacgcccaggccgucugcacccgcugcaaggaguccgccgacuucuggugcuucgagugcgagcagcuccucugcgccaagugcuucgaggcccaccagugguuccucaagcacgaggcccgcccccucgccgagcuccgcaaccaguccguccgcgaguuccucgacggcacccgcaagaccaacaacaucuucugcuccaaccccaaccaccgcacccccacccucaccuccaucuacugccgcggcugcuccaagccccucugcugcuccugcgcccuccucgacuccucccacuccgagcucaagugcgacaucuccgccgagauccagcagcgccaggaggagcucgacgccaugacccaggcccuccaggagcaggacuccgccuucggcgccguccacgcccagaugcacgccgccgucggccagcucggccgcgcccgcgccgagaccgaggagcucauccgcgagcgcguccgccaggucgucgcccacguccgcgcccaggagcgcgagcuccucgaggccgucgacgcccgcuaccagcgcgacuacgaggagauggccucccgccucggccgccucgacgccguccuccagcgcauccgcaccggcuccgcccucguccagcgcaugaagugcuacgccuccgaccaggagguccucgacaugcacggcuuccuccgccaggcccucugccgccuccgccaggaggagccccagucccuccaggccgccguccgcaccgacggcuucgacgaguucaagguccgccuccaggaccucuccuccugcaucacccagggcaaggacgccgccgucuccaagaaggccucccccgaggccgccuccaccccccgcgaccccaucgacgucgaccuccccgaggaggccgagcgcgucaaggcccagguccaggcccucggccucgccgaggcccagcccauggccgucguccaguccguccccggcgcccaccccguccccgucuacgccuucuccaucaagggccccuccuacggcgaggacgucuccaacaccaccaccgcccagaagcgcaagugcucccagacccagugcccccgcaaggucaucaagauggaguccgaggagggcaaggaggcccgccucgcccgcuccucccccgagcagccccgccccuccaccuccaaggccgucucccccccccaccucgacggcccccccuccccccgcucccccgucaucggcuccgaggucuuccuccccaacuccaaccacgucgccuccggcgccggcgaggccgaggagcgcgucgucgucaucuccuccuccgaggacuccgacgccgagaacuccuccucccgcgagcucgacgacuccuccuccgaguccuccgaccuccagcucgagggccccuccacccuccgcguccucgacgagaaccucgccgacccccaggccgaggaccgcccccucgucuucuucgaccucaagaucgacaacgagacccagaagaucucccagcucgccgccgucaaccgcgaguccaaguuccgcgucgucauccagcccgaggccuucuucuccaucuacuccaaggccgucucccucgaggucggccuccagcacuuccucuccuuccucuccuccaugcgccgccccauccucgccugcuacaagcucuggggccccggccuccccaacuucuuccgcgcccucgaggacaucaaccgccucugggaguuccaggaggccaucuccggcuuccucgccgcccucccccucauccgcgagcgcguccccggcgccuccuccuucaagcucaagaaccucgcccagaccuaccucgcccgcaacauguccgagcgcuccgccauggccgccguccucgccaugcgcgaccucugccgccuccucgaggucucccccggcccccagcucgcccagcacgucuaccccuucuccucccuccagugcuucgccucccuccagccccucguccaggccgccguccucccccgcgccgaggcccgccuccucgcccuccacaacgucuccuucauggagcuccucuccgcccaccgccgcgaccgccagggcggccucaagaaguacucccgcuaccucucccuccagaccaccacccucccccccgcccagcccgccuucaaccuccaggcccucggcaccuacuucgagggccuccucgagggccccgcccucgcccgcgccgagggcgucuccaccccccucgccggccgcggccucgccgagcgcgccucccagcaguccuga

SEQ ID NO: 3160 - RNA, 2649 nt, Artificial Sequence
  derived and/or modified sequence opt3 from PML__Homo_sapiens__CCDS10255.1
auggagcccgccccugcuagaagcccaaggccgcagcaagaccccgcacggccucaggaaccaaccaugcccccuccagagacacccuccgaaggccgccagccuucuccaucaccgagucccacugagcgagccccugcgagcgaagaggaguuccaguuucugcguugccaacagugucaggcugaagccaagugcccaaaacuccuucccugucugcacacguugugcuccggguguuuagaggcaucuggaaugcagugcccuaucugucaagccccauggccccugggugcugauaccccggcacuagacaacguguucuuugaaucgcuccagagaaggcugucagucuaccggcagauuguugaugcccaggcugugugcacacgcuguaaggagagcgccgacuucuggugcuuugagugugaacaacuucugugcgcgaaaugcuucgaggcacaucagugguuuuugaagcacgaagccagaccucucgcugagcugaggaaucagaguguacgggaauuucuggauggcacucgcaaaaccaacaauauauuuuguuccaaccccaaucaucgaacaccaacccucacuucuaucuauugcagaggguguagcaagccuuuaugcuguuccugcgcccugcuugacucaagucacagcgaguugaagugugauauuucugcagagauccaacagaggcaggaagaacuggacgcuaugacacaggcccuacaagaacaggauuccgcguucggagccgugcaugcacagaugcacgcugccgucggccagcucggucgggcucgugccgagaccgaggagcugauucgcgagagagugaggcaaguuguggcacacguccgggcccaggaacgagagcuucuggaagcuguggacgcgcgcuaccagagagauuaugaggaaauggcaucaagguuggggcggcucgacgccguacugcagcgcaucagaacgggaagcgcuuuaguucaaaggaugaaaugcuacgccagugaucaggaggugcuggacaugcauggcuuucuccgucaggcacuuugucggcugcgacaggaggaaccccaaucuuugcaggccgcugucagaacugacggcuucgaugaguuuaaggugaggcuacaggaccuguccagcugcauaacccaagggaaagaugccgcagugucgaagaaagcgucuccagaagcugccuccacaccccgcgacccuaucgaugucgaccucccagaggaggcagaacggguuaaggcccaggugcaggcucugggacuugccgaggcacagccgauggcuguagugcaaucaguccccggugcccacccugugccaguuuaugcguucaguauuaagggccccagcuacggggaagauguguccaacacuaccacagcccagaaaagaaaguguucucagacccagugcccuaggaaagucaucaagauggagagcgaagagggaaaagaggcucgccuggcacgaucaaguccagaacaaccccggccguccacgagcaaggccgugucuccuccacauuuggacggucccccuucaccccguaguccaguaauuggcagcgagguuuuccucccuaauuccaaccacguggcuucuggggccggagaagcagaggaaagagucguggucaucucgagcuccgaggauucagacgcggagaauaguucuagcagggaacuggaugacuccucaagcgagucuuccgacuuacagcuggaaggccccaguacucuacgcgugcucgaugagaaccuggccgacccacaggcugaagaucggccgcuuguuuucuucgacuugaaaauagauaaugagacacagaagauuagccaacuggccgcagugaacagagagucuaaguuuaggguagucauccagccugaggcuuucuuuuccauuuauucaaaagccgugagucucgaaguuggccugcagcacuuccuuagcuuucugucguccaugcgacgccccaucuuggcaugcuacaagcucugggggccaggacugcccaauuucuuucgggccuuagaagacaucaacagacugugggaguuccaagaggcuauuucugguuuucuagcggcccucccucugauaagggaacgugugccaggcgcaagcucauucaaacuuaagaauuuggcucagaccuaccuggcccgcaacaugagugagcgguccgccauggcugcaguccucgccaugagagaucuguguagguuacuggaagugucucccgggccucagcuugcgcagcauguauauccguuuagcuccuugcaaugcuucgcuucacuccagccacuggugcaggccgcaguucuaccccgagccgaggcucggcugcucgcacugcacaacgucagcuucauggaacuuuugagugcccaucgcagagacaggcagggaggccugaaaaaguacucucgguauuuaucccuccaaacuacaacccugccuccagcgcagcccgcuuuuaaucuucaggcccuggguacguacuucgagggguugcucgagggcccugcacuggcccgagcugaaggagugagcaccccgcuagccggcagagggcuggcagagcgcgcuucgcagcaaucauga

SEQ ID NO: 3161 - RNA, 2649 nt, Artificial Sequence
  derived and/or modified sequence opt4 from PML__Homo_sapiens__CCDS10255.1
auggagcccgcccccgccagaagccccagaccccagcaggaccccgccagaccccaggagcccaccaugcccccccccgagacccccagcgagggcagacagcccagccccagccccagccccaccgagagagcccccgccagcgaggaggaguuccaguuccugagaugccagcagugccaggccgaggccaagugccccaagcugcugcccugccugcacacccugugcagcggcugccuggaggccagcggcaugcagugccccaucugccaggcccccuggccccugggcgccgacacccccgcccuggacaacguguucuucgagagccugcagagaagacugagcguguacagacagaucguggacgcccaggccgugugcaccagaugcaaggagagcgccgacuucuggugcuucgagugcgagcagcugcugugcgccaagugcuucgaggcccaccagugguuccugaagcacgaggccagaccccuggccgagcugagaaaccagagcgugagagaguuccuggacggcaccagaaagaccaacaacaucuucugcagcaaccccaaccacagaacccccacccugaccagcaucuacugcagaggcugcagcaagccccugugcugcagcugcgcccugcuggacagcagccacagcgagcugaagugcgacaucagcgccgagauccagcagagacaggaggagcuggacgccaugacccaggcccugcaggagcaggacagcgccuucggcgccgugcacgcccagaugcacgccgccgugggccagcugggcagagccagagccgagaccgaggagcugaucagagagagagugagacaggugguggcccacgugagagcccaggagagagagcugcuggaggccguggacgccagauaccagagagacuacgaggagauggccagcagacugggcagacuggacgccgugcugcagagaaucagaaccggcagcgcccuggugcagagaaugaagugcuacgccagcgaccaggaggugcuggacaugcacggcuuccugagacaggcccugugcagacugagacaggaggagccccagagccugcaggccgccgugagaaccgacggcuucgacgaguucaaggugagacugcaggaccugagcagcugcaucacccagggcaaggacgccgccgugagcaagaaggccagccccgaggccgccagcacccccagagaccccaucgacguggaccugcccgaggaggccgagagagugaaggcccaggugcaggcccugggccuggccgaggcccagcccauggccguggugcagagcgugcccggcgcccaccccgugcccguguacgccuucagcaucaagggccccagcuacggcgaggacgugagcaacaccaccaccgcccagaagagaaagugcagccagacccagugccccagaaaggugaucaagauggagagcgaggagggcaaggaggccagacuggccagaagcagccccgagcagcccagacccagcaccagcaaggccgugagccccccccaccuggacggcccccccagccccagaagccccgugaucggcagcgagguguuccugcccaacagcaaccacguggccagcggcgccggcgaggccgaggagagagugguggugaucagcagcagcgaggacagcgacgccgagaacagcagcagcagagagcuggacgacagcagcagcgagagcagcgaccugcagcuggagggccccagcacccugagagugcuggacgagaaccuggccgacccccaggccgaggacagaccccugguguucuucgaccugaagaucgacaacgagacccagaagaucagccagcuggccgccgugaacagagagagcaaguucagaguggugauccagcccgaggccuucuucagcaucuacagcaaggccgugagccuggaggugggccugcagcacuuccugagcuuccugagcagcaugagaagacccauccuggccugcuacaagcuguggggccccggccugcccaacuucuucagagcccuggaggacaucaacagacugugggaguuccaggaggccaucagcggcuuccuggccgcccugccccugaucagagagagagugcccggcgccagcagcuucaagcugaagaaccuggcccagaccuaccuggccagaaacaugagcgagagaagcgccauggccgccgugcuggccaugagagaccugugcagacugcuggaggugagccccggcccccagcuggcccagcacguguaccccuucagcagccugcagugcuucgccagccugcagccccuggugcaggccgccgugcugcccagagccgaggccagacugcuggcccugcacaacgugagcuucauggagcugcugagcgcccacagaagagacagacagggcggccugaagaaguacagcagauaccugagccugcagaccaccacccugccccccgcccagcccgccuucaaccugcaggcccugggcaccuacuucgagggccugcuggagggccccgcccuggccagagccgagggcgugagcaccccccuggccggcagaggccuggccgagagagccagccagcagagcuga

SEQ ID NO: 3162 - RNA, 2649 nt, Artificial Sequence
  derived and/or modified sequence opt5 from PML__Homo_sapiens__CCDS10255.1
auggagcccgccccugcuagaagcccgcggccccagcaagacccugcccgcccccaggaaccuaccaugcccccuccggagacacccuccgaaggcagacagccuucucccagcccuucccccacggagcgggcgccggcuucugaagaggaguuccaguuucugcgcugccaacagugucaggccgaagccaagugcccuaaacuccugcccugucuucacacccugugcagcgggugucucgaggcuuccggaaugcagugcccuaucugucaagcccccuggccccugggcgcugauaccccugcccuugacaacguguucuuugaaucucugcagagacggcucagcgucuaccgccagauuguugaugcgcaggccgugugcacaagauguaaggaguccgcugacuucuggugcuuugagugugaacaacugcugugcgccaaaugcuucgaggcucaucagugguuucucaagcacgaagcccggccgcuggcggagcuucgcaaucagagcgugagagaauuucuggaugggacacggaaaaccaacaauaucuuuuguucuaaccccaaucaucgcacaccuacccucacguccauuuauugcagaggauguagcaagccccugugcuguucuugcgcccuucuggacuccagccacucugagcucaagugugauaucuccgcugagauucaacagcggcaggaggagcuggacgccaugacccaggcucugcaagaacaggauagcgccuucggcgccguccaugcucagaugcacgcggccguggggcagcucggacgcgcuagagccgagacagaggaacugauccgggagagaguucgccaaguggucgcccacgugcgggcucaggaaagagagcuucuggaagccguugacgcgcgcuaccagcgggauuaugaggaaauggcuuccagacucggccgccuggacgccgugcuucagcggaucagaaccggcucugcccugguccaacgcaugaaaugcuacgcuagcgaucaggaggugcucgacaugcauggguuucugcggcaggcccuguguagacuccgccaggaggaaccucaaucccugcaggcugccgugcggacagacggauucgaugaguuuaaggucagacuucaggaccugagcucuugcauuacccaaggcaaagaugcggccguuuccaagaaagcuagccccgaagccgcuucuacgccgcgggacccuaucgauguggaccuccccgaggaggccgaacgcgugaaggcgcagguccaggcccuggggcuugcugaggcccagccuauggcugugguucaaagcgugcccggagcccacccuguccccguguaugccuucuccauuaagggcccgucuuacggggaagauguuagcaacacaaccacagcucagaaaagaaaguguucccagacccagugcccucggaaagugaucaagauggagagcgaagagggaaaagaggcgagacuggcccggucuucccccgaacaaccccgcccuagcaccucuaaggcugucuccccgccccaucucgacggcccucccagcccuagaucccccgugauuggcucugaggucuuccugccuaauagcaaccacguggccuccggggccggagaagcugaggaacgcguuguggucaucucuagcuccgaggauagcgacgccgaaaauucuuccagcagagaacuggaugacucuuccagcgagucuagcgaccuccagcuggaaggccccuccacacuucgggugcuggaugagaaccucgcggacccgcaggcugaagaucgcccucugguuuucuucgaccugaaaauugauaaugagacgcagaagaucagccaacuugccgccgugaacagagagucuaaguuucgggucgugauccagcccgaggcuuucuuuuccauuuauagcaaagccgugucccucgaaguugggcugcagcacuuccugucuuuucucagcuccaugcgcagaccuauccuggcgugcuacaaacuuuggggacccggccugccgaauuucuuucgggcucucgaagacauuaaccgccugugggaguuccaagaggccaucucuggguuucuggccgcccuuccucucauuagagaacggguccccggagcuagcuccuucaagcugaagaaucuggcucagaccuaccucgcccgcaacaugucugagagaagcgcgauggccgcugugcuggccaugcgggaucuuuguagacugcucgaaguguccccuggcccccagcuggcucagcaugucuaucccuuuagcucucugcaaugcuucgccucccuucagccucucgugcaggccgcuguucugccgcgcgcggaggcccggcugcucgcucugcacaacgugagcuucauggaacuucugucugcccauagacgcgaccggcagggcgggcucaaaaaguacuccagauaucugagccugcaaacaaccacacuucccccugcccagcccgcuuuuaaucuccaggcccugggaaccuacuucgagggccugcucgaggggccugcgcuggcucgcgccgaaggagucucuacgccccuugccggccgggggcuggcugagagagccucccagcaaagcuga

SEQ ID NO: 3163 - protein, 1075 aa, Artificial Sequence
  POTEF__Homo_sapiens__A5A3E0
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSSKSKVGAWGDYDDSAFMEPRYHVRGEDLDKLHRAAWWGKVPRKDLIVMLRDTDVNKQDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDREVEEEMKKHESNNVGLLENLTNGVTAGNGDNGLIPQRKSRTPENQQFPDNESEEYHRICELLSDYKEKQMPKYSSENSNPEQDLKLTSEEESQRLKGSENGQPEKRSQEPEINKDGDRELENFMAIEEMKKHRSTHVGFPENLTNGATAGNGDDGLIPPRKSRTPESQQFPDTENEEYHSDEQNDTQKQFCEEQNTGILHDEILIHEEKQIEVVEKMNSELSLSCKKEKDILHENSTLREEIAMLRLELDTMKHQSQLREKKYLEDIESVKKRNDNLLKALQLNELTMDDDTAVLVIDNGSGMCKAGFAGDDAPRAVFPSIVGRPRQQGMMGGMHQKESYVGKEAQSKRGILTLKYPMEHGIITNWDDMEKIWHHTFYNELRVAPEEHPVLLTEATLNPKANREKMTQIMFETFNTPAMYVAIQAVLSLYTSGRTTGIVMDSGDGVTHTVPIYEGNALPHATLRLDLAGRELPDYLMKILTEHGYRFTTMAEREIVRDIKEKLCYVALDFEQEMATVASSSSLEKSYELPDGQVITIGNERFRCPEALFQPCFLGMESCGIHETTFNSIMKSDVDIRKDLYTNTVLSGGTTMYPGMAHRMQKEIAALAPSMMKIRIIAPPKRKYSVWVGGSILASLSTFQQMWISKQEYDESGPSIVHRKCL

SEQ ID NO: 3164 - RNA, 3228 nt, Artificial Sequence
  POTEF__Homo_sapiens__CCDS46409.1
auggugguugagguugauuccaugccggcugccucuucugugaagaagccauuuggucucaggagcaagaugggcaaguggugcugccguugcuuccccugcugcagggagagcggcaagagcaacgugggcacuucuggagaccacgacgacucugcuaugaagacacucaggagcaagaugggcaaguggugccgccacugcuuccccugcugcagggggaguggcaagagcaacgugggcgcuucuggagaccacgacgacucugcuaugaagacacucaggaacaagaugggcaaguggugcugccacugcuuccccugcugcagggggagcagcaagagcaaggugggcgcuuggggagacuacgaugacagugccuucauggagcccagguaccacguccguggagaagaucuggacaagcuccacagagcugccuggugggguaaaguccccagaaaggaucucaucgucaugcucagggacacugacgugaacaagcaggacaagcaaaagaggacugcucuacaucuggccucugccaaugggaauucagaaguaguaaaacuccugcuggacagacgaugucaacuuaauguccuugacaacaaaaagaggacagcucugauaaaggccguacaaugccaggaagaugaaugugcguuaauguugcuggaacauggcacugauccaaauauuccagaugaguauggaaauaccacucugcacuacgcuaucuauaaugaagauaaauuaauggccaaagcacugcucuuauauggugcugauaucgaaucaaaaaacaagcauggccucacaccacuguuacuugguguacaugagcaaaaacagcaagucgugaaauuuuuaauuaagaaaaaagcgaauuuaaaugcacuggauagauauggaagaacugcucucauacuugcuguauguuguggaucagcaaguauagucagccuucuacuugagcaaaauauugauguaucuucucaagaucuaucuggacagacggccagagaguaugcuguuucuagucaucaucauguaauuugccaguuacuuucugacuacaaagaaaaacagaugcuaaaaaucucuucugaaaacagcaauccagaacaagacuuaaagcugacaucagaggaagagucacaaagguucaaaggcagugaaaauagccagccagagaaaaugucucaagaaccagaaauaaauaaggauggugauagagagguugaagaagaaaugaagaagcaugaaaguaauaaugugggauuacuagaaaaccugacuaauggugucacugcuggcaauggugauaauggauuaauuccucaaaggaagagcagaacaccugaaaaucagcaauuuccugacaacgaaagugaagaguaucacagaauuugugaauuacuuucugacuacaaagaaaagcagaugccaaaauacucuucugaaaacagcaacccagaacaagacuuaaagcugacaucagaggaagagucacaaaggcuuaaaggcagugaaaauggccagccagagaaaagaucucaagaaccagaaauaaauaaggauggugauagagagcuagaaaauuuuauggcuaucgaagaaaugaagaagcacagaaguacucaugucggauucccagaaaaccugacuaauggugccacugcuggcaauggugaugauggauuaauuccuccaaggaagagcagaacaccugaaagccagcaauuuccugacacugagaaugaagaguaucacagugacgaacaaaaugauacucagaagcaauuuugugaagaacagaacacuggaauauuacacgaugagauucugauucaugaagaaaagcagauagaagugguugaaaaaaugaauucugagcuuucucuuaguuguaagaaagaaaaagacaucuugcaugaaaauaguacguugcgggaagaaauugccaugcuaagacuggagcuagacacaaugaaacaucagagccagcuaagagaaaagaaauauuuggaggauauugaaagugugaaaaaaaggaaugauaaucuuuuaaaggcucuacaauugaaugagcucaccauggaugaugauaccgcugugcucgucauugacaacggcucuggcaugugcaaggccggcuuugcgggcgacgaugccccccgggcugucuucccuuccaucguggggcgccccaggcagcagggcaugauggggggcaugcaucagaaagaguccuaugugggcaaggaggcccagagcaaaagaggcauccugacccugaaguaccccauggaacacggcaucaucaccaacugggaugacauggagaagaucuggcaccacaccuucuacaacgagcugcguguggcucccgaggagcaccccguccugcugaccgaggccacccugaacccuaaggccaaccgcgagaagaugacccagaucauguuugagaccuucaacaccccagccauguacguggccauccaggcugugcugucccuguacaccucuggccguacuacuggcaucgugauggacucuggugacggggucacccacacugugcccaucuaugaggggaaugcccucccccaugccacccugcgccuagaccuggcugggcgggaacugccugacuaccucaugaagauccucaccgagcauggcuauagguucaccaccauggccgagcgggaaaucgugcgugacaucaaagagaagcugugcuauguugcccuggacuucgagcaggagauggccacgguggccuccagcuccucccuagagaagagcuacgagcugcccgauggccaggucaucaccaucggcaacgagcgguuccgcugccccgaggcgcucuuccagccuugcuuccugggcauggaauccuguggcauccaugaaacuaccuucaacuccaucaugaagucugauguggacauccgcaaagaccuguacaccaacacagugcugucuggcggcaccaccauguacccuggcauggcccacagaaugcagaaggagaucgcugcccuggcgccuagcaugaugaagaucaggaucauugcuccucccaagcgcaaguacuccgugugggucgguggcuccauccuggccucgcuguccaccuuccagcagauguggaucagcaagcaggaguaugaugagucaggccccuccauuguccaccgcaaaugcuuguag

SEQ ID NO: 3165 - RNA, 3228 nt, Artificial Sequence
  derived and/or modified sequence opt1 from POTEF__Homo_sapiens__CCDS46409.1
augguggucgagguggacagcaugcccgccgccuccagcgugaagaagcccuucggccugcgcuccaagauggggaaguggugcugccggugcuuccccugcugccgcgagagcggcaaguccaacgucgggaccagcggcgaccacgacgacuccgcgaugaagacccuccggagcaagauggggaaguggugccgccacugcuuccccugcugccggggcuccggcaagagcaacgugggggccuccggcgaccacgacgacagcgccaugaagacgcugcgcaacaagauggggaaguggugcugccacugcuuccccugcugccggggcuccagcaaguccaaggugggggccuggggcgacuacgacgacagcgccuucauggagccgcgcuaccacguccggggcgaggaccuggacaagcuccaccgcgcggccuggugggggaaggugccccggaaggaccugaucgugaugcugcgcgacaccgacgucaacaagcaggacaagcagaagcggaccgcccuccaccuggccuccgcgaacggcaacagcgagguggugaagcugcuccuggaccgccggugccagcugaacguccucgacaacaagaagcgcaccgcccugaucaaggccgugcagugccaggaggacgagugcgcccugaugcuccuggagcacgggacggaccccaacauccccgacgaguacggcaacaccacccugcacuacgccaucuacaacgaggacaagcucauggcgaaggcccugcugcucuacggcgccgacaucgaguccaagaacaagcacgggcugaccccgcugcuccugggcgugcacgagcagaagcagcaggucgugaaguuccugaucaagaagaaggccaaccucaacgcccuggaccgguacgggcgcacggcgcugauccucgccgugugcugcggcagcgccagcaucgucucccugcugcucgagcagaacaucgacgugagcucccaggaccugagcgggcagaccgcccgggaguacgccguguccagccaccaccacgucaucugccagcugcucuccgacuacaaggagaagcagaugcugaagaucagcuccgagaacagcaaccccgagcaggaccugaagcucaccuccgaggaggagagccagcgcuucaagggcuccgagaacagccagcccgagaagaugucccaggagcccgagaucaacaaggacggcgaccgggagguggaggaggagaugaagaagcacgagagcaacaacguggggcugcuggagaaccucaccaacggcgucacggcggggaacggcgacaacgggcugaucccgcagcgcaagucccgcacccccgagaaccagcaguuccccgacaacgagagcgaggaguaccaccggaucugcgagcugcucuccgacuacaaggagaagcagaugcccaaguacagcagcgagaacuccaacccggagcaggaccugaagcugaccagcgaggaggagucccagcgccucaagggcagcgagaacggccagcccgagaagcggucccaggagcccgagaucaacaaggacggggaccgcgagcuggagaacuucauggccaucgaggagaugaagaagcaccggagcacccacgugggcuuccccgagaaccugacgaacggggccaccgccggcaacggggacgacggccugaucccgccccgcaagucccggacccccgagagccagcaguuccccgacaccgagaacgaggaguaccacuccgacgagcagaacgacacgcagaagcaguucugcgaggagcagaacaccggcauccuccacgacgagauccugauccacgaggagaagcagaucgaggucguggagaagaugaacagcgagcugucccucagcugcaagaaggagaaggacauccugcacgagaacuccacccugcgcgaggagaucgccaugcuccggcuggagcuggacaccaugaagcaccagagccagcuccgcgagaagaaguaccuggaggacaucgaguccgugaagaagcggaacgacaaccugcucaaggcgcugcagcugaacgagcucacgauggacgacgacaccgccguccuggugaucgacaacgggagcggcaugugcaaggccggguucgccggcgacgacgcgccgcgcgccguguuccccuccaucgucggccggccccgccagcaggggaugaugggcgggaugcaccagaaggagagcuacgugggcaaggaggcccagagcaagcgggggauccugacccucaaguaccccauggagcacggcaucaucaccaacugggacgacauggagaagaucuggcaccacacguucuacaacgagcugcgcguggccccggaggagcaccccguccugcucaccgaggccacccugaaccccaaggcgaaccgggagaagaugacccagaucauguucgagacguucaacaccccggccauguacguggccauccaggccgugcugucccucuacaccagcggccgcaccacggggaucgucauggacuccggcgacggggugacccacaccgugcccaucuacgagggcaacgcccugccccacgcgacccugcggcucgaccuggccgggcgcgagcugcccgacuaccucaugaagauccugaccgagcacggcuaccgcuucacgaccauggccgagcgggagaucguccgcgacaucaaggagaagcugugcuacguggcccucgacuucgagcaggagauggccaccguggcgagcuccagcucccuggagaaguccuacgagcugccggacggccaggucaucaccaucgggaacgagcgguuccgcugccccgaggcccucuuccagcccugcuuccugggcauggagagcugcgggauccacgagacgaccuucaacagcaucaugaaguccgacguggacauccggaaggaccuguacaccaacaccgugcucagcggcgggacgaccauguaccccggcauggcccaccgcaugcagaaggagaucgccgcgcuggccccguccaugaugaagauccggaucaucgccccgcccaagcgcaaguacagcgucugggugggcggguccauccuggccagccucuccaccuuccagcagauguggaucagcaagcaggaguacgacgaguccggccccagcaucgugcaccggaagugccuguga

SEQ ID NO: 3166 - RNA, 3228 nt, Artificial Sequence
  derived and/or modified sequence opt2 from POTEF__Homo_sapiens__CCDS46409.1
auggucgucgaggucgacuccaugcccgccgccuccuccgucaagaagcccuucggccuccgcuccaagaugggcaaguggugcugccgcugcuuccccugcugccgcgaguccggcaaguccaacgucggcaccuccggcgaccacgacgacuccgccaugaagacccuccgcuccaagaugggcaaguggugccgccacugcuuccccugcugccgcggcuccggcaaguccaacgucggcgccuccggcgaccacgacgacuccgccaugaagacccuccgcaacaagaugggcaaguggugcugccacugcuuccccugcugccgcggcuccuccaaguccaaggucggcgccuggggcgacuacgacgacuccgccuucauggagccccgcuaccacguccgcggcgaggaccucgacaagcuccaccgcgccgccugguggggcaaggucccccgcaaggaccucaucgucaugcuccgcgacaccgacgucaacaagcaggacaagcagaagcgcaccgcccuccaccucgccuccgccaacggcaacuccgaggucgucaagcuccuccucgaccgccgcugccagcucaacguccucgacaacaagaagcgcaccgcccucaucaaggccguccagugccaggaggacgagugcgcccucaugcuccucgagcacggcaccgaccccaacauccccgacgaguacggcaacaccacccuccacuacgccaucuacaacgaggacaagcucauggccaaggcccuccuccucuacggcgccgacaucgaguccaagaacaagcacggccucaccccccuccuccucggcguccacgagcagaagcagcaggucgucaaguuccucaucaagaagaaggccaaccucaacgcccucgaccgcuacggccgcaccgcccucauccucgccgucugcugcggcuccgccuccaucgucucccuccuccucgagcagaacaucgacgucuccucccaggaccucuccggccagaccgcccgcgaguacgccgucuccucccaccaccacgucaucugccagcuccucuccgacuacaaggagaagcagaugcucaagaucuccuccgagaacuccaaccccgagcaggaccucaagcucaccuccgaggaggagucccagcgcuucaagggcuccgagaacucccagcccgagaagaugucccaggagcccgagaucaacaaggacggcgaccgcgaggucgaggaggagaugaagaagcacgaguccaacaacgucggccuccucgagaaccucaccaacggcgucaccgccggcaacggcgacaacggccucaucccccagcgcaagucccgcacccccgagaaccagcaguuccccgacaacgaguccgaggaguaccaccgcaucugcgagcuccucuccgacuacaaggagaagcagaugcccaaguacuccuccgagaacuccaaccccgagcaggaccucaagcucaccuccgaggaggagucccagcgccucaagggcuccgagaacggccagcccgagaagcgcucccaggagcccgagaucaacaaggacggcgaccgcgagcucgagaacuucauggccaucgaggagaugaagaagcaccgcuccacccacgucggcuuccccgagaaccucaccaacggcgccaccgccggcaacggcgacgacggccucauccccccccgcaagucccgcacccccgagucccagcaguuccccgacaccgagaacgaggaguaccacuccgacgagcagaacgacacccagaagcaguucugcgaggagcagaacaccggcauccuccacgacgagauccucauccacgaggagaagcagaucgaggucgucgagaagaugaacuccgagcucucccucuccugcaagaaggagaaggacauccuccacgagaacuccacccuccgcgaggagaucgccaugcuccgccucgagcucgacaccaugaagcaccagucccagcuccgcgagaagaaguaccucgaggacaucgaguccgucaagaagcgcaacgacaaccuccucaaggcccuccagcucaacgagcucaccauggacgacgacaccgccguccucgucaucgacaacggcuccggcaugugcaaggccggcuucgccggcgacgacgccccccgcgccgucuuccccuccaucgucggccgcccccgccagcagggcaugaugggcggcaugcaccagaaggaguccuacgucggcaaggaggcccaguccaagcgcggcauccucacccucaaguaccccauggagcacggcaucaucaccaacugggacgacauggagaagaucuggcaccacaccuucuacaacgagcuccgcgucgcccccgaggagcaccccguccuccucaccgaggccacccucaaccccaaggccaaccgcgagaagaugacccagaucauguucgagaccuucaacacccccgccauguacgucgccauccaggccguccucucccucuacaccuccggccgcaccaccggcaucgucauggacuccggcgacggcgucacccacaccguccccaucuacgagggcaacgcccucccccacgccacccuccgccucgaccucgccggccgcgagcuccccgacuaccucaugaagauccucaccgagcacggcuaccgcuucaccaccauggccgagcgcgagaucguccgcgacaucaaggagaagcucugcuacgucgcccucgacuucgagcaggagauggccaccgucgccuccuccuccucccucgagaaguccuacgagcuccccgacggccaggucaucaccaucggcaacgagcgcuuccgcugccccgaggcccucuuccagcccugcuuccucggcauggaguccugcggcauccacgagaccaccuucaacuccaucaugaaguccgacgucgacauccgcaaggaccucuacaccaacaccguccucuccggcggcaccaccauguaccccggcauggcccaccgcaugcagaaggagaucgccgcccucgcccccuccaugaugaagauccgcaucaucgccccccccaagcgcaaguacuccgucugggucggcggcuccauccucgccucccucuccaccuuccagcagauguggaucuccaagcaggaguacgacgaguccggccccuccaucguccaccgcaagugccucuga

SEQ ID NO: 3167 - RNA, 3228 nt, Artificial Sequence
  derived and/or modified sequence opt3 from POTEF__Homo_sapiens__CCDS46409.1
augguggucgagguugacagcaugcccgccgcuuccucugugaagaaaccuuucggccugagaucaaagauggggaaauggugcuguaggugcuuuccauguugccgggaaaguggaaagagcaacguagguaccuccggcgaucacgacgauucugcaaugaaaacacuccgcucgaagauggggaaguggugucgacauugcuucccguguugccguggaucaggcaaaagcaaugugggugccaguggggaccacgaugacuccgcgaugaagacucuuagaaacaaaaugggaaagugguguugccauuguuuucccugcugcaggggcucuagcaaauccaaggucggcgcuuggggagauuacgacgauucagccuucauggagccucgguaucacgugcgcggggaagaccuggauaaguugcauagagcagccuggugggguaaaguuccaaggaaggacuuaaucgugaugcugcgggauacggacgucaauaaacaggacaagcaaaaacgcaccgcucuacaccucgcaagugccaacggcaauagcgaggugguaaagcugcuucuggaucgaagaugucaguugaacguucucgacaauaaaaagaggacagcucugauuaaggccgugcagugccaggaagaugagugugcgcugaugcucuuagagcacgggacugaccccaacauaccugaugaauacggaaauaccacacugcauuaugcaaucuacaacgaggacaaacuuauggccaaggcuuugcugcuauauggcgccgauauugaaucuaaaaauaagcacggucucaccccacugcuucuggggguccaugagcaaaaacaacagguggugaaguuuuugaucaagaaaaaggcaaaccucaaugcucuggaccgguacggacguacugccuuaauucuggcggucugcuguggcuccgccucaaucguuagccuccuucuggagcagaacauagaugugaguucucaggacuuguccggccagacagcacgcgaauaugcuguaagcucgcaccaccaugugaucugccagcuacugucugauuacaaagagaagcagaugcucaaaauuuccucagaaaauaguaaccccgagcaagaccugaaacuuaccagcgaagaggagucccagagauucaaggggucugaaaacagccagccugagaagaugucacaagaaccagagaucaauaaggacggagauagggaagucgaggaggaaaugaaaaagcacgagaguaacaaugugggucuguuggaaaaccucacgaauggcguuacugccgggaacggagacaauggccugauuccgcagcggaaaucccgaacccccgagaaccagcaguuuccugauaaugaaagcgaggaguaccaucgcaucugugaauuacugucugacuauaaggagaagcaaaugccaaaauacucaagugaaaacagcaaucccgagcaggaucuaaagcucacauccgaggaagagucucagagacugaaagguucggaaaacgggcagccugagaagaggagccaagaaccagagauaaauaaagacggcgaucgggagcuugaaaacuucauggcuauugaggaaaugaagaaacaccgcuccacucaugugggauuucccgagaauuugaccaacggcgccacagcagggaacggagacgauggucugaucccgccuagaaagucaaggacccccgaaagucagcaguucccagacacggagaaugaggaauaucacucugaugagcagaacgacacucaaaagcaguuuugcgaggaacagaauacaggcauucuccacgaugaaauccugauccaugaggagaaacagauugaagucguggagaagaugaacagcgaacuuucccugucauguaaaaaggagaaagacauauugcacgagaauagcacccuccgugaagagaucgccaugcugcgguuagaacuggacacuaugaagcaucaaucucagcuacgagagaagaaauaccucgaagauauugaguccguaaagaaaagaaacgacaaucugcuuaaggcuuugcagcugaacgagcucacaauggaugacgauaccgcgguucuggugaucgacaaugggaguggaaugugcaaagcaggcuucgccggugaugacgcuccuagggccgucuuucccagcauaguggggcgcccacggcaacagggcaugaugggaggcaugcaccagaaggaaucuuaugucgggaaggaggcacaguccaaaagaggaauuuuaacgcugaaguaccccauggaacacgguaucaucaccaacugggaugacauggagaaaauuuggcaucacacauucuauaaugaacuuaggguggccccugaggagcauccaguuuugcucacugaagcuacccugaacccgaaggccaaucgcgagaaaaugacacaaaucauguucgaaacuuuuaacacccccgcaauguacguggcgauucaggcuguacuaucacuguacacaaguggccgaaccacugggauagucauggauagcggagacggcgugacgcacacaguuccuaucuaugaggguaaugcccucccacaugcaacccugcggcuugauuuggccgggcgugaacugcccgacuacuuaaugaagauucucacugagcacggcuauagauucaccacaauggcugagagggaaaucgugcgcgacaucaaggagaaacuguguuacgucgcccuugauuuugaacaggagauggcaaccguggcuucguccucuagccuggagaagucauaugaauugccugacggacagguaauuacuauaggcaacgagcgguucagaugcccagaagcccucuuucaacccugcuuccuggggauggagaguuguggaauccacgaaacaacguuuaacuccauuaugaaaucugauguggacaucaggaaggaucuauacaccaauacuguucugagcggcgguacaaccauguauccggggauggcgcaucgaaugcagaaagagauugccgcucucgcaccuuccaugaugaagauccgcauaaucgccccacccaaacggaaguacucagucugggugggaggcagcauucuggcuagucuuucuacauuccagcagauguggaucuccaagcaagaguacgacgaaagcgguccuucgauugugcacagaaaaugcuuguga

SEQ ID NO: 3168 - RNA, 3228 nt, Artificial Sequence
  derived and/or modified sequence opt4 from POTEF__Homo_sapiens__CCDS46409.1
auggugguggagguggacagcaugcccgccgccagcagcgugaagaagcccuucggccugagaagcaagaugggcaaguggugcugcagaugcuuccccugcugcagagagagcggcaagagcaacgugggcaccagcggcgaccacgacgacagcgccaugaagacccugagaagcaagaugggcaaguggugcagacacugcuuccccugcugcagaggcagcggcaagagcaacgugggcgccagcggcgaccacgacgacagcgccaugaagacccugagaaacaagaugggcaaguggugcugccacugcuuccccugcugcagaggcagcagcaagagcaaggugggcgccuggggcgacuacgacgacagcgccuucauggagcccagauaccacgugagaggcgaggaccuggacaagcugcacagagccgccugguggggcaaggugcccagaaaggaccugaucgugaugcugagagacaccgacgugaacaagcaggacaagcagaagagaaccgcccugcaccuggccagcgccaacggcaacagcgagguggugaagcugcugcuggacagaagaugccagcugaacgugcuggacaacaagaagagaaccgcccugaucaaggccgugcagugccaggaggacgagugcgcccugaugcugcuggagcacggcaccgaccccaacauccccgacgaguacggcaacaccacccugcacuacgccaucuacaacgaggacaagcugauggccaaggcccugcugcuguacggcgccgacaucgagagcaagaacaagcacggccugaccccccugcugcugggcgugcacgagcagaagcagcagguggugaaguuccugaucaagaagaaggccaaccugaacgcccuggacagauacggcagaaccgcccugauccuggccgugugcugcggcagcgccagcaucgugagccugcugcuggagcagaacaucgacgugagcagccaggaccugagcggccagaccgccagagaguacgccgugagcagccaccaccacgugaucugccagcugcugagcgacuacaaggagaagcagaugcugaagaucagcagcgagaacagcaaccccgagcaggaccugaagcugaccagcgaggaggagagccagagauucaagggcagcgagaacagccagcccgagaagaugagccaggagcccgagaucaacaaggacggcgacagagagguggaggaggagaugaagaagcacgagagcaacaacgugggccugcuggagaaccugaccaacggcgugaccgccggcaacggcgacaacggccugaucccccagagaaagagcagaacccccgagaaccagcaguuccccgacaacgagagcgaggaguaccacagaaucugcgagcugcugagcgacuacaaggagaagcagaugcccaaguacagcagcgagaacagcaaccccgagcaggaccugaagcugaccagcgaggaggagagccagagacugaagggcagcgagaacggccagcccgagaagagaagccaggagcccgagaucaacaaggacggcgacagagagcuggagaacuucauggccaucgaggagaugaagaagcacagaagcacccacgugggcuuccccgagaaccugaccaacggcgccaccgccggcaacggcgacgacggccugaucccccccagaaagagcagaacccccgagagccagcaguuccccgacaccgagaacgaggaguaccacagcgacgagcagaacgacacccagaagcaguucugcgaggagcagaacaccggcauccugcacgacgagauccugauccacgaggagaagcagaucgaggugguggagaagaugaacagcgagcugagccugagcugcaagaaggagaaggacauccugcacgagaacagcacccugagagaggagaucgccaugcugagacuggagcuggacaccaugaagcaccagagccagcugagagagaagaaguaccuggaggacaucgagagcgugaagaagagaaacgacaaccugcugaaggcccugcagcugaacgagcugaccauggacgacgacaccgccgugcuggugaucgacaacggcagcggcaugugcaaggccggcuucgccggcgacgacgcccccagagccguguuccccagcaucgugggcagacccagacagcagggcaugaugggcggcaugcaccagaaggagagcuacgugggcaaggaggcccagagcaagagaggcauccugacccugaaguaccccauggagcacggcaucaucaccaacugggacgacauggagaagaucuggcaccacaccuucuacaacgagcugagaguggcccccgaggagcaccccgugcugcugaccgaggccacccugaaccccaaggccaacagagagaagaugacccagaucauguucgagaccuucaacacccccgccauguacguggccauccaggccgugcugagccuguacaccagcggcagaaccaccggcaucgugauggacagcggcgacggcgugacccacaccgugcccaucuacgagggcaacgcccugccccacgccacccugagacuggaccuggccggcagagagcugcccgacuaccugaugaagauccugaccgagcacggcuacagauucaccaccauggccgagagagagaucgugagagacaucaaggagaagcugugcuacguggcccuggacuucgagcaggagauggccaccguggccagcagcagcagccuggagaagagcuacgagcugcccgacggccaggugaucaccaucggcaacgagagauucagaugccccgaggcccuguuccagcccugcuuccugggcauggagagcugcggcauccacgagaccaccuucaacagcaucaugaagagcgacguggacaucagaaaggaccuguacaccaacaccgugcugagcggcggcaccaccauguaccccggcauggcccacagaaugcagaaggagaucgccgcccuggcccccagcaugaugaagaucagaaucaucgccccccccaagagaaaguacagcgugugggugggcggcagcauccuggccagccugagcaccuuccagcagauguggaucagcaagcaggaguacgacgagagcggccccagcaucgugcacagaaagugccuguga

SEQ ID NO: 3169 - RNA, 3228 nt, Artificial Sequence
  derived and/or modified sequence opt5 from POTEF__Homo_sapiens__CCDS46409.1
augguggucgagguugacagcaugcccgccgcuuccucugugaagaaaccuuucggccugagaagcaagauggggaaauggugcugucggugcuuuccguguugccgcgaauccggaaagucuaacgugggcaccagcggggaucacgacgauuccgccaugaaaacacucagaucuaagaugggaaaguggugucggcauugcuuccccuguugccgcggcagcgggaaauccaaugucggagcgagcggcgaccacgaugacucugcuaugaagacgcugagaaacaaaaugggcaagugguguugccauuguuuuccuugcugccggggguccagcaaaucuaaggugggagccuggggcgauuacgacgauuccgccuucauggagccccgcuaucacguuagaggggaagaccuugauaagcugcaucgggcugccugguggggaaaagugccucgcaaggaccucaucgucaugcugagagauaccgacgugaauaaacaggacaagcaaaaacggacagcccuucaccuggcuagcgcgaacggcaauucugagguugugaagcuccugcuggaucgcagaugucagcucaacguccuggacaauaaaaagcggaccgcccuuauuaaggcugugcagugccaggaagaugagugugcccugaugcuccuggagcacgggacagaccccaacaucccugaugaauacggaaauaccacacuucauuaugcuauuuacaacgaggacaaacugauggccaaggcgcuccugcuguauggcgccgauaucgaauccaaaaauaagcacggccucaccccgcugcuucugggggugcaugagcaaaaacagcaggucguuaaguuucucauuaagaaaaaggcuaaccugaaugcccuugaccgcuacggaagaacggcucugauccucgccgugugcuguggcagcgccuccaucgugucucugcugcucgagcagaacauugaugucagcucccaagaccugagcgggcagaccgcucgggaauaugcggugucuucccaccaccauguuaucugccagcuucugagcgauuacaaagagaagcagaugcucaaaauuucuagcgaaaauuccaaccccgagcaagaccugaaacuuacaucugaagaggagagccagagauucaagggauccgaaaacagccagccugagaagaugucucaagaacccgagaucaauaaggacggcgaucgcgaaguggaggaggaaaugaaaaagcacgaguccaacaaugucgggcugcucgaaaaccugaccaauggagugacagccggcaacggcgacaaugggcugauuccucagcggaaaagcagaacccccgagaaccagcaguuuccggauaaugaaucugaggaguaccaucgcaucugugaacuccuguccgacuauaaggagaagcaaaugccuaaauacagcuccgaaaacucuaaucccgagcaggaucuuaagcugacgagcgaggaagagucccagcggcucaaaggaucugaaaacggccagccugagaagagaagccaagaacccgagauuaauaaagacggggaucgcgagcuggaaaacuucauggcuaucgaggaaaugaagaaacaccgguccacacauguuggauuucccgagaaucugaccaacggcgccacagccgggaacggcgacgauggacuuaucccuccgagaaagagccgcacccccgaaucucagcaguucccugacaccgagaaugaggaauaucacuccgaugagcagaacgacacacaaaagcaguuuugcgaggaacagaauacgggcauucuccacgaugaaauccugauucaugaggagaaacagaucgaaguggucgagaagaugaacagcgaacugucucucuccuguaaaaaggagaaagacauucugcacgagaauagcacccuucgggaagagaucgcuaugcugagacucgaacuggacacaaugaagcaucaaucucagcugcgcgagaagaaauaccuugaagauaucgagagcgugaagaaacggaacgacaaucuccugaaggcccugcagcucaacgagcugaccauggaugacgauacagcgguccuugugauugacaauggguccggaaugugcaaagcuggcuucgccggggaugacgcccccagagcuguuuuuccuagcaucgugggacggccccgccaacagggcaugaugggcgggaugcaccagaaggaaucuuaugucggaaaggaggcccaguccaaaagaggcauucugacccucaaguacccgauggaacacgggaucauuacgaacugggaugacauggagaaaaucuggcaucacacauucuauaaugaacugcggguggcuccugaggagcaucccguucugcuuaccgaagccacccucaacccuaaggcgaauagagagaaaaugacacaaaucauguucgaaaccuuuaacacacccgccauguacguggcuauucaggccguccugagccuguacacguccggacgcaccacaggcaucgugauggauucuggggacggagugacccacacaguuccuauuuaugagggcaaugcucucccccaugccacccugcggcuugaucuggcggggagagaacucccggacuaccugaugaagauccugacggagcacggcuaucgcuucaccacaauggccgagagagaaauuguccgggacaucaaggagaaacuuuguuacguggcucucgauuuugaacaggagauggccaccguggcuagcuccucuagccuggagaaguccuaugaacugccugacggacaggucauuacaaucggcaacgagcgcuucagaugccccgaagcccucuuucaacccugcuuccuggggauggagucuuguggaauccacgaaaccacguuuaacagcauuaugaaauccgauguggacauccggaaggaucuuuacacaaauaccguucugagcggcgggacaaccauguauccuggaauggcccaucgcaugcagaaagagauugcugcgcucgccccgucuaugaugaagaucagaauuaucgcucccccuaaacggaaguacuccgugugggucggcgggagcauccuggccucucuguccaccuuccagcagauguggauuagcaagcaagaguacgacgaaucuggccccuccaucgugcaccgcaaaugccuuuga

SEQ ID NO: 3170 - protein, 584 aa, Artificial Sequence
  POTE__Homo_sapiens__Q86YR6
MVAEVCSMPTASTVKKPFDLRSKMGKWCHHRFPCCRGSGKSNMGTSGDHDDSFMKMLRSKMGKCCRHCFPCCRGSGTSNVGTSGDHENSFMKMLRSKMGKWCCHCFPCCRGSGKSNVGAWGDYDHSAFMEPRYHIRREDLDKLHRAAWWGKVPRKDLIVMLRDTDMNKRDKEKRTALHLASANGNSEVVQLLLDRRCQLNVLDNKKRTALIKAIQCQEDECVLMLLEHGADRNIPDEYGNTALHYAIYNEDKLMAKALLLYGADIESKNKCGLTPLLLGVHEQKQQVVKFLIKKKANLNVLDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEQKMNSELSLSHKKEEDLLRENSVLQEEIAMLRLELDETKHQNQLRENKILEEIESVKEKTDKLLRAMQLNEEALTKTNI

SEQ ID NO: 3171 - RNA, 1755 nt, Artificial Sequence
  POTE__Homo_sapiens__CCDS13562.1
augguggcugagguuuguucaaugcccacugccucuacugugaagaagccauuugaucucaggagcaagaugggcaaguggugccaccaccgcuuccccugcugcagggggagcggcaagagcaacaugggcacuucuggagaccacgacgacuccuuuaugaagaugcucaggagcaagaugggcaaguguugccgccacugcuuccccugcugcagggggagcggcacgagcaacgugggcacuucuggagaccaugaaaacuccuuuaugaagaugcucaggagcaagaugggcaaguggugcugucacugcuuccccugcugcagggggagcggcaagagcaacgugggcgcuuggggagacuacgaccacagcgccuucauggagccgagguaccacauccgucgagaagaucuggacaagcuccacagagcugccuggugggguaaaguccccagaaaggaucucaucgucaugcucagggacacugacaugaacaagagggacaaggaaaagaggacugcucuacauuuggccucugccaauggaaauucagaaguaguacaacuccugcuggacagacgaugucaacuuaauguccuugacaacaaaaaaaggacagcucugauaaaggccauacaaugccaggaagaugaauguguguuaauguugcuggaacauggcgcugaucgaaauauuccagaugaguauggaaauaccgcucuacacuaugcuaucuacaaugaagauaaauuaauggccaaagcacugcucuuauauggugcugauauugaaucaaaaaacaaguguggccucacaccacuuuugcuuggcguacaugaacaaaaacagcaaguggugaaauuuuuaaucaagaaaaaagcuaauuuaaauguacuugauagauauggaagaacugcccucauacuugcuguauguuguggaucagcaaguauagucaaucuucuacuugagcaaaauguugauguaucuucucaagaucuaucuggacagacggccagagaguaugcuguuucuagucaucaucauguaauuugugaauuacuuucugacuauaaagaaaaacagaugcuaaaaaucucuucugaaaacagcaauccagaacaagacuuaaagcugacaucagaggaagagucacaaaggcuuaaagucagugaaaauagccagccagagaaaaugucucaagaaccagaaauaaauaaggacugugauagagagguugaagaagaaauaaagaagcauggaaguaauccugugggauuaccagaaaaccugacuaauggugccagugcuggcaauggugaugauggauuaauuccacaaaggaggagcagaaaaccugaaaaucagcaauuuccugacacugagaaugaagaguaucacagugaugaacaaaaugauacccggaaacaacuuucugaagaacagaacacuggaauaucacaagaugagauucugacuaauaaacaaaagcagauagaaguggcugaacagaaaaugaauucugagcuuucucuuagucauaagaaagaagaagaucucuugcgugaaaacagcguguugcaggaagaaauugccaugcuaagacuggaacuagaugaaacaaaacaucagaaccagcuaagggaaaauaaaauuuuggaggaaauugaaagugugaaagaaaagacugauaaacuucuaagggcuaugcaauugaaugaagaagcauuaacgaaaaccaauauuuaa

SEQ ID NO: 3172 - RNA, 1755 nt, Artificial Sequence
  derived and/or modified sequence opt1 from POTE__Homo_sapiens__CCDS13562.1
augguggccgaggucugcagcaugcccaccgccuccaccgugaagaagccguucgaccugcgcagcaagaugggcaaguggugccaccaccgguuccccugcugccgcggguccggcaagagcaacauggggacguccggcgaccacgacgacagcuucaugaagaugcuccgguccaagauggggaagugcugccgccacugcuuccccugcugccggggcagcggcaccuccaacguggggaccagcggcgaccacgagaacuccuucaugaagaugcugcgcagcaagauggggaaguggugcugccacugcuuccccugcugccggggcuccggcaagagcaacgucggggcguggggcgacuacgaccacuccgccuucauggagccgcgcuaccacauccggcgcgaggaccuggacaagcuccaccgggccgccuggugggggaaggugccccgcaaggaccugaucgugaugcugcgggacaccgacaugaacaagcgcgacaaggagaagcggacggcccuccaccuggcgagcgccaacggcaacuccgaggucgugcagcugcuccuggaccgccggugccagcugaacgugcucgacaacaagaagcgcaccgcccugaucaaggccauccagugccaggaggacgagugcguccugaugcuccuggagcacggggcggaccggaacauccccgacgaguacggcaacaccgcccugcacuacgccaucuacaacgaggacaagcucauggccaaggcccugcugcucuacggcgcggacaucgagagcaagaacaagugcgggcugacgccccugcuccugggcgugcacgagcagaagcagcaggucgugaaguuccugaucaagaagaaggccaaccucaacgugcuggaccgcuacgggcggaccgcccugauccucgccgugugcugcggcuccgccagcaucgucaaccugcugcucgagcagaacguggacgugagcucccaggaccugagcgggcagaccgcgcgcgaguacgccgucuccagccaccaccacgugaucugcgagcugcucuccgacuacaaggagaagcagaugcugaagaucagcuccgagaacagcaacccggagcaggaccugaagcucaccuccgaggaggagagccagcgccugaagguguccgagaacagccagcccgagaagaugucccaggagcccgagaucaacaaggacugcgaccgggaggucgaggaggagaucaagaagcacggcagcaaccccgugggccugccggagaaccucaccaacggggccuccgccggcaacggggacgacggccugaucccccagcgccggagccgcaagcccgagaaccagcaguuccccgacacggagaacgaggaguaccacuccgacgagcagaacgacacccggaagcagcugagcgaggagcagaacaccgggaucucccaggacgagauccucaccaacaagcagaagcagaucgagguggccgagcagaagaugaacagcgagcugagccugucccacaagaaggaggaggaccuccugcgcgagaacagcguccugcaggaggagaucgcgaugcugcggcucgagcuggacgagacgaagcaccagaaccagcugcgcgagaacaagauccucgaggagaucgaguccgugaaggagaagaccgacaagcugcugcgggccaugcagcucaacgaggaggcccugaccaagaccaacaucuga

SEQ ID NO: 3173 - RNA, 1755 nt, Artificial Sequence
  derived and/or modified sequence opt2 from POTE__Homo_sapiens__CCDS13562.1
auggucgccgaggucugcuccaugcccaccgccuccaccgucaagaagcccuucgaccuccgcuccaagaugggcaaguggugccaccaccgcuuccccugcugccgcggcuccggcaaguccaacaugggcaccuccggcgaccacgacgacuccuucaugaagaugcuccgcuccaagaugggcaagugcugccgccacugcuuccccugcugccgcggcuccggcaccuccaacgucggcaccuccggcgaccacgagaacuccuucaugaagaugcuccgcuccaagaugggcaaguggugcugccacugcuuccccugcugccgcggcuccggcaaguccaacgucggcgccuggggcgacuacgaccacuccgccuucauggagccccgcuaccacauccgccgcgaggaccucgacaagcuccaccgcgccgccugguggggcaaggucccccgcaaggaccucaucgucaugcuccgcgacaccgacaugaacaagcgcgacaaggagaagcgcaccgcccuccaccucgccuccgccaacggcaacuccgaggucguccagcuccuccucgaccgccgcugccagcucaacguccucgacaacaagaagcgcaccgcccucaucaaggccauccagugccaggaggacgagugcguccucaugcuccucgagcacggcgccgaccgcaacauccccgacgaguacggcaacaccgcccuccacuacgccaucuacaacgaggacaagcucauggccaaggcccuccuccucuacggcgccgacaucgaguccaagaacaagugcggccucaccccccuccuccucggcguccacgagcagaagcagcaggucgucaaguuccucaucaagaagaaggccaaccucaacguccucgaccgcuacggccgcaccgcccucauccucgccgucugcugcggcuccgccuccaucgucaaccuccuccucgagcagaacgucgacgucuccucccaggaccucuccggccagaccgcccgcgaguacgccgucuccucccaccaccacgucaucugcgagcuccucuccgacuacaaggagaagcagaugcucaagaucuccuccgagaacuccaaccccgagcaggaccucaagcucaccuccgaggaggagucccagcgccucaaggucuccgagaacucccagcccgagaagaugucccaggagcccgagaucaacaaggacugcgaccgcgaggucgaggaggagaucaagaagcacggcuccaaccccgucggccuccccgagaaccucaccaacggcgccuccgccggcaacggcgacgacggccucaucccccagcgccgcucccgcaagcccgagaaccagcaguuccccgacaccgagaacgaggaguaccacuccgacgagcagaacgacacccgcaagcagcucuccgaggagcagaacaccggcaucucccaggacgagauccucaccaacaagcagaagcagaucgaggucgccgagcagaagaugaacuccgagcucucccucucccacaagaaggaggaggaccuccuccgcgagaacuccguccuccaggaggagaucgccaugcuccgccucgagcucgacgagaccaagcaccagaaccagcuccgcgagaacaagauccucgaggagaucgaguccgucaaggagaagaccgacaagcuccuccgcgccaugcagcucaacgaggaggcccucaccaagaccaacaucuga

SEQ ID NO: 3174 - RNA, 1755 nt, Artificial Sequence
  derived and/or modified sequence opt3 from POTE__Homo_sapiens__CCDS13562.1
augguggccgaggucugcagcaugcccaccgcuuccacaguuaagaaaccuuucgaccugagaucuaagaugggcaaauggugucaccauagguuuccaugcugucgggggucaggaaagaguaacauggguacuagcggcgaucacgacgauuccuucaugaaaaugcuccgcucuaagauggggaagugcugucgacauugcuuuccguguugccguggaucgggcacgucaaauguggguaccagcggggaccacgaaaacaguuucaugaaaaugcuuagauccaagaugggaaaaugguguugccauuguuuucccugcugcaggggcucuggcaagagcaauguaggggcauggggagauuacgaccacuccgccuucauggagccucgguaucacauccgcagagaagaucuggacaaauugcauagggcggcuuggugggguaaggugccacggaaggauuuaauugucaugcugcgcgacacagauaugaacaaacgagacaaggagaaaagaacugcccuacaccucgcaucagccaauggcaacagugaagugguucagcugcuucuggauaggcggugucaauugaaugugcucgacaacaagaaacguaccgcucugauaaaggcaauccagugccaggaggacgaguguguccugaugcucuuagaacauggggccgaucgcaauauucccgacgaguacggaaacacagcucugcacuaugccaucuacaaugaagauaaacuuauggcgaaggcauugcugcuauauggcgccgacauugagagcaagaacaaaugcggucucaccccucugcuucugggggugcacgagcagaagcaacagguaguuaaauuuuugaucaagaaaaaggcuaaucucaacgugcuggauagauacggaaggacugccuuaauacuggcagucuguugcggcucugcuuccaucgugaaucuccuucuggaacagaacguggacgucucaagccaggauuugaguggccaaacagcccgggaguaugcgguuucuucccaucaccaugugauuugugaacuacugagcgacuacaaggagaaacagaugcucaagaucucgucugaaaacuccaauccagagcaggaucugaaacuuaccucagaggaagagagucagcgacugaagguaagcgaaaacucccaacccgagaaaaugucucaggaaccugagauuaauaaggacugcgaucgcgagguggaagaggaaaucaagaaacacgggagcaacccagucggauugccggagaaucucacgaacggugccucagcaggcaauggggacgacggacugauaccccagagaaggagucggaagccugaaaaccaacaguucccagauacugagaaugaggaauaccauuccgacgagcagaacgauacccgcaaacaguuaagcgaagaacaaaauacaggcauuucucaggacgagauccugacuaacaagcagaaacagauugaaguggcugagcaaaagaugaauagugaacuaucacucagccacaagaaagaggaagaucugcuuagagagaacuccguuuugcaggaggaaaucgccaugcugaggcucgagcuggacgaaaccaagcaccagaaucagcuucgugagaacaaaauccuggaagagauugagucugugaaggagaaaacagauaaguugcuccgggcuaugcaacugaacgaggaagccuuaaccaaaacgaauauauga

SEQ ID NO: 3175 - RNA, 1755 nt, Artificial Sequence
  derived and/or modified sequence opt4 from POTE__Homo_sapiens__CCDS13562.1
augguggccgaggugugcagcaugcccaccgccagcaccgugaagaagcccuucgaccugagaagcaagaugggcaaguggugccaccacagauuccccugcugcagaggcagcggcaagagcaacaugggcaccagcggcgaccacgacgacagcuucaugaagaugcugagaagcaagaugggcaagugcugcagacacugcuuccccugcugcagaggcagcggcaccagcaacgugggcaccagcggcgaccacgagaacagcuucaugaagaugcugagaagcaagaugggcaaguggugcugccacugcuuccccugcugcagaggcagcggcaagagcaacgugggcgccuggggcgacuacgaccacagcgccuucauggagcccagauaccacaucagaagagaggaccuggacaagcugcacagagccgccugguggggcaaggugcccagaaaggaccugaucgugaugcugagagacaccgacaugaacaagagagacaaggagaagagaaccgcccugcaccuggccagcgccaacggcaacagcgagguggugcagcugcugcuggacagaagaugccagcugaacgugcuggacaacaagaagagaaccgcccugaucaaggccauccagugccaggaggacgagugcgugcugaugcugcuggagcacggcgccgacagaaacauccccgacgaguacggcaacaccgcccugcacuacgccaucuacaacgaggacaagcugauggccaaggcccugcugcuguacggcgccgacaucgagagcaagaacaagugcggccugaccccccugcugcugggcgugcacgagcagaagcagcagguggugaaguuccugaucaagaagaaggccaaccugaacgugcuggacagauacggcagaaccgcccugauccuggccgugugcugcggcagcgccagcaucgugaaccugcugcuggagcagaacguggacgugagcagccaggaccugagcggccagaccgccagagaguacgccgugagcagccaccaccacgugaucugcgagcugcugagcgacuacaaggagaagcagaugcugaagaucagcagcgagaacagcaaccccgagcaggaccugaagcugaccagcgaggaggagagccagagacugaaggugagcgagaacagccagcccgagaagaugagccaggagcccgagaucaacaaggacugcgacagagagguggaggaggagaucaagaagcacggcagcaaccccgugggccugcccgagaaccugaccaacggcgccagcgccggcaacggcgacgacggccugaucccccagagaagaagcagaaagcccgagaaccagcaguuccccgacaccgagaacgaggaguaccacagcgacgagcagaacgacaccagaaagcagcugagcgaggagcagaacaccggcaucagccaggacgagauccugaccaacaagcagaagcagaucgagguggccgagcagaagaugaacagcgagcugagccugagccacaagaaggaggaggaccugcugagagagaacagcgugcugcaggaggagaucgccaugcugagacuggagcuggacgagaccaagcaccagaaccagcugagagagaacaagauccuggaggagaucgagagcgugaaggagaagaccgacaagcugcugagagccaugcagcugaacgaggaggcccugaccaagaccaacaucuga

SEQ ID NO: 3176 - RNA, 1755 nt, Artificial Sequence
  derived and/or modified sequence opt5 from POTE__Homo_sapiens__CCDS13562.1
augguggccgaggucugcagcaugcccaccgcuuccacaguuaagaaaccuuucgaccugagaucuaagaugggcaaauggugucaccaucgguuuccgugcugucgcgggagcggaaaguccaacaugggcacgucuggggaucacgacgauagcuucaugaaaaugcucagauccaagaugggaaagugcugucggcauugcuuucccuguugccgcggcucugggaccagcaaugugggaacauccggcgaccacgaaaacagcuucaugaaaaugcugagaucuaagaugggcaaaugguguugccauuguuuuccuugcugccggggguccggaaagagcaaugugggcgccuggggagauuacgaccacucugcguucauggagccccgcuaucacaucagacgggaagaucuugacaaacugcaucgcgcugccuggugggggaaggucccuagaaaggaucucauugugaugcugcgggacaccgauaugaacaaacgcgacaaggagaaaagaacagcccuucaccuggcuuccgccaauggcaacagcgaaguugugcagcuccugcuggaucggcgcugucaacucaauguccuggacaacaagaaaagaaccgcucuuaucaaggccauucagugccaggaggacgagugugugcugaugcuccuggaacauggggcggaucggaauauccccgacgaguacggaaacacagcccuucacuaugcuauuuacaaugaagauaaacugauggccaaggcucuccugcuguauggcgccgacaucgagucuaagaacaaaugcggccucaccccucugcuucuggggguucacgagcagaagcaacagguggucaaauuucucaucaagaaaaaggcgaaucugaacgugcuugauagauacggacgcacggcccugauucucgcuguguguugcggcuccgccagcaucgucaaucugcugcucgaacagaacguugacguguccucucaggaucugagcgggcaaaccgcucgggaguaugccguguccagccaucaccaugucauuugugaacuucugucugacuacaaggagaaacagaugcucaagaucuccagcgaaaacucuaauccggagcaggaucugaaacuuacaagcgaggaagagucccagagacugaaggugucugaaaacagccaacccgagaaaaugucccaggaaccugagauuaauaaggacugcgaucgcgagguugaagaggaaaucaagaaacacggaagcaaccccgugggccucccugagaaucugaccaacggggccucugcuggaaauggcgacgacggccugauuccccagcggagaucccgcaagccggaaaaccaacaguucccugauacagagaaugaggaauaccauagcgacgagcagaacgauacccggaaacagcucucugaagaacaaaauacggggaucucccaggacgagauccugacaaacaagcagaaacagauugaagucgcggagcaaaagaugaauagcgaacuuucccugucucacaagaaagaggaagaucuccugagagagaacagcgugcugcaggaggaaaucgccaugcuucgccucgagcuggacgaaaccaagcaccagaaucagcugcgggagaacaaaauucucgaagagaucgaguccguuaaggagaaaacagauaagcugcuuagagcuaugcaacugaacgaggaagcccucaccaaaaccaauauuuga

SEQ ID NO: 3177 - protein, 509 aa, Artificial Sequence
  PRAME__Homo_sapiens__A0A024R1E6
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 3178 - RNA, 1530 nt, Artificial Sequence
  PRAME__Homo_sapiens__EAW59519
auggaacgaaggcguuugugggguuccauucagagccgauacaucagcaugaguguguggacaagcccacggagacuuguggagcuggcagggcagagccugcugaaggaugaggcccuggccauugccgcccuggaguugcugcccagggagcucuucccgccacucuucauggcagccuuugacgggagacacagccagacccugaaggcaauggugcaggccuggcccuucaccugccucccucugggagugcugaugaagggacaacaucuucaccuggagaccuucaaagcugugcuugauggacuugaugugcuccuugcccaggagguucgccccaggagguggaaacuucaagugcuggauuuacggaagaacucucaucaggacuucuggacuguauggucuggaaacagggccagucuguacucauuuccagagccagaagcagcucagcccaugacaaagaagcgaaaaguagaugguuugagcacagaggcagagcagcccuucauuccaguagaggugcucguagaccuguuccucaaggaaggugccugugaugaauuguucuccuaccucauugagaaagugaagcgaaagaaaaauguacuacgccugugcuguaagaagcugaagauuuuugcaaugcccaugcaggauaucaagaugauccugaaaauggugcagcuggacucuauugaagauuuggaagugacuuguaccuggaagcuacccaccuuggcgaaauuuucuccuuaccugggccagaugauuaaucugcguagacuccuccucucccacauccaugcaucuuccuacauuuccccggagaaggaagagcaguauaucgcccaguucaccucucaguuccucagucugcagugccugcaggcucucuauguggacucuuuauuuuuccuuagaggccgccuggaucaguugcucaggcacgugaugaaccccuuggaaacccucucaauaacuaacugccggcuuucggaaggggaugugaugcaucugucccagagucccagcgucagucagcuaaguguccugagucuaaguggggucaugcugaccgauguaagucccgagccccuccaagcucugcuggagagagccucugccacccuccaggaccuggucuuugaugagugugggaucacggaugaucagcuccuugcccuccugccuucccugagccacugcucccagcuuacaaccuuaagcuucuacgggaauuccaucuccauaucugccuugcagagucuccugcagcaccucaucgggcugagcaaucugacccacgugcuguauccugucccccuggagaguuaugaggacauccaugguacccuccaccuggagaggcuugccuaucugcaugccaggcucagggaguugcugugugaguuggggcggcccagcauggucuggcuuagugccaaccccuguccucacuguggggacagaaccuucuaugacccggagcccauccugugccccuguuucaugccuaacuag

SEQ ID NO: 3179 - RNA, 1530 nt, Artificial Sequence
  derived and/or modified sequence opt1 from PRAME__Homo_sapiens__EAW59519
auggagcgccggcgccuguggggcagcauccagucccgguacaucagcauguccguguggaccagcccccgccggcucgucgagcuggccgggcagucccugcucaaggacgaggcccuggcgaucgccgcccuggagcuccugccgcgcgagcuguucccgccccucuucauggccgccuucgacggccggcacagccagacccugaaggcgauggugcaggccuggcccuucacgugccugccccucggggugcugaugaagggccagcaccuccaccuggagaccuucaaggccguccuggacgggcuggacgugcuccuggcccaggaggugcgcccccggcgcuggaagcugcagguccucgaccugcggaagaacucccaccaggacuucuggaccguguggagcggcaaccgcgcgucccuguacagcuuccccgagcccgaggccgcccagccgaugaccaagaagcggaagguggacggccucuccacggaggccgagcagcccuucauccccgucgaggugcugguggaccuguuccucaaggagggggccugcgacgagcuguucagcuaccugaucgagaaggucaagcgcaagaagaacgugcuccggcugugcugcaagaagcugaagaucuucgcgaugcccaugcaggacaucaagaugauccucaagauggugcagcuggacuccaucgaggaccuggaggugaccugcaccuggaagcucccgacccuggccaaguucagccccuaccugggccagaugaucaaccuccgccggcugcugcucucccacauccacgccagcuccuacaucagccccgagaaggaggagcaguacaucgcccaguucacgucccaguuccugagccugcagugccuccaggcccuguacgucgacagccuguucuuccuccgcgggcggcuggaccagcugcugcgccacgugaugaacccccucgagacccuguccaucaccaacugccggcugagcgagggcgacgucaugcaccucucccagagcccguccgugagccagcuguccgugcugagccucuccggggucaugcugaccgacgugagccccgagccccugcaggcgcuccuggagcgcgccuccgccacgcugcaggaccucguguucgacgagugcggcaucaccgacgaccagcugcuggcccuccugcccagccugucccacugcagccagcucaccacccuguccuucuacggcaacagcaucuccaucagcgcccugcagucccuccugcagcaccugaucgggcucagcaaccugacgcacguccuguacccggugccccucgagagcuacgaggacauccacggcacccugcaccuggagcgccucgcguaccugcacgcccggcugcgcgagcuccugugcgagcuggggcggcccuccauggucuggcucagcgccaaccccugcccgcacugcggcgaccgcaccuucuacgaccccgagcccauccugugccccugcuucaugccgaacuga

SEQ ID NO: 3180 - RNA, 1530 nt, Artificial Sequence
  derived and/or modified sequence opt2 from PRAME__Homo_sapiens__EAW59519
auggagcgccgccgccucuggggcuccauccagucccgcuacaucuccauguccgucuggaccuccccccgccgccucgucgagcucgccggccagucccuccucaaggacgaggcccucgccaucgccgcccucgagcuccucccccgcgagcucuuccccccccucuucauggccgccuucgacggccgccacucccagacccucaaggccaugguccaggccuggcccuucaccugccucccccucggcguccucaugaagggccagcaccuccaccucgagaccuucaaggccguccucgacggccucgacguccuccucgcccaggagguccgcccccgccgcuggaagcuccagguccucgaccuccgcaagaacucccaccaggacuucuggaccgucugguccggcaaccgcgccucccucuacuccuuccccgagcccgaggccgcccagcccaugaccaagaagcgcaaggucgacggccucuccaccgaggccgagcagcccuucauccccgucgagguccucgucgaccucuuccucaaggagggcgccugcgacgagcucuucuccuaccucaucgagaaggucaagcgcaagaagaacguccuccgccucugcugcaagaagcucaagaucuucgccaugcccaugcaggacaucaagaugauccucaagaugguccagcucgacuccaucgaggaccucgaggucaccugcaccuggaagcuccccacccucgccaaguucucccccuaccucggccagaugaucaaccuccgccgccuccuccucucccacauccacgccuccuccuacaucucccccgagaaggaggagcaguacaucgcccaguucaccucccaguuccucucccuccagugccuccaggcccucuacgucgacucccucuucuuccuccgcggccgccucgaccagcuccuccgccacgucaugaacccccucgagacccucuccaucaccaacugccgccucuccgagggcgacgucaugcaccucucccagucccccuccgucucccagcucuccguccucucccucuccggcgucaugcucaccgacgucucccccgagccccuccaggcccuccucgagcgcgccuccgccacccuccaggaccucgucuucgacgagugcggcaucaccgacgaccagcuccucgcccuccuccccucccucucccacugcucccagcucaccacccucuccuucuacggcaacuccaucuccaucuccgcccuccagucccuccuccagcaccucaucggccucuccaaccucacccacguccucuaccccgucccccucgaguccuacgaggacauccacggcacccuccaccucgagcgccucgccuaccuccacgcccgccuccgcgagcuccucugcgagcucggccgccccuccauggucuggcucuccgccaaccccugcccccacugcggcgaccgcaccuucuacgaccccgagcccauccucugccccugcuucaugcccaacuga

SEQ ID NO: 3181 - RNA, 1530 nt, Artificial Sequence
  derived and/or modified sequence opt3 from PRAME__Homo_sapiens__EAW59519
auggagagaaggcggcuguggggcagcauccagucccgcuacauuucuaugucaguguggaccaguccccgacgucucgucgaacuugccgggcaaagccuguugaaggacgaggcuuuagcaauagccgcgcuggaacuacucccuagagagcuguucccaccgcuuuuuauggcugccuucgauggaaggcacucccagacacugaaagcaaugguucaggccuggcccuuuacuugcuugccucucggugugcugaugaagggccagcaucugcaccucgaaacguucaaagcuguauuagacgggcuggaugugcuuuuggcacaagagguccggccacgcagauggaagcuacaggugcuggaccucaggaaaaacucucaucaggauuuuuggaccguuuggucgggaaaucgggccucacuguauagcuuccccgagccugaagcugcccagccaaugacaaagaagcgcaaaguggacggccuuaguacugaggcggaacaacccuuuaucccugucgaggugcugguagauuuguuccucaaggagggugcaugugacgaacuguuuuccuacuuaauugagaaaguuaagcgaaagaaaaacgugcugagacucugcuguaagaaacuuaagaucuucgccaugccaaugcaggauauuaaaaugauccugaagaugguccaguuggacucuauagaagaucuagaggugaccugcacauggaaacugccgacccucgcuaaguuuagccccuaucuggggcagaugaucaaucuuaggcggcuguugcucucccacauucaugccucaaguuacaucagcccugaaaaagaggagcaauauauugcacaguucacuucucaguuucuguccuuacaaugucugcaggcucuauacguggacucacucuucuuccugcguggacgccuugaucaguugcugagacacgucaugaacccacucgaaacacugagcaucaccaauugcaggcuuagugagggcgacguuaugcaccugucucagucccccagcgugucgcaauugucuguacucucccugucaggcgugauguuaacggacgucaguccugaaccacugcaggcccuacucgagcgggcgagcgccacucugcaggaucuuguguuugacgaaugugggauaaccgaugaccaguugcuggcacuccugcccuccuuaucucauugcagccaacugacaacucuuucauucuauggaaacaguauuuccaucagcgcuuugcagucucuccugcagcaccuaauuggucugucaaaucucacccauguucuguacccggugccucuugagaguuacgaggauauccacggcacauugcaccuggaacgauuagccuaucuccaugcucgccugagagagcuucugugugaauuggggaggcccagcauggucuggcucuccgccaacccaugcccucacuguggagaccggaccuuuuacgaucccgagccaauccugugccccugcuucaugccuaauuga

SEQ ID NO: 3182 - RNA, 1530 nt, Artificial Sequence
  derived and/or modified sequence opt4 from PRAME__Homo_sapiens__EAW59519
auggagagaagaagacuguggggcagcauccagagcagauacaucagcaugagcguguggaccagccccagaagacugguggagcuggccggccagagccugcugaaggacgaggcccuggccaucgccgcccuggagcugcugcccagagagcuguuccccccccuguucauggccgccuucgacggcagacacagccagacccugaaggccauggugcaggccuggcccuucaccugccugccccugggcgugcugaugaagggccagcaccugcaccuggagaccuucaaggccgugcuggacggccuggacgugcugcuggcccaggaggugagacccagaagauggaagcugcaggugcuggaccugagaaagaacagccaccaggacuucuggaccguguggagcggcaacagagccagccuguacagcuuccccgagcccgaggccgcccagcccaugaccaagaagagaaagguggacggccugagcaccgaggccgagcagcccuucauccccguggaggugcugguggaccuguuccugaaggagggcgccugcgacgagcuguucagcuaccugaucgagaaggugaagagaaagaagaacgugcugagacugugcugcaagaagcugaagaucuucgccaugcccaugcaggacaucaagaugauccugaagauggugcagcuggacagcaucgaggaccuggaggugaccugcaccuggaagcugcccacccuggccaaguucagccccuaccugggccagaugaucaaccugagaagacugcugcugagccacauccacgccagcagcuacaucagccccgagaaggaggagcaguacaucgcccaguucaccagccaguuccugagccugcagugccugcaggcccuguacguggacagccuguucuuccugagaggcagacuggaccagcugcugagacacgugaugaacccccuggagacccugagcaucaccaacugcagacugagcgagggcgacgugaugcaccugagccagagccccagcgugagccagcugagcgugcugagccugagcggcgugaugcugaccgacgugagccccgagccccugcaggcccugcuggagagagccagcgccacccugcaggaccugguguucgacgagugcggcaucaccgacgaccagcugcuggcccugcugcccagccugagccacugcagccagcugaccacccugagcuucuacggcaacagcaucagcaucagcgcccugcagagccugcugcagcaccugaucggccugagcaaccugacccacgugcuguaccccgugccccuggagagcuacgaggacauccacggcacccugcaccuggagagacuggccuaccugcacgccagacugagagagcugcugugcgagcugggcagacccagcaugguguggcugagcgccaaccccugcccccacugcggcgacagaaccuucuacgaccccgagcccauccugugccccugcuucaugcccaacuga

SEQ ID NO: 3183 - RNA, 1530 nt, Artificial Sequence
  derived and/or modified sequence opt5 from PRAME__Homo_sapiens__EAW59519
auggagagacggcgccuguggggcagcauccaguccagauacauuucuaugagcguguggaccucuccccggcgccucgucgaacuggccgggcaaucccuucugaaggacgaggcucucgccaucgcggcucuggaacuucugccuagagagcuuuucccgccccuguuuauggccgccuucgauggacggcacagccagacacugaaagcuaugguucaggccuggccuuuuacgugccucccccugggcgugcuuaugaaggggcagcaucugcaccucgaaaccuucaaagcugugcuggacggacuugauguccugcucgcccaagaggugcgcccuagacgguggaagcugcagguucuggaccuccgcaaaaacucccaucaggauuuuuggacaguguggucuggcaauagagcgagccuguauuccuuccccgagccugaagccgcucagccgaugaccaagaagcggaaagucgacgggcuuagcacagaggccgaacaacccuuuauuccuguggagguucugguggaucucuuccugaaggagggagcuugugacgaacucuuuucuuaccugaucgagaaagucaagcgcaaaaagaacgugcucagacugugcuguaagaaacugaagauuuucgccaugcccaugcaggauaucaaaaugauccucaagauggugcagcuggacuccauugaagaucuugagguuaccugcacauggaaacugccuacccucgcgaaguuuagccccuaucugggccagaugaucaaucuucggcgccugcuccugucucacauucaugccuccagcuacaucucuccggaaaaagaggagcaauauauugcucaguucacgucccaguuucugagccuccaaugucugcaggcccuuuacgucgacucccuguucuuccucagaggccggcuggaucagcugcuuagacacgugaugaacccucucgaaacccugucuaucacaaauugccgccugagcgagggggacgugaugcaccucucccagagccccucugucucccaacugagcgugcuuucucugagcggaguuaugcucaccgacguguccccugaaccccugcaggcucugcuugagcgggccucugccacacuccaggaucuggucuuugacgaauguggcauuaccgaugaccagcugcucgcucugcuucccagccugucccauugcagccaacucacgacacugucuuucuaugggaacuccaucagcaucucugcgcugcagucccuucuccagcaccugauuggacugagcaaucucacccaugugcuguacccuguuccgcuugaguccuacgaggauauccacggcacacugcaccucgaaagacuggccuaucugcaugcucgccuucgggagcuccugugugaacuggggagacccucuaugguguggcucagcgccaacccuugcccccacuguggagaccgcaccuuuuacgauccugagcccauucugugcccgugcuucaugccuaauuga

SEQ ID NO: 3184 - protein, 509 aa, Artificial Sequence; identical to SEQ ID NO: 3177
  PRAME__Homo_sapiens__P78395

SEQ ID NO: 3185 - RNA, 1530 nt, Artificial Sequence; identical to SEQ ID NO: 3178
  PRAME__Homo_sapiens__AAC51160

SEQ ID NO: 3186 - RNA, 1530 nt, Artificial Sequence; identical to SEQ ID NO: 3179
  derived and/or modified sequence opt1 from PRAME__Homo_sapiens__AAC51160

SEQ ID NO: 3187 - RNA, 1530 nt, Artificial Sequence; identical to SEQ ID NO: 3180
  derived and/or modified sequence opt2 from PRAME__Homo_sapiens__AAC51160

SEQ ID NO: 3188 - RNA, 1530 nt, Artificial Sequence; identical to SEQ ID NO: 3181
  derived and/or modified sequence opt3 from PRAME__Homo_sapiens__AAC51160

SEQ ID NO: 3189 - RNA, 1530 nt, Artificial Sequence; identical to SEQ ID NO: 3182
  derived and/or modified sequence opt4 from PRAME__Homo_sapiens__AAC51160

SEQ ID NO: 3190 - RNA, 1530 nt, Artificial Sequence; identical to SEQ ID NO: 3183
  derived and/or modified sequence opt5 from PRAME__Homo_sapiens__AAC51160

SEQ ID NO: 3191 - protein, 214 aa, Artificial Sequence
  PRDX5/m__Homo_sapiens__P30044
MGLAGVCALRRSAGYILVGGAGGQSAAAAARRYSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 3192 - RNA, 645 nt, Artificial Sequence
  PRDX5/m__Homo_sapiens__CCDS8069.1
augggacuagcuggcgugugcgcccugagacgcucagcgggcuauauacucgucgguggggccggcggucagucugcggcagcggcagcaagacgguacagugaaggagagugggcgucuggcgggguccgcaguuucagcagagccgcugcagccauggccccaaucaaggugggagaugccaucccagcaguggagguguuugaaggggagccagggaacaaggugaaccuggcagagcuguucaagggcaagaagggugugcuguuuggaguuccuggggccuucaccccuggauguuccaagacacaccugccaggguuuguggagcaggcugaggcucugaaggccaagggaguccaggugguggccugucugaguguuaaugaugccuuugugacuggcgaguggggccgagcccacaaggcggaaggcaagguucggcuccuggcugaucccacuggggccuuugggaaggagacagacuuauuacuagaugauucgcugguguccaucuuugggaaucgacgucucaagagguucuccauggugguacaggauggcauagugaaggcccugaauguggaaccagauggcacaggccucaccugcagccuggcacccaauaucaucucacagcucuga

SEQ ID NO: 3193 - RNA, 645 nt, Artificial Sequence
  derived and/or modified sequence opt1 from PRDX5/m__Homo_sapiens__CCDS8069.1
augggccuggccggggugugcgcccuccgccggagcgcgggcuacauccuggucgggggcgccgggggccaguccgccgccgccgcggcccgccgguacagcgagggcgagugggccuccgggggcgugcgcagcuucucccgggccgcggccgccauggcccccaucaaggugggggacgccaucccggcggucgagguguucgagggcgagcccgggaacaaggugaaccuggccgagcuguucaagggcaagaagggcguccuguucggggugcccggcgccuucacccccgggugcagcaagacccaccucccgggcuucguggagcaggccgaggcccucaaggcgaagggcguccaggugguggccugccuguccgucaacgacgccuucgugacgggggaguggggccgcgcccacaaggccgaggggaaggugcggcugcucgcggaccccaccggcgccuucgggaaggagaccgaccugcugcucgacgacagccuggucuccaucuucggcaaccgccggcugaagcgcuucagcaugguggugcaggacggcaucgucaaggcccucaacguggagcccgacgggaccggccugacgugcucccuggcccccaacaucaucagccagcucuga

SEQ ID NO: 3194 - RNA, 645 nt, Artificial Sequence
  derived and/or modified sequence opt2 from PRDX5/m__Homo_sapiens__CCDS8069.1
augggccucgccggcgucugcgcccuccgccgcuccgccggcuacauccucgucggcggcgccggcggccaguccgccgccgccgccgcccgccgcuacuccgagggcgagugggccuccggcggcguccgcuccuucucccgcgccgccgccgccauggcccccaucaaggucggcgacgccauccccgccgucgaggucuucgagggcgagcccggcaacaaggucaaccucgccgagcucuucaagggcaagaagggcguccucuucggcguccccggcgccuucacccccggcugcuccaagacccaccuccccggcuucgucgagcaggccgaggcccucaaggccaagggcguccaggucgucgccugccucuccgucaacgacgccuucgucaccggcgaguggggccgcgcccacaaggccgagggcaagguccgccuccucgccgaccccaccggcgccuucggcaaggagaccgaccuccuccucgacgacucccucgucuccaucuucggcaaccgccgccucaagcgcuucuccauggucguccaggacggcaucgucaaggcccucaacgucgagcccgacggcaccggccucaccugcucccucgcccccaacaucaucucccagcucuga

SEQ ID NO: 3195 - RNA, 645 nt, Artificial Sequence
  derived and/or modified sequence opt3 from PRDX5/m__Homo_sapiens__CCDS8069.1
augggccuggccggggugugcgcucucagaaggagcgcaggauacauccuugucgguggcgccgggggacaguccgcggcugccgcagcccggcgcuauucugagggcgaaugggcuucaggugggguucgaaguuucagccgugcagccgcugccauggcgcccauuaaggugggagacgcaauaccugccguagagguguuugaaggcgagccaggcaacaaagucaaucuggcugaauuguucaaggggaaaaagggaguguuauuugguguuccgggcgccuucacccccggguguuccaaaacacaucugccuggauuuguggagcaagcagaggcucuaaaggccaagggcguccaggugguagcgugccucucuguuaacgaugccuucgugacuggugaaugggggagagcacacaaagcugagggaaaggucaggcugcuugccgacccaacgggcgcuuuuggcaaagaaaccgaucuguugcucgacgauucgcuggugucaaucuucgggaaucggcgccugaagagauuuagcauggugguccaggacggaauuguuaaagcccucaacguggagcccgaugguacaggcuuaacuuguagucuggcaccuaauaucauuucccagcuuuga

SEQ ID NO: 3196 - RNA, 645 nt, Artificial Sequence
  derived and/or modified sequence opt4 from PRDX5/m__Homo_sapiens__CCDS8069.1
augggccuggccggcgugugcgcccugagaagaagcgccggcuacauccuggugggcggcgccggcggccagagcgccgccgccgccgccagaagauacagcgagggcgagugggccagcggcggcgugagaagcuucagcagagccgccgccgccauggcccccaucaaggugggcgacgccauccccgccguggagguguucgagggcgagcccggcaacaaggugaaccuggccgagcuguucaagggcaagaagggcgugcuguucggcgugcccggcgccuucacccccggcugcagcaagacccaccugcccggcuucguggagcaggccgaggcccugaaggccaagggcgugcaggugguggccugccugagcgugaacgacgccuucgugaccggcgaguggggcagagcccacaaggccgagggcaaggugagacugcuggccgaccccaccggcgccuucggcaaggagaccgaccugcugcuggacgacagccuggugagcaucuucggcaacagaagacugaagagauucagcaugguggugcaggacggcaucgugaaggcccugaacguggagcccgacggcaccggccugaccugcagccuggcccccaacaucaucagccagcuguga

SEQ ID NO: 3197 - RNA, 645 nt, Artificial Sequence
  derived and/or modified sequence opt5 from PRDX5/m__Homo_sapiens__CCDS8069.1
augggccuggccggggugugcgcucucagacggagcgccggauacauccuggucggcggggcgggaggccaguccgcugccgccgcugcccgcagauauucugagggggaaugggcuagcggaggcguucgguccuucucucgcgccgcggccgcuauggcccccauuaaggugggcgacgcuaucccugccguggaggucuuugaaggggagccgggaaacaaagugaaucuugcggaacuguucaagggcaaaaaggggguucucuuuggagugcccggcgccuucaccccuggguguagcaaaacacaucugcccggauuugucgagcaagcugaggcccuuaaggcuaagggcgugcagguuguggccugccuguccgucaacgaugccuucgugacgggcgaaugggggagagcucacaaagcggagggaaaggugcggcuccuggccgacccuaccggcgcuuuugggaaagaaacagaucugcuccuggacgauucucuugucagcauuuucggaaaucgcagacugaagcgguuuuccaugguugugcaggacggcaucgugaaagcccucaacgucgagcccgaugggaccggacugacauguagccuugccccuaauauuaucucucagcuguga

SEQ ID NO: 3198 - protein, 102 aa, Artificial Sequence
  PRM2__Homo_sapiens__P04554
MVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 3199 - RNA, 309 nt, Artificial Sequence
  PRM2__Homo_sapiens__AAA63250
augguccgauaccgcgugaggagccugagcgaacgcucgcacgagguguacaggcagcaguugcaugggcaagagcaaggacaccacggccaagaggagcaagggcugagcccggagcacgucgaggucuacgagaggacccauggccagucucacuauaggcgcagacacugcucucgaaggaggcugcaccggauccacaggcggcagcaucgcuccugcagaaggcgcaaaagacgcuccugcaggcaccggaggaggcaucgcagaggcugcagaaccaggaagagaacaugcagaaggcacuaa

SEQ ID NO: 3200 - RNA, 309 nt, Artificial Sequence
  derived and/or modified sequence opt1 from PRM2__Homo_sapiens__AAA63250
auggugcgcuaccggguccgcagccuguccgagcggagccacgagguguaccgccagcagcuccacggccaggagcaggggcaccacggccaggaggagcaggggcugucccccgagcacguggaggucuacgagcggacccacggccagagccacuaccgccggcgccacugcucccggcgccggcugcaccgcauccaccggcgccagcaccggagcugccgccggcgcaagcggcgcuccugccggcaccgccgccggcaccgccgggggugccgcacccggaagcgcacgugccggcgccacuga

SEQ ID NO: 3201 - RNA, 309 nt, Artificial Sequence
  derived and/or modified sequence opt2 from PRM2__Homo_sapiens__AAA63250
augguccgcuaccgcguccgcucccucuccgagcgcucccacgaggucuaccgccagcagcuccacggccaggagcagggccaccacggccaggaggagcagggccucucccccgagcacgucgaggucuacgagcgcacccacggccagucccacuaccgccgccgccacugcucccgccgccgccuccaccgcauccaccgccgccagcaccgcuccugccgccgccgcaagcgccgcuccugccgccaccgccgccgccaccgccgcggcugccgcacccgcaagcgcaccugccgccgccacuga

SEQ ID NO: 3202 - RNA, 309 nt, Artificial Sequence
  derived and/or modified sequence opt3 from PRM2__Homo_sapiens__AAA63250
auggugagauacaggguccggagccuguccgagcgcucucacgaaguuuaucgacagcaacuccauggccaggagcaggggcaccauggacaggaggaacaaggucuuucacccgaacacguggagguauacgagcguacccauggccagagucacuauagaaggcggcacugcagccgcagaaggcugcaucggauccaccgccgacagcauagauccuguaggcggcguaagcgcagaucuugcaggcaccggcgacgccacagaagggggugucggacacgcaaaagaacuugcaggcgucauuga

SEQ ID NO: 3203 - RNA, 309 nt, Artificial Sequence
  derived and/or modified sequence opt4 from PRM2__Homo_sapiens__AAA63250
auggugagauacagagugagaagccugagcgagagaagccacgagguguacagacagcagcugcacggccaggagcagggccaccacggccaggaggagcagggccugagccccgagcacguggagguguacgagagaacccacggccagagccacuacagaagaagacacugcagcagaagaagacugcacagaauccacagaagacagcacagaagcugcagaagaagaaagagaagaagcugcagacacagaagaagacacagaagaggcugcagaaccagaaagagaaccugcagaagacacuga

SEQ ID NO: 3204 - RNA, 309 nt, Artificial Sequence
  derived and/or modified sequence opt5 from PRM2__Homo_sapiens__AAA63250
auggugagauaccggguccgcagccuguccgagagaucucacgaaguuuaucggcagcaacuccauggccaggagcaggggcaccauggacaggaggaacaaggccugagccccgaacacguggagguguacgagcgcacccaugggcagucccacuauagacggcgccacugcucuagacggcgccuucauagaauccaccggcgccagcauagaagcugucggcgcagaaagcggagauccugccgccaccggagacgccaccggagaggaugucgcacacggaaaagaacgugccgccggcauuga

SEQ ID NO: 3205 - protein, 553 aa, Artificial Sequence
  prostein__Homo_sapiens__Q96JT2
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 3206 - RNA, 1662 nt, Artificial Sequence
  prostein__Homo_sapiens__AAH50416
augguccagaggcugugggugagccgccugcugcggcaccggaaagcccagcucuugcuggucaaccugcuaaccuuuggccuggagguguguuuggccgcaggcaucaccuaugugccgccucugcugcuggaaguggggguagaggagaaguucaugaccauggugcugggcauugguccagugcugggccuggucugugucccgcuccuaggcucagccagugaccacuggcguggacgcuauggccgccgccggcccuucaucugggcacuguccuugggcauccugcugagccucuuucucaucccaagggccggcuggcuagcagggcugcugugcccggaucccaggccccuggagcuggcacugcucauccugggcguggggcugcuggacuucuguggccaggugugcuucacuccacuggaggcccugcucucugaccucuuccgggacccggaccacugucgccaggccuacucugucuaugccuucaugaucagucuugggggcugccugggcuaccuccugccugccauugacugggacaccagugcccuggcccccuaccugggcacccaggaggagugccucuuuggccugcucacccucaucuuccucaccugcguagcagccacacugcugguggcugaggaggcagcgcugggccccaccgagccagcagaagggcugucggcccccuccuugucgccccacugcuguccaugccgggcccgcuuggcuuuccggaaccugggcgcccugcuuccccggcugcaccagcugugcugccgcaugccccgcacccugcgccggcucuucguggcugagcugugcagcuggauggcacucaugaccuucacgcuguuuuacacggauuucgugggcgaggggcuguaccagggcgugcccagagcugagccgggcaccgaggcccggagacacuaugaugaaggcguucggaugggcagccuggggcuguuccugcagugcgccaucucccuggucuucucucuggucauggaccggcuggugcagcgauucggcacucgagcagucuauuuggccaguguggcagcuuucccuguggcugccggugccacaugccugucccacaguguggccguggugacagcuucagccgcccucaccggguucaccuucucagcccugcagauccugcccuacacacuggccucccucuaccaccgggagaagcagguguuccugcccaaauaccgaggggacacuggaggugcuagcagugaggacagccugaugaccagcuuccugccaggcccuaagccuggagcucccuucccuaauggacacgugggugcuggaggcaguggccugcucccaccuccacccgcgcucugcggggccucugccugugaugucuccguacgugugguggugggugagcccaccgaggccagggugguuccgggccggggcaucugccuggaccucgccauccuggauagugccuuccugcugucccagguggccccaucccuguuuaugggcuccauuguccagcucagccagucugucacugccuauauggugucugccgcaggccugggucuggucgccauuuacuuugcuacacagguaguauuugacaagagcgacuuggccaaauacucagcguag

SEQ ID NO: 3207 - RNA, 1662 nt, Artificial Sequence
  derived and/or modified sequence opt1 from prostein__Homo_sapiens__AAH50416
auggugcagcgccugugggucagccggcuccugcgccaccggaaggcccagcugcuccuggugaaccugcucaccuucggccuggaggugugccuggccgcggggaucaccuacgugcccccgcuccugcuggaggugggcguggaggagaaguucaugacgaugguccucgggaucggccccgugcuggggcuggugugcgucccccuccugggcuccgccagcgaccacuggcgcggccgguacgggcgccggcgccccuucaucugggcccugucccucggcauccugcugagccucuuccugaucccgcgggccggguggcuggccggccuccugugccccgacccccgcccccuggagcucgcgcugcugauccucggggugggccugcuggacuucugcggccaggugugcuucaccccgcucgaggcccugcuguccgaccucuuccgggaccccgaccacugccgccaggccuacagcgucuacgccuucaugaucucccucgggggcugccugggguaccugcugcccgcgaucgacugggacaccagcgcccuggcccccuaccucggcacccaggaggagugccuguucggccugcucacgcugaucuuccugaccugcguggccgccacccuccugguggcggaggaggccgcccuggggcccaccgagcccgccgagggccuguccgcccccagccucagcccccacugcugcccgugccgggcgcgccuggccuuccggaaccugggggcccuccugccccgccugcaccagcucugcugccggaugccccgcacgcugcggcgccuguucgucgccgagcucugcuccuggauggcccugaugaccuucacccuguucuacaccgacuucgugggcgaggggcucuaccagggcgugccccgggcggagccgggcacggaggcccgccgccacuacgacgaggggguccggaugggcucccuggggcuguuccuccagugcgccaucagccugguguucucccuggugauggaccgccucguccagcgguucggcacccgcgccguguaccuggccagcguggcggccuuccccgucgccgccggggcgaccugccugucccacagcguggccgucgugaccgccuccgccgcccucacgggcuucaccuucagcgcgcugcagauccugcccuacacccucgccagccuguaccaccgggagaagcaggucuuccugcccaaguaccgcggcgacaccgggggcgccuccagcgaggacucccucaugacgagcuuccugccggggcccaagcccggcgcccccuucccgaacgggcacgucggcgccggcggguccggccugcucccgccgccgcccgcgcugugcggggccagcgccugcgacguguccgugcgggucguggugggcgagcccaccgaggcccgcgucgugcccggccgggggaucugccuggaccucgccauccuggacagcgcguuccugcucucccagguggcccccagccuguucaugggcuccaucguccagcugagccaguccgugaccgccuacauggugagcgccgcggggcucggccuggucgccaucuacuucgccacccaggugguguucgacaaguccgaccuggccaaguacagcgccuga

SEQ ID NO: 3208 - RNA, 1662 nt, Artificial Sequence
  derived and/or modified sequence opt2 from prostein__Homo_sapiens__AAH50416
augguccagcgccucugggucucccgccuccuccgccaccgcaaggcccagcuccuccucgucaaccuccucaccuucggccucgaggucugccucgccgccggcaucaccuacguccccccccuccuccucgaggucggcgucgaggagaaguucaugaccaugguccucggcaucggccccguccucggccucgucugcgucccccuccucggcuccgccuccgaccacuggcgcggccgcuacggccgccgccgccccuucaucugggcccucucccucggcauccuccucucccucuuccucaucccccgcgccggcuggcucgccggccuccucugccccgacccccgcccccucgagcucgcccuccucauccucggcgucggccuccucgacuucugcggccaggucugcuucaccccccucgaggcccuccucuccgaccucuuccgcgaccccgaccacugccgccaggccuacuccgucuacgccuucaugaucucccucggcggcugccucggcuaccuccuccccgccaucgacugggacaccuccgcccucgcccccuaccucggcacccaggaggagugccucuucggccuccucacccucaucuuccucaccugcgucgccgccacccuccucgucgccgaggaggccgcccucggccccaccgagcccgccgagggccucuccgcccccucccucuccccccacugcugccccugccgcgcccgccucgccuuccgcaaccucggcgcccuccucccccgccuccaccagcucugcugccgcaugccccgcacccuccgccgccucuucgucgccgagcucugcuccuggauggcccucaugaccuucacccucuucuacaccgacuucgucggcgagggccucuaccagggcgucccccgcgccgagcccggcaccgaggcccgccgccacuacgacgagggcguccgcaugggcucccucggccucuuccuccagugcgccaucucccucgucuucucccucgucauggaccgccucguccagcgcuucggcacccgcgccgucuaccucgccuccgucgccgccuuccccgucgccgccggcgccaccugccucucccacuccgucgccgucgucaccgccuccgccgcccucaccggcuucaccuucuccgcccuccagauccuccccuacacccucgccucccucuaccaccgcgagaagcaggucuuccuccccaaguaccgcggcgacaccggcggcgccuccuccgaggacucccucaugaccuccuuccuccccggccccaagcccggcgcccccuuccccaacggccacgucggcgccggcggcuccggccuccucccccccccccccgcccucugcggcgccuccgccugcgacgucuccguccgcgucgucgucggcgagcccaccgaggcccgcgucguccccggccgcggcaucugccucgaccucgccauccucgacuccgccuuccuccucucccaggucgcccccucccucuucaugggcuccaucguccagcucucccaguccgucaccgccuacauggucuccgccgccggccucggccucgucgccaucuacuucgccacccaggucgucuucgacaaguccgaccucgccaaguacuccgccuga

SEQ ID NO: 3209 - RNA, 1662 nt, Artificial Sequence
  derived and/or modified sequence opt3 from prostein__Homo_sapiens__AAH50416
auggugcagagacugugggucagcaggcuccuucggcaccgcaaggcccaacuguuguuaguuaaccugcuaaccuucggccucgaggugugccuggcugcagggaucacauacguacccccucuucuguuggaagugggagucgaggaaaaauuuaugacuauggugcucgguauuggcccaguucuggggcuggugugugucccgcucuuaggauccgccucugaccauuggcgaggccguuaugguagaaggcggcccuucauaugggcgcugucacuugggaucuugcugagucuauuucucauuccucgcgcuggauggcuggccggccuucugugcccagaucccagaccuuuggagcucgcacuguuaauccugggcguggggcuccuugacuucuguggacagguaugcuuuacgccacuggaagccuugcuaagcgaucuguucagggaccccgaucacugucggcaggcuuacuccguuuaugcauuuaugauuucucucgguggcugccugggguaccuucugccugccaucgacugggauaccucggcuuuggccccauaucucggaacacaggaggagugucuguucggcuuacugacucuaauauuuuugaccugcguggcggcaacacugcuugucgccgaagaggcugccuuggguccgaccgaacccgcagaggggcugucagcuccuagccucaguccacauuguugccccugucgcgcccgacuggcguucagaaaucuuggagcccuguugccuaggcuccaccaacugugcugccggaugccacguacuuuacgcagacuguuuguggcagagcuauguuccuggauggcucucaugacauucacccuguuuuacacggacuucgugggcgaaggccuuuaucaggggguccccagggccgagccgggaacugaagcucggcgacauuacgaugaggguguucgcaugggcucuuuggggcuguuccuccagugcgccaucagccugguguuuuccuuaguaauggacagacuggugcagagguucggaacccgggcagucuaccuugccucaguggcugcguuuccuguugcagccggcgcuacauguuugagucacagcguggccgucgugacugcaucugccgcucucaccgguuucacauuuuccgcccugcaaauucuacccuauacccuggcaucacucuaccaccgcgaaaagcagguauuccugccaaaauauagaggggauacgggcggagcgagcagugaggacucucuuaugacuuccuuuuugccuggccccaagccaggggcucccuucccuaacggacauguuggugccggcgggagcggacuguuaccaccgcccccugcacucugcggcgccucggcuugugaugugucugucaggguggucgugggugagccaacagaagcccguguugugcccgggcggggcaucugccuggaccuugcaauucuggacuccgcuuuucuccucucacagguagccccuagucuguucaugggaagcaucguccagcuaucccaaucugugaccgcguacaugguuagcgccgcuggccuggggcucguggcaauauauuuugccacucaggucguguucgauaaaucagaccuggcuaaguacagugccuga

SEQ ID NO: 3210 - RNA, 1662 nt, Artificial Sequence
  derived and/or modified sequence opt4 from prostein__Homo_sapiens__AAH50416
auggugcagagacugugggugagcagacugcugagacacagaaaggcccagcugcugcuggugaaccugcugaccuucggccuggaggugugccuggccgccggcaucaccuacgugcccccccugcugcuggaggugggcguggaggagaaguucaugaccauggugcugggcaucggccccgugcugggccuggugugcgugccccugcugggcagcgccagcgaccacuggagaggcagauacggcagaagaagacccuucaucugggcccugagccugggcauccugcugagccuguuccugauccccagagccggcuggcuggccggccugcugugccccgaccccagaccccuggagcuggcccugcugauccugggcgugggccugcuggacuucugcggccaggugugcuucaccccccuggaggcccugcugagcgaccuguucagagaccccgaccacugcagacaggccuacagcguguacgccuucaugaucagccugggcggcugccugggcuaccugcugcccgccaucgacugggacaccagcgcccuggcccccuaccugggcacccaggaggagugccuguucggccugcugacccugaucuuccugaccugcguggccgccacccugcugguggccgaggaggccgcccugggccccaccgagcccgccgagggccugagcgcccccagccugagcccccacugcugccccugcagagccagacuggccuucagaaaccugggcgcccugcugcccagacugcaccagcugugcugcagaaugcccagaacccugagaagacuguucguggccgagcugugcagcuggauggcccugaugaccuucacccuguucuacaccgacuucgugggcgagggccuguaccagggcgugcccagagccgagcccggcaccgaggccagaagacacuacgacgagggcgugagaaugggcagccugggccuguuccugcagugcgccaucagccugguguucagccuggugauggacagacuggugcagagauucggcaccagagccguguaccuggccagcguggccgccuuccccguggccgccggcgccaccugccugagccacagcguggccguggugaccgccagcgccgcccugaccggcuucaccuucagcgcccugcagauccugcccuacacccuggccagccuguaccacagagagaagcagguguuccugcccaaguacagaggcgacaccggcggcgccagcagcgaggacagccugaugaccagcuuccugcccggccccaagcccggcgcccccuuccccaacggccacgugggcgccggcggcagcggccugcugccccccccccccgcccugugcggcgccagcgccugcgacgugagcgugagagugguggugggcgagcccaccgaggccagaguggugcccggcagaggcaucugccuggaccuggccauccuggacagcgccuuccugcugagccagguggcccccagccuguucaugggcagcaucgugcagcugagccagagcgugaccgccuacauggugagcgccgccggccugggccugguggccaucuacuucgccacccaggugguguucgacaagagcgaccuggccaaguacagcgccuga

SEQ ID NO: 3211 - RNA, 1662 nt, Artificial Sequence
  derived and/or modified sequence opt5 from prostein__Homo_sapiens__AAH50416
auggugcagagacugugggucagccggcuccugcgccacagaaaggcccaacuucugcucguuaaccugcuuaccuucggccuggaggugugccucgcugccgggaucacauacgugcccccucugcugcucgaagucggaguggaggaaaaauuuaugacgaugguucugggcauugggccggugcuuggacuggucugugugccccuccugggcuccgcgucugaccauuggcgggggcgcuauggaagacggcgcccuuucaucugggcucuuagccugggcauucuccugucccuguuucucauccccagagccggcuggcuggccgggcuucugugcccugauccccggccucucgagcuggcccuucugauucucggaguuggccugcuggacuucuguggacaggugugcuuuaccccgcucgaagcucugcuuucugaucuguuccgcgaccccgaucacuguagacaggcuuacagcgucuaugccuuuaugaucucccucgggggcugccugggguaccuucugccugcgaucgacugggauacaucugcccucgcucccuaucugggaacccaggaggagugucuguucggccuccugacacuuauuuuucugaccugcguggccgcuacacuccugguggccgaagaggcggcccugggcccuaccgaacccgcugaggggcuuagcgccccgucccucagcccucauuguugccccugucgggcucgccuggccuucagaaaucugggagcccuccugccucggcuucaccaacugugcugccgcaugcccagaacgcuccggagacuguuugucgcugagcuguguucuuggauggcgcuuaugaccuucacacucuuuuacaccgacuucguuggcgaagggcuguaucagggagugccccgcgccgagccuggcacagaagcucggagacauuacgaugagggggugcgcaugggaucccugggccucuuccugcagugcgccaucagccuugucuuuucucuggugauggaccggcucguucagagauucggcacccgcgccguguaccuggcuuccgucgccgcguuuccgguggcugccggggccacgugucugagccacucuguugcuguggucacagccuccgcugcccuuaccggauucacauuuagcgcgcuccaaauucugcccuauacccuggccucccucuaccaccgggaaaaacagguguuccugccuaaguauagaggcgauaccgggggagcuucuagcgaggacucccuuaugacgagcuuucugcccggcccuaagcccggggccccguucccuaacggccaugucggagcuggcgggucuggacuccugcccccucccccugcccugugcggcgcguccgccugugaugugagcguucgcguggucgugggggagcccacagaagcucggguugugccgggaagaggcaucugccuugaccucgccauucuggacucugcuuuucugcucagccaggucgccccuucccuguucauggggucuaucgugcagcuuagccaauccgugaccgccuacaugguuagcgcugcgggccugggacucgucgccauuuauuuugcuacacaggugguguucgauaaaucugaccuggccaaguacuccgccuga

SEQ ID NO: 3212 - protein, 215 aa, Artificial Sequence [sequence omitted]

SEQ ID NO: 3213 - RNA, 648 nt, Artificial Sequence
  proteinase-3__Homo_sapiens__CBI83574
auggccucccugcagaugcgggggaacccgggcagccacuucugcggaggcaccuugauccaccccagcuucgugcugacggccgcgcacugccugcgggacauaccccagcgccuggugaacguggugcucggagcccacaacgugcggacgcaggagcccacccagcagcacuucucgguggcucagguguuucugaacaacuacgacgcggagaacaaacugaacgacauucuccucauccagcugagcagcccagccaaccucagugccuccgucgccacaguccagcugccacagcaggaccagccagugccccacggcacccagugccuggccaugggcuggggccgcgugggugcccacgaccccccagcccagguccugcaggagcucaaugucaccguggugaccuucuucugccggccacauaacauuugcacuuucgucccucgccgcaaggccggcaucugcuucggagacucagguggcccccugaucugugauggcaucauccaaggaauagacuccuucgugaucuggggaugugccacccgccuuuucccugacuucuucacgcggguagcccucuacguggacuggauccguuccacgcugcgccguguggaggccaagggccgccccuga

SEQ ID NO: 3214 - RNA, 648 nt, Artificial Sequence
  derived and/or modified sequence opt1 from proteinase-3__Homo_sapiens__CBI83574
auggccagccugcagaugcgcggcaaccccgggucccacuucugcggcgggacccucauccacccgagcuucgugcugaccgccgcgcacugccugcgggacaucccccagcgccucgucaacguggugcugggcgcccacaacguccggacgcaggagcccacccagcagcacuucuccguggcccagguguuccugaacaacuacgacgccgagaacaagcucaacgacauccugcugauccagcucagcucccccgccaaccugagcgcguccgucgccaccgugcagcugccgcagcaggaccagcccgugccccacgggacccagugccucgccaugggcuggggccgcgucggggcccacgacccgcccgcccaggugcugcaggagcugaacgugacggucgugaccuucuucugccggccccacaacaucugcaccuucgugccccgccggaaggcgggcaucugcuucggggacagcggcgggccccucaucugcgacggcaucauccagggcaucgacuccuucgucaucugggggugcgccacccgccuguucccggacuucuucacgcggguggcccuguacguggacuggauccgcagcacccuccggcgcgucgaggccaagggccggcccuga

SEQ ID NO: 3215 - RNA, 648 nt, Artificial Sequence
  derived and/or modified sequence opt2 from proteinase-3__Homo_sapiens__CBI83574
auggccucccuccagaugcgcggcaaccccggcucccacuucugcggcggcacccucauccaccccuccuucguccucaccgccgcccacugccuccgcgacaucccccagcgccucgucaacgucguccucggcgcccacaacguccgcacccaggagcccacccagcagcacuucuccgucgcccaggucuuccucaacaacuacgacgccgagaacaagcucaacgacauccuccucauccagcucuccucccccgccaaccucuccgccuccgucgccaccguccagcucccccagcaggaccagcccgucccccacggcacccagugccucgccaugggcuggggccgcgucggcgcccacgacccccccgcccagguccuccaggagcucaacgucaccgucgucaccuucuucugccgcccccacaacaucugcaccuucgucccccgccgcaaggccggcaucugcuucggcgacuccggcggcccccucaucugcgacggcaucauccagggcaucgacuccuucgucaucuggggcugcgccacccgccucuuccccgacuucuucacccgcgucgcccucuacgucgacuggauccgcuccacccuccgccgcgucgaggccaagggccgccccuga

SEQ ID NO: 3216 - RNA, 648 nt, Artificial Sequence
  derived and/or modified sequence opt3 from proteinase-3__Homo_sapiens__CBI83574
auggccagccugcagaugagaggcaaccccgggucccacuucugcggagguacccucauccauccuucuuuugugcuuacagcugcacacugucugagggacauuccacaacgguuggucaauguuguguuaggcgcccauaacguacgcacucaggagccgacgcagcagcacuucucaguggcgcaagucuuucugaauaacuacgaugcugaaaauaagcuaaacgacauacuccugauccagcuuaguagccccgccaaucuguccgcaucuguggccaccguucaguugccucagcaagaucagccagugccccaugggacacagugccucgcuaugggauggggccgagucggugcacacgacccuccagcccaggugcugcaagagcugaacguaacuguugugaccuucuuuugucguccccacaauauuugcacauucgucccuagaaggaaagcugggaucuguuuuggagauucgggcggcccacucauuugcgacgggaucauacagggaaucgauucauucgugauuugggguugugccacccgguuauuuccggacuucuuuacucgcguggcgcuguaugucgauuggaucagaagcacacuuaggcggguugaagcaaagggccgccccuga

SEQ ID NO: 3217 - RNA, 648 nt, Artificial Sequence
  derived and/or modified sequence opt4 from proteinase-3__Homo_sapiens__CBI83574
auggccagccugcagaugagaggcaaccccggcagccacuucugcggcggcacccugauccaccccagcuucgugcugaccgccgcccacugccugagagacaucccccagagacuggugaacguggugcugggcgcccacaacgugagaacccaggagcccacccagcagcacuucagcguggcccagguguuccugaacaacuacgacgccgagaacaagcugaacgacauccugcugauccagcugagcagccccgccaaccugagcgccagcguggccaccgugcagcugccccagcaggaccagcccgugccccacggcacccagugccuggccaugggcuggggcagagugggcgcccacgacccccccgcccaggugcugcaggagcugaacgugaccguggugaccuucuucugcagaccccacaacaucugcaccuucgugcccagaagaaaggccggcaucugcuucggcgacagcggcggcccccugaucugcgacggcaucauccagggcaucgacagcuucgugaucuggggcugcgccaccagacuguuccccgacuucuucaccagaguggcccuguacguggacuggaucagaagcacccugagaagaguggaggccaagggcagacccuga

SEQ ID NO: 3218 - RNA, 648 nt, Artificial Sequence
  derived and/or modified sequence opt5 from proteinase-3__Homo_sapiens__CBI83574
auggccagccugcagaugagaggcaaccccgggucccacuucugcggaggcacccucauccauccuucuuuugugcugacagcugcccacugucuucgggacauuccgcaacgccuggucaauguugugcucggggcgcauaacgugagaacgcaggagcccacccagcagcacuucagcgucgcucaaguguuucugaauaacuacgaugccgaaaauaaacuuaacgacauccugcucauucagcuguccucuccugccaaucugagcgcuuccguugccacagugcagcucccccagcaagaucagccugucccccauggaacccagugccuggcuaugggcugggggcgggugggagcccacgacccuccggcgcagguucuucaagagcugaacgugacagucgugaccuucuuuugucgcccccacaauaucugcacauucgugccuagacggaaggccggcauuuguuuuggcgauucugggggaccccucaucugcgacggcaucauucaggggaucgauagcuucgucauuuggggaugugcuacccgccuguuuccugacuucuuuacgagaguugcccuuuauguggauuggauccgguccacccugcgcagaguggaagcuaagggccggcccuga

SEQ ID NO: 3219 - protein, 256 aa, Artificial Sequence
  proteinase-3__Homo_sapiens__P24158
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 3220 - RNA, 771 nt, Artificial Sequence
  proteinase-3__Homo_sapiens__AAH96183
auggcucaccggccccccagcccugcccuggcguccgugcugcuggccuugcugcugagcggugcugcccgagcugcggagaucgugggcgggcacgaggcgcagccacacucccggcccuacauggccucccugcagaugcgggggaacccgggcagccacuucugcggaggcaccuugauccaccccagcuucgugcugacggccgcgcacugccugcgggacauaccccagcgccuggugaacguggugcucggagcccacaacgugcggacgcaggagcccacccagcagcacuucucgguggcucagguguuucugaacaacuacgacgcggagaacaaacugaacgacguucuccucauccagcugagcagcccagccaaccucagugccuccgucgccacaguccagcugccacagcaggaccagccagugccccacggcacccagugccuggccaugggcuggggccgcgugggugcccacgaccccccagcccagguccugcaggagcucaaugucaccguggucaccuucuucugccggccacauaacauuugcacuuucgucccucgccgcaaggccggcaucugcuucggagacucagguggcccccugaucugugauggcaucauccaaggaauagacuccuucgugaucuggggaugugccacccgccuuuucccugacuucuucacgcggguagcccucuacguggacuggauccguuccacgcugcgccguguggaggccaagggccgccccuga

SEQ ID NO: 3221 - RNA, 771 nt, Artificial Sequence
  derived and/or modified sequence opt1 from proteinase-3__Homo_sapiens__AAH96183
auggcccaccggcccccgagccccgcccuggcguccgugcuccuggcccugcuccugagcggcgccgcccgcgccgcggagaucgucgggggccacgaggcccagccccacucccgccccuacauggccagccugcagaugcgggggaacccgggcucccacuucugcgggggcacccucauccaccccagcuucgugcugaccgccgcgcacugccugcgcgacaucccccagcggcucgugaacgucgugcugggcgcccacaacgugcgcacgcaggagcccacccagcagcacuucuccgucgcccagguguuccugaacaacuacgacgccgagaacaagcucaacgacgugcugcugauccagcucagcuccccggccaaccugagcgcguccgucgccaccgugcagcugccccagcaggaccagcccgugccccacgggacccagugccucgccaugggcugggggcgggucggcgcccacgacccgcccgcccaggugcugcaggagcugaacgugacggucgugaccuucuucugccgcccccacaacaucugcaccuucgugccccggcgcaaggcggggaucugcuucggcgacagcggcgggccgcucaucugcgacggcaucauccaggggaucgacuccuucgucaucuggggcugcgccacccggcuguuccccgacuucuucacgcgcguggcccuguacguggacuggauccggagcacccuccgccgggucgaggccaagggccgccccuga

SEQ ID NO: 3222 - RNA, 771 nt, Artificial Sequence
  derived and/or modified sequence opt2 from proteinase-3__Homo_sapiens__AAH96183
auggcccaccgcccccccucccccgcccucgccuccguccuccucgcccuccuccucuccggcgccgcccgcgccgccgagaucgucggcggccacgaggcccagccccacucccgccccuacauggccucccuccagaugcgcggcaaccccggcucccacuucugcggcggcacccucauccaccccuccuucguccucaccgccgcccacugccuccgcgacaucccccagcgccucgucaacgucguccucggcgcccacaacguccgcacccaggagcccacccagcagcacuucuccgucgcccaggucuuccucaacaacuacgacgccgagaacaagcucaacgacguccuccucauccagcucuccucccccgccaaccucuccgccuccgucgccaccguccagcucccccagcaggaccagcccgucccccacggcacccagugccucgccaugggcuggggccgcgucggcgcccacgacccccccgcccagguccuccaggagcucaacgucaccgucgucaccuucuucugccgcccccacaacaucugcaccuucgucccccgccgcaaggccggcaucugcuucggcgacuccggcggcccccucaucugcgacggcaucauccagggcaucgacuccuucgucaucuggggcugcgccacccgccucuuccccgacuucuucacccgcgucgcccucuacgucgacuggauccgcuccacccuccgccgcgucgaggccaagggccgccccuga

SEQ ID NO: 3223 - RNA, 771 nt, Artificial Sequence
  derived and/or modified sequence opt3 from proteinase-3__Homo_sapiens__AAH96183
auggcccacagacccccuagcccagcucuggcauccgugcuccuugcccuguuguuaucuggcgcggcuagggccgcagagaucgucgggggacaugaagcccagccgcacucacggcccuacauggcuagucugcaaaugcgcgguaacccuggcagccauuucugcgggggaacccuaauucacccauccuuuguucucacagcagcccauugucugcgagacauaccccagcgucuugugaauguagugcugggcgcucacaacgucagaacucaggagccuacgcagcaacacuucucuguggcccagguguuuuugaauaacuaugaugcggaaaauaagcucaacgacguucugcugauccagcucucgucaccagcaaauuuaagcgccagugucgcuaccgugcagcugccccaacaggaucagccuguaccacaugguacacagugccuugccaugggguggggaaggguuggcgcacacgacccgcccgcucaaguguugcaggagcugaacgucacuguggugaccuucuuuugucggccucauaauauuugcacauucgucccacgcagaaaagccggcaucuguuuuggggauuccggagguccccuaauuugcgacggcaucauacaggggaucgauucuuucguuauuuggggaugugcgaccaggcucuuuccugacuucuuuacucggguggcccuguacguagauuggauccgcagcacacuucgaagaguggaagcaaagggcaggccauga

SEQ ID NO: 3224 - RNA, 771 nt, Artificial Sequence
  derived and/or modified sequence opt4 from proteinase-3__Homo_sapiens__AAH96183
auggcccacagaccccccagccccgcccuggccagcgugcugcuggcccugcugcugagcggcgccgccagagccgccgagaucgugggcggccacgaggcccagccccacagcagacccuacauggccagccugcagaugagaggcaaccccggcagccacuucugcggcggcacccugauccaccccagcuucgugcugaccgccgcccacugccugagagacaucccccagagacuggugaacguggugcugggcgcccacaacgugagaacccaggagcccacccagcagcacuucagcguggcccagguguuccugaacaacuacgacgccgagaacaagcugaacgacgugcugcugauccagcugagcagccccgccaaccugagcgccagcguggccaccgugcagcugccccagcaggaccagcccgugccccacggcacccagugccuggccaugggcuggggcagagugggcgcccacgacccccccgcccaggugcugcaggagcugaacgugaccguggugaccuucuucugcagaccccacaacaucugcaccuucgugcccagaagaaaggccggcaucugcuucggcgacagcggcggcccccugaucugcgacggcaucauccagggcaucgacagcuucgugaucuggggcugcgccaccagacuguuccccgacuucuucaccagaguggcccuguacguggacuggaucagaagcacccugagaagaguggaggccaagggcagacccuga

SEQ ID NO: 3225 - RNA, 771 nt, Artificial Sequence
  derived and/or modified sequence opt5 from proteinase-3__Homo_sapiens__AAH96183
auggcccacagacccccuagcccggcucuggccuccgugcuccuggcgcuucugcucucuggcgcugcccgggccgcugagaucgucgggggacaugaagcccagccccacagccgcccuuacauggcuucccugcaaaugagaggcaaccccgggucucauuucugcggaggcacccuuauucacccuagcuuuguucugacagccgcgcauugucuccgggacaucccccagcgccuggugaaugugguccugggggcccacaacgugagaacgcaggagccuacccagcaacacuucuccguugcucagguguuucucaauaacuaugaugccgaaaauaagcugaacgacguccuucugauucagcucucuagcccggcuaaucuguccgccagcguggcgacaguucagcuuccccaacaggaucagccugugccccauggaacccagugccuggccaugggcuggggccgggucggggcucacgacccucccgcccaagugcuccaggagcugaacgugacagucguuaccuucuuuugucgcccgcauaauaucugcacauucgugccuagacggaaagcuggaauuuguuuuggcgauucugggggaccccugaucugcgacggcaucauucaggggaucgauuccuucgugauuuggggaugugccacccgccucuuuccugacuucuuuacgagagucgcccuguacguggauuggauccggagcacccuucgcagaguugaagcuaagggccggcccuga

SEQ ID NO: 3226 - protein, 919 aa, Artificial Sequence
  PSA__Homo_sapiens__P55786
MWLAAAAPSLARRLLFLGPPPPPLLLLVFSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 3227 - RNA, 2760 nt, Artificial Sequence
  PSA__Homo_sapiens__CCDS45721.1
auguggcuggcagcugccgcccccucccucgcucgccgccugcucuuccucggcccuccgccuccuccccuccuccuucucgucuucagccgcuccucucgccgccgccuccacagccugggccucgccgcgaugccggagaagaggcccuucgagcggcugccugccgaugucucccccaucaacuacagccuuugccucaagcccgacuugcuggacuucaccuucgagggcaagcuggaggccgccgcccaggugaggcaggcgacuaaucagauugugaugaauugugcugauauugauauuauuacagcuucauaugcaccagaaggagaugaagaaauacaugcuacaggauuuaacuaucagaaugaagaugaaaaagucaccuugucuuucccuaguacucugcaaacagguacgggaaccuuaaagauagauuuuguuggagagcugaaugacaaaaugaaagguuucuauagaaguaaauauacuaccccuucuggagaggugcgcuaugcugcuguaacacaguuugaggcuacugaugcccgaagggcuuuuccuugcugggaugagccugcuaucaaagcaacuuuugauaucucauugguuguuccuaaagacagaguagcuuuaucaaacaugaauguaauugaccggaaaccauacccugaugaugaaaauuuaguggaagugaaguuugcccgcacaccuguuaugucuacauaucugguggcauuuguugugggugaauaugacuuuguagaaacaaggucaaaagaugguguguguguccguguuuacacuccuguuggcaaagcagagcaaggaaaauuugcguuagagguugcugcuaaaaccuugccuuuuuauaaggacuacuucaauguuccuuauccucuaccuaaaauugaucucauugcuauugcagacuuugcagcuggugccauggagaacuggggccuuguuacuuauagggagacugcauugcuuauugauccaaaaaauuccuguucuucaucccgccaguggguugcucugguugugggacaugaacucgcccaucaaugguuuggaaaucuuguuacuauggaaugguggacucaucuuugguuaaaugaagguuuugcauccuggauugaauaucuguguguagaccacugcuucccagaguaugauauuuggacucaguuuguuucugcugauuacacccgugcccaggagcuugacgccuuagauaacagccauccuauugaagucagugugggccauccaucugagguugaugagauauuugaugcuauaucauauagcaaaggugcaucugucauccgaaugcugcaugacuacauuggggauaaggacuuuaagaaaggaaugaacauguauuuaaccaaguuccaacaaaagaaugcugccacagaggaucucugggaaaguuuagaaaaugcuagugguaaaccuauagcagcugugaugaauaccuggaccaaacaaaugggauuuccccucauuuauguggaagcugaacagguagaagaugacagauuauugagguugucccaaaagaaguucugugcuggugggucauauguuggugaagauuguccccaguggauggucccuaucacaaucucuacuagugaagaccccaaccaggccaaacuaaaaauucuaauggacaagccagagaugaaugugguuuugaaaaaugucaaaccagaccaaugggugaaguuaaacuuaggaacaguuggguuuuaucggacccaguacagcucugccaugcuggaaaguuuauuaccaggcauucgugaccuuucucugcccccuguggaucgacuuggauuacagaaugaccucuucuccuuggcucgagcuggaaucauuagcacuguagagguucuaaaagucauggaggcuuuugugaaugagcccaauuauacuguauggagcgaccugagcuguaaccuggggauucucucaacucucuugucccacacagacuucuaugaggaaauccaggaguuugugaaagaugucuuuucaccuauaggggagagacugggcugggaccccaaaccuggagaaggucaucucgaugcacuccugaggggcuugguucugggaaaacuaggaaaagcaggacauaaggcaacguuagaagaagcccgucgucgguuuaaggaccacguggaaggaaaacagauucucuccgcugaucugaggaguccugucuaucugacuguuuugaagcauggugauggcacuacuuuagauauuauguuaaaacuucauaaacaagcagauaugcaagaagagaaaaaccgaaucgaaagaguccuuggcgcuacucuuuugccugaccugauucaaaaaguccucacguuugcacuuucagaagagguacguccacaggacacuguaucgguaauugguggaguagcuggaggcagcaagcaugguaggaaagcugcuuggaaauucauaaaggacaacugggaagaacuuuauaaccgauaccagggaggauucuuaauauccagacuaauaaagcuaucaguugagggauuugcaguugauaaaauggcuggagagguuaaggcuuucuucgagagucacccagcuccuucagcugagcguaccauccagcaguguugugaaaauauucugcugaaugcugccuggcuaaagcgagaugcugagagcauccaccaguaccuccuucagcggaaggccucaccacccacaguguga

SEQ ID NO: 3228 - RNA, 2760 nt, Artificial Sequence
  derived and/or modified sequence opt1 from PSA__Homo_sapiens__CCDS45721.1
auguggcuggccgccgcggcccccagccucgcccgccggcugcuguuccucggcccgcccccgccgccccugcugcuccugguguucucccgcagcucccggcgccggcugcacagccucgggcuggccgccaugcccgagaagcgccccuucgagcggcugcccgcggacgucucccccaucaacuacagccucugccugaagcccgaccugcucgacuucaccuucgagggcaagcuggaggccgccgcccaggugcgccaggcgaccaaccagaucgugaugaacugcgccgacaucgacaucaucacggccuccuacgcccccgagggggacgaggagauccacgccaccggcuucaacuaccagaacgaggacgagaaggucacccugagcuuccccuccacccuccagacggggaccggcacccugaagaucgacuucgugggcgagcugaacgacaagaugaagggguucuaccggagcaaguacaccacgccguccggcgaggugcgcuacgcggccgucacccaguucgaggccaccgacgcccggcgcgccuuccccugcugggacgagcccgcgaucaaggccaccuucgacaucagccucguggugcccaaggaccgggucgcccuguccaacaugaacgugaucgaccgcaagccguaccccgacgacgagaaccugguggaggucaaguucgcccggacgcccgugaugagcaccuaccucguggccuucgucgugggggaguacgacuucguggagacccgcuccaaggacggcgucugcgugcggguguacacccccgucgggaaggcggagcagggcaaguucgcccuggagguggccgccaagacgcugccguucuacaaggacuacuucaacgugcccuacccccuccccaagaucgaccugaucgccaucgcggacuucgccgccggcgccauggagaacugggggcuggucaccuaccgcgagaccgcgcuccugaucgacccgaagaacagcugcuccagcucccggcaguggguggcccuggucgugggccacgagcucgcccaccagugguucgggaaccuggugaccauggagugguggacgcaccuguggcucaacgagggcuucgccagcuggaucgaguaccugugcgucgaccacugcuuccccgaguacgacaucuggacccaguucgugagcgccgacuacacccgcgcgcaggagcuggacgcccucgacaacucccaccccaucgaggugagcgucggccaccccuccgagguggacgagaucuucgacgccaucagcuacuccaagggggccagcgugauccggaugcugcacgacuacaucggcgacaaggacuucaagaaggggaugaacauguaccugaccaaguuccagcagaagaacgccgcgacggaggaccucugggagucccuggagaacgccagcggcaagccgaucgccgccgucaugaacaccuggaccaagcagaugggguucccccugaucuacguggaggccgagcaggucgaggacgaccgccuccugcgccugucccagaagaaguucugcgcgggcggcagcuacgugggggaggacugcccccaguggauggugccgaucaccaucuccacgagcgaggaccccaaccaggccaagcucaagauccugauggacaagcccgagaugaacgugguccugaagaacgugaagcccgaccagugggugaagcugaaccucggcaccgucggguucuaccggacccaguacuccagcgccaugcuggagucccugcucccgggcauccgcgaccugagccugccgcccguggaccggcucgggcugcagaacgaccuguucucccucgcccgcgcgggcaucaucagcaccguggagguccugaaggugauggaggccuucgugaacgagcccaacuacacggucugguccgaccugagcugcaaccucggcauccugagcacccugcucucccacaccgacuucuacgaggagauccaggaguucgugaaggacguguucagccccaucggggagcggcugggcugggaccccaagcccggggagggccaccuggacgcccuccugcgcgggcugguccucggcaagcugggcaaggccgggcacaaggccacccuggaggaggcgcggcgccgguucaaggaccacguggagggcaagcagauccucuccgccgaccugcgcagccccguguaccugacgguccucaagcacggggacggcaccacccuggacaucaugcugaagcuccacaagcaggccgacaugcaggaggagaagaaccggaucgagcgcgugcugggcgccacccugcucccggaccugauccagaaggugcugaccuucgcccucuccgaggagguccggccccaggacacggugagcgugaucgggggcgucgccgggggcuccaagcacgggcgcaaggcggccuggaaguucaucaaggacaacugggaggagcuguacaaccgguaccagggcggcuuccugaucagccgccucaucaagcuguccguggagggguucgccguggacaagauggccggcgaggucaaggcguucuucgagagccaccccgcccccuccgccgagcggaccauccagcagugcugcgagaacauccugcucaacgccgcguggcugaagcgcgacgccgagagcauccaccaguaccugcuccagcggaaggccuccccgcccaccguguga

SEQ ID NO: 3229 - RNA, 2760 nt, Artificial Sequence
  derived and/or modified sequence opt2 from PSA__Homo_sapiens__CCDS45721.1
auguggcucgccgccgccgcccccucccucgcccgccgccuccucuuccucggcccccccccccccccccuccuccuccucgucuucucccgcuccucccgccgccgccuccacucccucggccucgccgccaugcccgagaagcgccccuucgagcgccuccccgccgacgucucccccaucaacuacucccucugccucaagcccgaccuccucgacuucaccuucgagggcaagcucgaggccgccgcccagguccgccaggccaccaaccagaucgucaugaacugcgccgacaucgacaucaucaccgccuccuacgcccccgagggcgacgaggagauccacgccaccggcuucaacuaccagaacgaggacgagaaggucacccucuccuuccccuccacccuccagaccggcaccggcacccucaagaucgacuucgucggcgagcucaacgacaagaugaagggcuucuaccgcuccaaguacaccacccccuccggcgagguccgcuacgccgccgucacccaguucgaggccaccgacgcccgccgcgccuuccccugcugggacgagcccgccaucaaggccaccuucgacaucucccucgucguccccaaggaccgcgucgcccucuccaacaugaacgucaucgaccgcaagcccuaccccgacgacgagaaccucgucgaggucaaguucgcccgcacccccgucauguccaccuaccucgucgccuucgucgucggcgaguacgacuucgucgagacccgcuccaaggacggcgucugcguccgcgucuacacccccgucggcaaggccgagcagggcaaguucgcccucgaggucgccgccaagacccuccccuucuacaaggacuacuucaacguccccuacccccuccccaagaucgaccucaucgccaucgccgacuucgccgccggcgccauggagaacuggggccucgucaccuaccgcgagaccgcccuccucaucgaccccaagaacuccugcuccuccucccgccagugggucgcccucgucgucggccacgagcucgcccaccagugguucggcaaccucgucaccauggagugguggacccaccucuggcucaacgagggcuucgccuccuggaucgaguaccucugcgucgaccacugcuuccccgaguacgacaucuggacccaguucgucuccgccgacuacacccgcgcccaggagcucgacgcccucgacaacucccaccccaucgaggucuccgucggccaccccuccgaggucgacgagaucuucgacgccaucuccuacuccaagggcgccuccgucauccgcaugcuccacgacuacaucggcgacaaggacuucaagaagggcaugaacauguaccucaccaaguuccagcagaagaacgccgccaccgaggaccucugggagucccucgagaacgccuccggcaagcccaucgccgccgucaugaacaccuggaccaagcagaugggcuucccccucaucuacgucgaggccgagcaggucgaggacgaccgccuccuccgccucucccagaagaaguucugcgccggcggcuccuacgucggcgaggacugcccccaguggaugguccccaucaccaucuccaccuccgaggaccccaaccaggccaagcucaagauccucauggacaagcccgagaugaacgucguccucaagaacgucaagcccgaccagugggucaagcucaaccucggcaccgucggcuucuaccgcacccaguacuccuccgccaugcucgagucccuccuccccggcauccgcgaccucucccucccccccgucgaccgccucggccuccagaacgaccucuucucccucgcccgcgccggcaucaucuccaccgucgagguccucaaggucauggaggccuucgucaacgagcccaacuacaccgucugguccgaccucuccugcaaccucggcauccucuccacccuccucucccacaccgacuucuacgaggagauccaggaguucgucaaggacgucuucucccccaucggcgagcgccucggcugggaccccaagcccggcgagggccaccucgacgcccuccuccgcggccucguccucggcaagcucggcaaggccggccacaaggccacccucgaggaggcccgccgccgcuucaaggaccacgucgagggcaagcagauccucuccgccgaccuccgcucccccgucuaccucaccguccucaagcacggcgacggcaccacccucgacaucaugcucaagcuccacaagcaggccgacaugcaggaggagaagaaccgcaucgagcgcguccucggcgccacccuccuccccgaccucauccagaagguccucaccuucgcccucuccgaggagguccgcccccaggacaccgucuccgucaucggcggcgucgccggcggcuccaagcacggccgcaaggccgccuggaaguucaucaaggacaacugggaggagcucuacaaccgcuaccagggcggcuuccucaucucccgccucaucaagcucuccgucgagggcuucgccgucgacaagauggccggcgaggucaaggccuucuucgagucccaccccgcccccuccgccgagcgcaccauccagcagugcugcgagaacauccuccucaacgccgccuggcucaagcgcgacgccgaguccauccaccaguaccuccuccagcgcaaggccuccccccccaccgucuga

SEQ ID NO: 3230 - RNA, 2760 nt, Artificial Sequence
  derived and/or modified sequence opt3 from PSA__Homo_sapiens__CCDS45721.1
auguggcuggccgcugcagcccccagccucgcgagaaggcuucuguucuugggcccuccaccgcccccuuuacugcuacucguguuuucccggucuucacgccgacgucugcacagucuugggcuggcugccaugccagagaagagacccuucgaaagguugccugcagacgucagcccaaucaacuacucccucugccugaaacccgaucugcucgacuuuaccuucgagggaaaguuagaagccgcugcacagguucggcaagccacaaaucagauugugaugaacugugcugauauagacaucauuacugccucuuaugcgccugagggugaugaagagauccaugcaacgggcuuuaauuaccagaacgaggacgaaaaaguaacccugucguucccaucaacacuucagacugggaccggaacauugaagauugauuuugugggcgagcugaaugacaaaaugaaggguuucuaucgcagcaaguacaccacuccgaguggggaagucagauaugccgcugugacacaauuugaggccaccgaugcaaggcgggcuuuccccugcugggacgagccugccaucaaagcgacguuugauauaucccuaguugugccaaaggaccgcgucgcccucucuaacaugaaugugaucgaucgaaaacccuacccugacgacgaaaaccugguagagguuaaguucgcaagaacuccagugaugagcaccuaucuugucgcuuuuguggugggagaauacgauuucgucgagacaagguccaaagacggcguuugugugcggguauacacucccgugggcaaggccgaacaggggaaguucgcucuggaggucgccgcaaaaaccuugccguuuuauaaggauuacuucaaugugccuuauccccucccaaaaauugaccugaucgccauugcugauuuugcggcaggagccauggagaacugggguuuaguuacauaccgugaaaccgcucugcucaucgacccuaaaaauucaugcaguagcucucgccaguggguggcccuugucgugggccacgagcuggcacaucagugguucgggaacuugguaacgauggaaugguggacucaccuauggcugaaugagggauuugccuccuggauagaauaucucuguguugaucauugcuuccccgaguacgacauuuggacacaauuugugucagcugauuauaccagagcccaggagcuggacgcacuugauaacagccacccaaucgaagucagugugggccaccccucugaggucgacgaaauuuucgacgcgaucuccuacagcaagggugcuucggugaucaggaugcugcaugauuacauuggggacaaggauuuuaaaaagggaaugaauauguauuugacuaaguuccagcagaaaaacgccgcaacagaggaccucugggaaucucuggagaacgccuccggcaagccuauagcugccguuaugaauaccuggacgaaacaaaugggcuuuccauuaaucuacguggaggcagaacagguagaggaugaccggcugcuacgacucucacagaagaaauucugugcugggggaaguuaugucggugaagauugcccgcaauggauggugcccauuaccaucagcacauccgaggacccuaaccaggccaagcugaagauacuuauggauaaaccagagaugaauguuguguugaagaacgucaaacccgaccagugggugaagcugaaucucggcacuguaggguuuuaccgcacccaguauucuagcgcgaugcuggaaucacuucugccuggaauuagagauuugagucucccacccguggacaggcugggcuuacaaaacgaucuguucucccuagcccgggcugguaucaucagcacaguugagguccucaaagugauggaagcauucgugaaugagccgaacuacacugucuggucugaccugucauguaaucuugggauuuugaguacccugcucagccacacagacuuuuaugaagagauccaggaguucguuaaggauguguuuuccccuauuggcgaacgccugggaugggacccaaagcccggcgaggggcauuuagaugcccugcuuagaggauuggugcucgguaaacugggcaaggcugggcacaaagccacccuagaagaggcaaggcgucgguucaaggaccacguagaaggaaaacagauacugucugcggaucuccgaucgccugucuaccugacugugcuuaagcauggcgacgguacgacauuggauaucaugcugaaguuacacaaacaggccgacaugcaagaggagaagaacagaauugaaaggguucucggggcuacccugcuucccgaucugauccagaaaguguugacuuuugcccucagcgaggaaguccgcccacaggacaccguguccguuaucggcggaguggcaggcgggucaaagcauggacggaaagcugccuggaaguucauuaaagauaauugggaggaacuguacaacagauaucaggguggcuuucuaauaaguaggcugaucaagcucucuguagagggguucgcagucgacaagauggccggagaggugaaagcguuuuucgaaagccacccugcucccuccgccgagcgcacaauucaacagugcugugaaaauauccugcuuaacgcagcuugguugaagcgagaugccgagucaauucaucaguaccuguuacagcggaaagccagcccaccgaccguguga

SEQ ID NO: 3231 - RNA, 2760 nt, Artificial Sequence
  derived and/or modified sequence opt4 from PSA__Homo_sapiens__CCDS45721.1
auguggcuggccgccgccgcccccagccuggccagaagacugcuguuccugggcccccccccccccccccugcugcugcugguguucagcagaagcagcagaagaagacugcacagccugggccuggccgccaugcccgagaagagacccuucgagagacugcccgccgacgugagccccaucaacuacagccugugccugaagcccgaccugcuggacuucaccuucgagggcaagcuggaggccgccgcccaggugagacaggccaccaaccagaucgugaugaacugcgccgacaucgacaucaucaccgccagcuacgcccccgagggcgacgaggagauccacgccaccggcuucaacuaccagaacgaggacgagaaggugacccugagcuuccccagcacccugcagaccggcaccggcacccugaagaucgacuucgugggcgagcugaacgacaagaugaagggcuucuacagaagcaaguacaccacccccagcggcgaggugagauacgccgccgugacccaguucgaggccaccgacgccagaagagccuuccccugcugggacgagcccgccaucaaggccaccuucgacaucagccugguggugcccaaggacagaguggcccugagcaacaugaacgugaucgacagaaagcccuaccccgacgacgagaaccugguggaggugaaguucgccagaacccccgugaugagcaccuaccugguggccuucguggugggcgaguacgacuucguggagaccagaagcaaggacggcgugugcgugagaguguacacccccgugggcaaggccgagcagggcaaguucgcccuggagguggccgccaagacccugcccuucuacaaggacuacuucaacgugcccuacccccugcccaagaucgaccugaucgccaucgccgacuucgccgccggcgccauggagaacuggggccuggugaccuacagagagaccgcccugcugaucgaccccaagaacagcugcagcagcagcagacaguggguggcccugguggugggccacgagcuggcccaccagugguucggcaaccuggugaccauggagugguggacccaccuguggcugaacgagggcuucgccagcuggaucgaguaccugugcguggaccacugcuuccccgaguacgacaucuggacccaguucgugagcgccgacuacaccagagcccaggagcuggacgcccuggacaacagccaccccaucgaggugagcgugggccaccccagcgagguggacgagaucuucgacgccaucagcuacagcaagggcgccagcgugaucagaaugcugcacgacuacaucggcgacaaggacuucaagaagggcaugaacauguaccugaccaaguuccagcagaagaacgccgccaccgaggaccugugggagagccuggagaacgccagcggcaagcccaucgccgccgugaugaacaccuggaccaagcagaugggcuucccccugaucuacguggaggccgagcagguggaggacgacagacugcugagacugagccagaagaaguucugcgccggcggcagcuacgugggcgaggacugcccccaguggauggugcccaucaccaucagcaccagcgaggaccccaaccaggccaagcugaagauccugauggacaagcccgagaugaacguggugcugaagaacgugaagcccgaccagugggugaagcugaaccugggcaccgugggcuucuacagaacccaguacagcagcgccaugcuggagagccugcugcccggcaucagagaccugagccugccccccguggacagacugggccugcagaacgaccuguucagccuggccagagccggcaucaucagcaccguggaggugcugaaggugauggaggccuucgugaacgagcccaacuacaccguguggagcgaccugagcugcaaccugggcauccugagcacccugcugagccacaccgacuucuacgaggagauccaggaguucgugaaggacguguucagccccaucggcgagagacugggcugggaccccaagcccggcgagggccaccuggacgcccugcugagaggccuggugcugggcaagcugggcaaggccggccacaaggccacccuggaggaggccagaagaagauucaaggaccacguggagggcaagcagauccugagcgccgaccugagaagccccguguaccugaccgugcugaagcacggcgacggcaccacccuggacaucaugcugaagcugcacaagcaggccgacaugcaggaggagaagaacagaaucgagagagugcugggcgccacccugcugcccgaccugauccagaaggugcugaccuucgcccugagcgaggaggugagaccccaggacaccgugagcgugaucggcggcguggccggcggcagcaagcacggcagaaaggccgccuggaaguucaucaaggacaacugggaggagcuguacaacagauaccagggcggcuuccugaucagcagacugaucaagcugagcguggagggcuucgccguggacaagauggccggcgaggugaaggccuucuucgagagccaccccgcccccagcgccgagagaaccauccagcagugcugcgagaacauccugcugaacgccgccuggcugaagagagacgccgagagcauccaccaguaccugcugcagagaaaggccagcccccccaccguguga

SEQ ID NO: 3232 - RNA, 2760 nt, Artificial Sequence
  derived and/or modified sequence opt5 from PSA__Homo_sapiens__CCDS45721.1
auguggcuggccgcugccgcgcccagccucgcuagacggcugcuuuuccugggcccuccgcccccuccccuccugcuucugguguuuucccgcucuagcagacggcgccuccacucccuggggcuggccgccaugccugagaagagacccuucgaacggcucccugcugacgucucuccgaucaacuacagccugugccuuaaacccgaucugcucgacuuuaccuucgagggaaagcuggaagccgcugcccagguucgccaagcgacaaaucagauugugaugaacugugccgauaucgacauuaucacggcuuccuaugccccugagggcgaugaagagauucaugcuaccggguuuaauuaccagaacgaggacgaaaaagugacacuuucuuuccccagcacccugcagacaggaaccggcacacucaagaucgauuuugucggggagcugaaugacaaaaugaagggauucuauagauccaaguacaccacgccuagcggcgaagugcgguaugccgcgguuacccaauuugaggccacagaugcucgcagagccuuccccugcugggacgagccggcuaucaaagccaccuuugauauuucucugguggucccuaaggaccggguggcccucuccaacaugaauguuaucgaucgcaaacccuacccugacgacgaaaaccugguggaggucaaguucgcuagaacacccgugaugagcaccuaucuuguggcguuugucguuggcgaauacgauuucguggagacgcggucuaaagacgggguguguguccgcguguacacacccguuggaaaggccgaacagggcaaguucgcucuggagguggccgccaaaacccucccuuuuuauaaggauuacuucaaugucccguauccccugccuaaaauugaccuuaucgcuauugccgauuuugcggcuggggccauggagaacuggggacuggugacauacagagaaaccgcccuccugaucgaccccaagaauagcugcuccucuucccggcaguggguugcucugguggucggccacgagcucgcccaucagugguucgggaaccuggugaccauggaaugguggacacaccuuuggcugaaugagggauuugcuagcuggauugaauaucucugugucgaucauugcuucccugaguacgacaucuggacgcaauuuguguccgccgauuauaccagagcgcaggagcuggacgcccuugauaacucucaccccaucgaaguuagcgugggccacccguccgaggucgacgaaauuuucgacgcuaucagcuacucuaaaggcgccuccgugauucgcaugcugcaugauuacaucggggacaaggauuuuaaaaagggaaugaauauguaucucacaaaguuccagcagaaaaacgcugccaccgaggaccugugggaaagccuggagaacgcgucuggcaagccuauugccgcuguuaugaauacauggaccaaacaaaugggguuuccccucaucuacguggaggccgaacaggucgaggaugaccggcugcuuagacugagccagaagaaauucugugcuggaggcuccuaugugggggaagauugcccucaauggauggugcccaucacgauuucuacaagcgaggacccuaaccaggccaagcucaagauccugauggauaaacccgagaugaauguuguccugaagaacgugaaaccggaccagugggugaaacuuaaucucggaaccgucggcuuuuaccgcacccaguauuccagcgccaugcuggaaucucugcucccuggcauucgggaucugucccuuccucccguggacagacuggggcuccaaaacgaucuguucagccuggcucgcgcgggaaucauuucuacaguugaggugcuuaaggucauggaagccuucgugaaugagcccaacuacaccguuugguccgaccucagcuguaaucugggcauccuguccacacuccugucucacacggacuuuuaugaagagauccaggaguucgugaaggaugucuuuagcccgauuggggaacggcuuggaugggaccccaagccuggcgaggggcaucuggaugcucuccugagaggccuggugcuuggaaaacucggcaaggccgggcacaaagccacccuggaagaggcucgccggagauucaaggaccacguugaaggaaaacagauccuguccgccgaucuccgcucucccguguaccugacaguccuuaagcauggcgacgggaccacacuggauauuaugcucaagcugcacaaacaggcggacaugcaagaggagaagaaccggaucgaaagagugcugggagcuacccuucucccugaucugauucagaaagugcugacguuugcccucagcgaggaaguccggccccaggacaccguuuccgugaucggcgggguggccggcggaagcaagcauggccgcaaagcugccuggaaguucauuaaagauaauugggaggaacuguacaacagauaucaagggggauuucuuaucucucggcugaucaagcucuccgucgagggcuucgcgguggacaagauggcuggggagguuaaagccuuuuucgaaagccacccugcccccucugcugagagaacaauucagcagugcugugaaaauauccugcugaacgccgcuuggcuuaagcgcgaugccgaguccauucaucaguaccugcuccagcggaaagcgagcccgccuaccguguga

SEQ ID NO: 3233 - protein, 219 aa, Artificial Sequence
  PSB9__Homo_sapiens__P28065
MLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 3234 - RNA, 660 nt, Artificial Sequence
  PSB9__Homo_sapiens__AAH65513
augcugcgggcgggagcaccaaccggggacuuaccccgggcgggagaaguccacaccgggaccaccaucauggcaguggaguuugacgggggcguugugauggguucugauucccgagugucugcaggcgaggcgguggugaaccgaguguuugacaagcuguccccgcugcacgagcgcaucuacugugcacucucugguucagcugcugaugcccaagccguggccgacauggccgccuaccagcuggagcuccaugggauagaacuggaggaaccuccacuuguuuuggcugcugcaaauguggugagaaauaucagcuauaaauaucgagaggacuugucugcacaucucaugguagcuggcugggaccaacgugaaggaggucagguauauggaacccugggaggaaugcugacucgacagccuuuugccauugguggcuccggcagcaccuuuaucuaugguuauguggaugcagcauauaagccaggcaugucucccgaggagugcaggcgcuucaccacagacgcuauugcucuggccaugagccgggauggcucaagcgggggugucaucuaccuggucacuauuacagcugccgguguggaccaucgagucaucuugggcaaugaacugccaaaauucuaugaugaguga

SEQ ID NO: 3235 - RNA, 660 nt, Artificial Sequence
  derived and/or modified sequence opt1 from PSB9__Homo_sapiens__AAH65513
augcugcgcgccggcgcccccaccggggaccucccgcgggcgggcgaggugcacaccgggacgaccaucauggccgucgaguucgacggcgggguggugaugggcagcgacucccgcgucagcgccggcgaggccguggugaaccgggucuucgacaagcugagcccccugcacgagcgcaucuacugcgcccucuccggguccgcggccgacgcccaggccguggcggacauggccgccuaccagcuggagcugcacggcaucgagcucgaggagccgccccuggugcuggccgccgcgaacgucgugcggaacaucagcuacaaguaccgcgaggaccucuccgcccaccugaugguggccgggugggaccagcgggagggcgggcaggucuacggcacccugggcgggaugcucacccgccagcccuucgccaucggcgggagcggcuccacguucaucuacggcuacguggacgccgcguacaagcccgggaugagccccgaggagugccggcgcuucaccaccgacgccaucgcccuggccaugucccgggacggcagcuccgggggcgugaucuaccuggucaccaucacggccgcggggguggaccaccgcgugauccucggcaacgagcugcccaaguucuacgacgaguga

SEQ ID NO: 3236 - RNA, 660 nt, Artificial Sequence
  derived and/or modified sequence opt2 from PSB9__Homo_sapiens__AAH65513
augcuccgcgccggcgcccccaccggcgaccucccccgcgccggcgagguccacaccggcaccaccaucauggccgucgaguucgacggcggcgucgucaugggcuccgacucccgcgucuccgccggcgaggccgucgucaaccgcgucuucgacaagcucuccccccuccacgagcgcaucuacugcgcccucuccggcuccgccgccgacgcccaggccgucgccgacauggccgccuaccagcucgagcuccacggcaucgagcucgaggagcccccccucguccucgccgccgccaacgucguccgcaacaucuccuacaaguaccgcgaggaccucuccgcccaccucauggucgccggcugggaccagcgcgagggcggccaggucuacggcacccucggcggcaugcucacccgccagcccuucgccaucggcggcuccggcuccaccuucaucuacggcuacgucgacgccgccuacaagcccggcaugucccccgaggagugccgccgcuucaccaccgacgccaucgcccucgccaugucccgcgacggcuccuccggcggcgucaucuaccucgucaccaucaccgccgccggcgucgaccaccgcgucauccucggcaacgagcuccccaaguucuacgacgaguga

SEQ ID NO: 3237 - RNA, 660 nt, Artificial Sequence
  derived and/or modified sequence opt3 from PSB9__Homo_sapiens__AAH65513
augcugagagccggcgcucccaccggggaccucccuagggcaggagaggugcacacagguacuacgaucauggccgucgaguucgauggcgggguugugaugggaagcgacucccggguaucugcgggcgaagcuguggucaaccgcguguuugauaaacuuucaccacugcaugaacgaauuuacugcgccuugagugguagcgcagccgacgcucaggcaguugccgauauggcugccuaucaauuagagcugcacgggauagaacuagaggagccgccccucgugcuggcggcagccaaugucgugcguaacaucuccuacaaguauagagaagaccuuucugcucaucugaugguagccggaugggaucagagggagggcggccagguuuacgggaccuugggagguaugcucacacggcagccuuucgcaauuggcgggucgggaucaacuuuuaucuauggcuacguggacgcugccuauaagccagguaugagccccgaagagugucgcagauucaccacagaugcgauugcccuggcaaugaguagggacggguccucuggaggcgucaucuaccuggugaccauaacugcugccggcguggaucaccgggucauccucgggaaugaguuaccuaaauuuuacgacgaauga

SEQ ID NO: 3238 - RNA, 660 nt, Artificial Sequence
  derived and/or modified sequence opt4 from PSB9__Homo_sapiens__AAH65513
augcugagagccggcgcccccaccggcgaccugcccagagccggcgaggugcacaccggcaccaccaucauggccguggaguucgacggcggcguggugaugggcagcgacagcagagugagcgccggcgaggccguggugaacagaguguucgacaagcugagcccccugcacgagagaaucuacugcgcccugagcggcagcgccgccgacgcccaggccguggccgacauggccgccuaccagcuggagcugcacggcaucgagcuggaggagcccccccuggugcuggccgccgccaacguggugagaaacaucagcuacaaguacagagaggaccugagcgcccaccugaugguggccggcugggaccagagagagggcggccagguguacggcacccugggcggcaugcugaccagacagcccuucgccaucggcggcagcggcagcaccuucaucuacggcuacguggacgccgccuacaagcccggcaugagccccgaggagugcagaagauucaccaccgacgccaucgcccuggccaugagcagagacggcagcagcggcggcgugaucuaccuggugaccaucaccgccgccggcguggaccacagagugauccugggcaacgagcugcccaaguucuacgacgaguga

SEQ ID NO: 3239 - RNA, 660 nt, Artificial Sequence
  derived and/or modified sequence opt5 from PSB9__Homo_sapiens__AAH65513
augcugagagccggcgcucccaccggggaccucccucgggccggagaggugcacacaggcacgaccaucauggcggucgaguucgaugggggaguugugaugggcagcgacucccgcgugucugcuggggaggccgucgugaacagaguuuuugauaagcugagcccgcuucaugaacggauuuacugcgcccuguccggaucugcugccgacgcucaggccguggcggauauggccgcuuaucaacucgagcugcacggcaucgaacuugaggagcccccucugguccucgccgcugccaaugugguucgcaacauuagcuacaaauauagagaagaccuguccgcgcaucugaugguggccggcugggaucagcgggaagggggacaggucuacggcacacucgggggaaugcugacccgccagcccuucgcuaucggcgggucuggaagcacauuuauuuauggcuacguggacgccgcuuauaagccuggcaugucccccgaagaguguagacgguucaccacagaugccaucgcccuugcuaugagccgcgacgggucuuccggaggcgugaucuaccuggucaccauuacggcggccgggguugaucacagagugauccucggaaaugagcugccuaaauuuuacgacgaauga

SEQ ID NO: 3240 - protein, 114 aa, Artificial Sequence
  PSCA__Homo_sapiens__D3DWI6
MAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 3241 - RNA, 345 nt, Artificial Sequence
  PSCA__Homo_sapiens__EAW82312
auggcaggcuuggcccugcagccaggcacugcccugcugugcuacuccugcaaagcccaggugagcaacgaggacugccugcagguggagaacugcacccagcugggggagcagugcuggaccgcgcgcauccgcgcaguuggccuccugaccgucaucagcaaaggcugcagcuugaacugcguggaugacucacaggacuacuacgugggcaagaagaacaucacgugcugugacaccgacuugugcaacgccagcggggcccaugcccugcagccggcugcugccauccuugcgcugcucccugcacucggccugcugcucuggggacccggccagcucuag

SEQ ID NO: 3242 - RNA, 345 nt, Artificial Sequence
  derived and/or modified sequence opt1 from PSCA__Homo_sapiens__EAW82312
auggccggccuggcccuccagcccgggaccgcgcugcugugcuacagcugcaaggcccagguguccaacgaggacugccuccaggucgagaacugcacccagcugggcgagcagugcuggaccgcccgcauccgggccguggggcugcucaccgugaucagcaagggcugcucccugaacugcgucgacgacagccaggacuacuacguggggaagaagaacaucacgugcugcgacaccgaccugugcaacgccuccggcgcgcacgcccuccagccggccgccgcgauccuggcccugcuccccgcccugggccugcuccugugggggcccggccagcuguga

SEQ ID NO: 3243 - RNA, 345 nt, Artificial Sequence
  derived and/or modified sequence opt2 from PSCA__Homo_sapiens__EAW82312
auggccggccucgcccuccagcccggcaccgcccuccucugcuacuccugcaaggcccaggucuccaacgaggacugccuccaggucgagaacugcacccagcucggcgagcagugcuggaccgcccgcauccgcgccgucggccuccucaccgucaucuccaagggcugcucccucaacugcgucgacgacucccaggacuacuacgucggcaagaagaacaucaccugcugcgacaccgaccucugcaacgccuccggcgcccacgcccuccagcccgccgccgccauccucgcccuccuccccgcccucggccuccuccucuggggccccggccagcucuga

SEQ ID NO: 3244 - RNA, 345 nt, Artificial Sequence
  derived and/or modified sequence opt3 from PSCA__Homo_sapiens__EAW82312
auggccggccuggcucuccagcccgggaccgcacuucugugcuacagcuguaaggcccaaguguccaacgaggacugcuugcaggucgaaaauuguacacaguuaggagagcagugcuggacugcgagaaucagggcuguuggucugcuaacggugauuucuaaaggcuguucacucaacugcguagaugacagucaagauuauuacguggggaagaaaaauauaaccuguugcgacacagaucuguguaacgccagcggagcacacgcccuucagccugcugcagccauccuggcuuugcucccagcccugggccugcucuuaugggguccggggcagcuguga

SEQ ID NO: 3245 - RNA, 345 nt, Artificial Sequence
  derived and/or modified sequence opt4 from PSCA__Homo_sapiens__EAW82312
auggccggccuggcccugcagcccggcaccgcccugcugugcuacagcugcaaggcccaggugagcaacgaggacugccugcagguggagaacugcacccagcugggcgagcagugcuggaccgccagaaucagagccgugggccugcugaccgugaucagcaagggcugcagccugaacugcguggacgacagccaggacuacuacgugggcaagaagaacaucaccugcugcgacaccgaccugugcaacgccagcggcgcccacgcccugcagcccgccgccgccauccuggcccugcugcccgcccugggccugcugcuguggggccccggccagcuguga

SEQ ID NO: 3246 - RNA, 345 nt, Artificial Sequence
  derived and/or modified sequence opt5 from PSCA__Homo_sapiens__EAW82312
auggccggccuggcucuccagcccgggaccgcccugcuuugcuacagcuguaaggcgcaaguguccaacgaggacugccugcaggucgaaaauuguacacagcucggagagcagugcuggacggcuagaauccgggccguuggccugcuuaccgugauuucuaaaggguguagccugaacugcguggaugacucccaagauuauuacgucggaaagaaaaauaucacauguugcgacaccgaucucuguaacgccucuggcgcucacgcccugcagccugcugccgcgauucuggcccuccugccggcucuugggcugcuccuguggggacccggccagcuuuga

SEQ ID NO: 3247 - protein, 123 aa, Artificial Sequence
  PSCA__Homo_sapiens__O43653
MKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 3248 - RNA, 372 nt, Artificial Sequence
  PSCA__Homo_sapiens__AAC39607
augaaggcugugcugcuugcccuguugauggcaggcuuggcccugcagccaggcacugcccugcugugcuacuccugcaaagcccaggugagcaacgaggacugccugcagguggagaacugcacccagcugggggagcagugcuggaccgcgcgcauccgcgcaguuggccuccugaccgucaucagcaaaggcugcagcuugaacugcguggaugacucacaggacuacuacgugggcaagaagaacaucacgugcugugacaccgacuugugcaacgccagcggggcccaugcccugcagccggcugccgccauccuugcgcugcucccugcacucggccugcugcucuggggacccggccagcuauag

SEQ ID NO: 3249 - RNA, 372 nt, Artificial Sequence
  derived and/or modified sequence opt1 from PSCA__Homo_sapiens__AAC39607
augaaggccgugcugcucgcccugcugauggcgggccucgcccugcagcccgggaccgcccugcucugcuacagcugcaaggcccaggucuccaacgaggacugccuccagguggagaacugcacccagcugggcgagcagugcuggaccgcccgcauccgggcgguggggcugcugaccgucaucagcaagggcugcucccugaacugcguggacgacagccaggacuacuacguggggaagaagaacaucacgugcugcgacaccgaccucugcaacgccuccggcgcccacgcccugcagccggcggccgccauccuggcccuccugcccgcccugggccuccugcugugggggcccggccagcucuga

SEQ ID NO: 3250 - RNA, 372 nt, Artificial Sequence
  derived and/or modified sequence opt2 from PSCA__Homo_sapiens__AAC39607
augaaggccguccuccucgcccuccucauggccggccucgcccuccagcccggcaccgcccuccucugcuacuccugcaaggcccaggucuccaacgaggacugccuccaggucgagaacugcacccagcucggcgagcagugcuggaccgcccgcauccgcgccgucggccuccucaccgucaucuccaagggcugcucccucaacugcgucgacgacucccaggacuacuacgucggcaagaagaacaucaccugcugcgacaccgaccucugcaacgccuccggcgcccacgcccuccagcccgccgccgccauccucgcccuccuccccgcccucggccuccuccucuggggccccggccagcucuga

SEQ ID NO: 3251 - RNA, 372 nt, Artificial Sequence
  derived and/or modified sequence opt3 from PSCA__Homo_sapiens__AAC39607
augaaggccgugcugcucgcacuucugauggcuggcuuggccuuacagcccgggaccgcgcugcuaugcuacagcuguaaagcucaagucuccaacgaggacugccuccagguugaaaauuguacacagcugggagagcagugcuggacugccagaaucagggcagugggucuucugacgguaauuucuaagggcuguucauugaacugcguggaugacagucaagauuauuacgucgggaaaaagaauauaaccuguugcgacacagaucucuguaacgccagcggagcucacgcacugcagccugccgcugccauccuggcgcucuuaccagcacugggccuuuugcugugggguccggggcagcuauga

SEQ ID NO: 3252 - RNA, 372 nt, Artificial Sequence
  derived and/or modified sequence opt4 from PSCA__Homo_sapiens__AAC39607
augaaggccgugcugcuggcccugcugauggccggccuggcccugcagcccggcaccgcccugcugugcuacagcugcaaggcccaggugagcaacgaggacugccugcagguggagaacugcacccagcugggcgagcagugcuggaccgccagaaucagagccgugggccugcugaccgugaucagcaagggcugcagccugaacugcguggacgacagccaggacuacuacgugggcaagaagaacaucaccugcugcgacaccgaccugugcaacgccagcggcgcccacgcccugcagcccgccgccgccauccuggcccugcugcccgcccugggccugcugcuguggggccccggccagcuguga

SEQ ID NO: 3253 - RNA, 372 nt, Artificial Sequence
  derived and/or modified sequence opt5 from PSCA__Homo_sapiens__AAC39607
augaaggccgugcugcucgcucugcuuauggccggccuggcgcuccagcccgggaccgcucugcuuugcuacagcuguaaagcccaagucuccaacgaggacugccugcagguugaaaauuguacacagcucggagagcagugcuggacggccagaauccgggcugugggccugcugaccgugauuucuaagggguguagccucaacugcgucgaugacucccaagauuauuacgugggcaaaaagaauaucacauguugcgacaccgaucuguguaacgccucuggagcucacgcccuucagccugcggccgcuauucuggcccuccugccggcucuugggcugcuccuguggggacccggccagcuguga

SEQ ID NO: 3254 - protein, 320 aa, Artificial Sequence
  PSGR__Homo_sapiens__Q9H255
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 3255 - RNA, 963 nt, Artificial Sequence
  PSGR__Homo_sapiens__AAG40776
augaguuccugcaacuucacacaugccaccuuugugcuuauugguaucccaggauuagagaaagcccauuucuggguuggcuucccccuccuuuccauguauguaguggcaauguuuggaaacugcaucguggucuucaucguaaggacggaacgcagccugcacgcuccgauguaccucuuucucugcaugcuugcagccauugaccuggccuuauccacauccaccaugccuaagauccuugcccuuuucugguuugauucccgagagauuagcuuugaggccugucuuacccagauguucuuuauucaugcccucucagccauugaauccaccauccugcuggccauggccuuugaccguuauguggccaucugccacccacugcgccaugcugcagugcucaacaauacaguaacagcccagauuggcaucguggcugugguccgcggaucccucuuuuuuuucccacugccucugcugaucaagcggcuggccuucugccacuccaauguccucucgcacuccuauuguguccaccaggauguaaugaaguuggccuaugcagacacuuugcccaaugugguauauggucuuacugccauucugcuggucaugggcguggacguaauguucaucuccuuguccuauuuucugauaauacgaacgguucugcaacugccuuccaagucagagcgggccaaggccuuuggaaccugugugucacacauuggugugguacucgccuucuaugugccacuuauuggccucucaguuguacaccgcuuuggaaacagccuucaucccauugugcguguugucaugggugacaucuaccugcugcugccuccugucaucaaucccaucaucuauggugccaaaaccaaacagaucagaacacgggugcuggcuauguucaagaucagcugugacaaggacuugcaggcugugggaggcaaguga

SEQ ID NO: 3256 - RNA, 963 nt, Artificial Sequence
  derived and/or modified sequence opt1 from PSGR__Homo_sapiens__AAG40776
augagcuccugcaacuucacccacgccaccuucgugcugaucggcauccccgggcucgagaaggcccacuucugggucggcuucccgcugcugagcauguacgugguggcgauguucgggaacugcaucgucguguucaucgugcgcacggagcggucccuccacgcccccauguaccuguuccugugcaugcucgccgccaucgaccuggcccugagcaccuccaccaugcccaagauccucgcgcuguucugguucgacagccgcgagaucuccuucgaggccugccugacccagauguucuucauccacgcccucagcgccaucgaguccacgauccugcuggcgauggccuucgaccgguacgucgccaucugccacccccuccgccacgccgccgugcugaacaacaccgugaccgcgcagaucggcaucgucgccguggugcgggggagccuguucuucuucccgcucccccugcugaucaagcgccucgccuucugccacuccaacguccugagccacuccuacugcgugcaccaggacgugaugaagcuggccuacgccgacacccuccccaacgucguguacggccugacggcgauccugcucgugaugggcgucgacgugauguucaucagccuguccuacuuccugaucauccggaccgugcuccagcugcccagcaaguccgagcgcgccaaggccuucgggaccugcgucagccacaucggcguggugcuggccuucuacgucccgcucaucgggcuguccgugguccaccgguucggcaacagccugcaccccaucgugcgcguggucaugggggacaucuaccuccugcugccgcccgugaucaaccccaucaucuacggcgccaagaccaagcagauccggacgcgcgugcucgcgauguucaagaucagcugcgacaaggaccugcaggccgucggcgggaaguga

SEQ ID NO: 3257 - RNA, 963 nt, Artificial Sequence
  derived and/or modified sequence opt2 from PSGR__Homo_sapiens__AAG40776
auguccuccugcaacuucacccacgccaccuucguccucaucggcauccccggccucgagaaggcccacuucugggucggcuucccccuccucuccauguacgucgucgccauguucggcaacugcaucgucgucuucaucguccgcaccgagcgcucccuccacgcccccauguaccucuuccucugcaugcucgccgccaucgaccucgcccucuccaccuccaccaugcccaagauccucgcccucuucugguucgacucccgcgagaucuccuucgaggccugccucacccagauguucuucauccacgcccucuccgccaucgaguccaccauccuccucgccauggccuucgaccgcuacgucgccaucugccacccccuccgccacgccgccguccucaacaacaccgucaccgcccagaucggcaucgucgccgucguccgcggcucccucuucuucuucccccucccccuccucaucaagcgccucgccuucugccacuccaacguccucucccacuccuacugcguccaccaggacgucaugaagcucgccuacgccgacacccuccccaacgucgucuacggccucaccgccauccuccucgucaugggcgucgacgucauguucaucucccucuccuacuuccucaucauccgcaccguccuccagcuccccuccaaguccgagcgcgccaaggccuucggcaccugcgucucccacaucggcgucguccucgccuucuacgucccccucaucggccucuccgucguccaccgcuucggcaacucccuccaccccaucguccgcgucgucaugggcgacaucuaccuccuccucccccccgucaucaaccccaucaucuacggcgccaagaccaagcagauccgcacccgcguccucgccauguucaagaucuccugcgacaaggaccuccaggccgucggcggcaaguga

SEQ ID NO: 3258 - RNA, 963 nt, Artificial Sequence
  derived and/or modified sequence opt3 from PSGR__Homo_sapiens__AAG40776
augagcuccugcaacuucacccacgccacauuugugcugaucggcauucccgggcucgagaaggcucauuucugggucggauuuccucuucugucuauguacguuguggcaauguucgguaauuguauaguaguguuuaucgucagaacugaaaggucauugcacgccccaauguauuuauuccugugcaugcuagcggcuauugaccucgcccugaguacgagcaccaugccgaaaauccuugcacuguuuugguucgauucccgggagauuucuuuugaagccuguuugacacagauguucuuuauccaugcucucucggcaauagagucaacuauccugcuggccauggcuuucgaccgcuacguggccauuugccacccccuccgacaugcggcaguuuuaaacaauaccgugacagcccaaaucggcauugucgcugugguacgugggagccuguuuuucuucccucuuccauugcugaucaagagacuagccuuuugucacaguaacguucucucccacucuuauugcgugcaucaggaugucaugaaacuggcauacgcugacacccuucccaaugugguguauggacugacugccauauugcucgucaugggcguugaugugauguucauuagccuguccuacuuuuuaaucauuaggacaguacugcagcucccuucaaagagugaacgggcgaaagccuucgguaccugugugagccacaucggggucgugcuugcauuuuauguuccacugaucggauugucugugguccaucgcuucggcaacucccuacaccccauugugagaguaguuaugggcgacauauaccugcuccugccuccagugaucaauccgauuaucuacggggcuaagacgaagcagauaaggacucggguccuugccauguuuaaaauuucaugcgauaaggaccugcaagcugugggagguaaauga

SEQ ID NO: 3259 - RNA, 963 nt, Artificial Sequence
  derived and/or modified sequence opt4 from PSGR__Homo_sapiens__AAG40776
augagcagcugcaacuucacccacgccaccuucgugcugaucggcauccccggccuggagaaggcccacuucugggugggcuucccccugcugagcauguacgugguggccauguucggcaacugcaucgugguguucaucgugagaaccgagagaagccugcacgcccccauguaccuguuccugugcaugcuggccgccaucgaccuggcccugagcaccagcaccaugcccaagauccuggcccuguucugguucgacagcagagagaucagcuucgaggccugccugacccagauguucuucauccacgcccugagcgccaucgagagcaccauccugcuggccauggccuucgacagauacguggccaucugccacccccugagacacgccgccgugcugaacaacaccgugaccgcccagaucggcaucguggccguggugagaggcagccuguucuucuucccccugccccugcugaucaagagacuggccuucugccacagcaacgugcugagccacagcuacugcgugcaccaggacgugaugaagcuggccuacgccgacacccugcccaacgugguguacggccugaccgccauccugcuggugaugggcguggacgugauguucaucagccugagcuacuuccugaucaucagaaccgugcugcagcugcccagcaagagcgagagagccaaggccuucggcaccugcgugagccacaucggcguggugcuggccuucuacgugccccugaucggccugagcguggugcacagauucggcaacagccugcaccccaucgugagaguggugaugggcgacaucuaccugcugcugccccccgugaucaaccccaucaucuacggcgccaagaccaagcagaucagaaccagagugcuggccauguucaagaucagcugcgacaaggaccugcaggccgugggcggcaaguga

SEQ ID NO: 3260 - RNA, 963 nt, Artificial Sequence
  derived and/or modified sequence opt5 from PSGR__Homo_sapiens__AAG40776
augagcuccugcaacuucacccacgccacauuugugcugaucggcauucccgggcucgagaaggcucauuucugggugggauuuccucugcuuucuauguacguuguggccauguucggcaauuguaucguggucuuuauugugagaacggaacggagccugcacgcgccgauguaucucuuccugugcaugcuugcugccaucgaccuggcccucuccaccucuacaaugcccaaaauucuggcucuguuuugguucgauagccgcgagaucuccuuugaagccugucucacccagauguucuuuauccaugcucugucugccauugagagcacaauccuucuggcgauggccuucgacagauacguugcuauuugccacccucuccggcaugccgcugugcugaacaauaccgucacagcccaaaucgggauuguggcgguugugcgcggaucccuguuuuucuucccccuuccucuccugaucaagagacuggccuuuugucacagcaacguccucucucacuccuauugcgugcaucaggaugugaugaaacuggcuuacgccgacacccuucccaaugucguuuauggccugacggcuauucuccuggugauggggguggaugucauguucaucagccuuucuuacuuucugaucauucggaccgugcuccagcugccuuccaagagcgaacgcgccaaagccuucggaacauguguuucucacaucggcgugguccuggcuuuuuaugugccgcucauuggccuguccguugugcauagauucgggaacagccuucaccccaucguccggguggucaugggagacauuuaccugcuccugccucccgugaucaauccuaucauuuacggcgcgaagaccaagcagauccgcacaagaguucuugccauguuuaaaauuuccugcgauaaggaccugcaagcugucgggggaaaauga

SEQ ID NO: 3261 - protein, 750 aa, Artificial Sequence
  PSM__Homo_sapiens__Q04609
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 3262 - RNA, 2253 nt, Artificial Sequence
  PSM__Homo_sapiens__AAA60209
auguggaaucuccuucacgaaaccgacucggcuguggccaccgcgcgccgcccgcgcuggcugugcgcuggggcgcuggugcuggcggguggcuucuuucuccucggcuuccucuucgggugguuuauaaaauccuccaaugaagcuacuaacauuacuccaaagcauaauaugaaagcauuuuuggaugaauugaaagcugagaacaucaagaaguucuuauauaauuuuacacagauaccacauuuagcaggaacagaacaaaacuuucagcuugcaaagcaaauucaaucccaguggaaagaauuuggccuggauucuguugagcuagcacauuaugauguccuguuguccuacccaaauaagacucaucccaacuacaucucaauaauuaaugaagauggaaaugagauuuucaacacaucauuauuugaaccaccuccuccaggauaugaaaauguuucggauauuguaccaccuuucagugcuuucucuccucaaggaaugccagagggcgaucuaguguauguuaacuaugcacgaacugaagacuucuuuaaauuggaacgggacaugaaaaucaauugcucugggaaaauuguaauugccagauaugggaaaguuuucagaggaaauaagguuaaaaaugcccagcuggcaggggccaaaggagucauucucuacuccgacccugcugacuacuuugcuccuggggugaaguccuauccagaugguuggaaucuuccuggaggugguguccagcguggaaauauccuaaaucugaauggugcaggagacccucucacaccagguuacccagcaaaugaauaugcuuauaggcguggaauugcagaggcuguuggucuuccaaguauuccuguucauccaauuggauacuaugaugcacagaagcuccuagaaaaaauggguggcucagcaccaccagauagcagcuggagaggaagucucaaagugcccuacaauguuggaccuggcuuuacuggaaacuuuucuacacaaaaagucaagaugcacauccacucuaccaaugaagugacaagaauuuacaaugugauagguacucucagaggagcaguggaaccagacagauaugucauucugggaggucaccgggacucauggguguuuggugguauugacccucagaguggagcagcuguuguucaugaaauugugaggagcuuuggaacacugaaaaaggaaggguggagaccuagaagaacaauuuuguuugcaagcugggaugcagaagaauuuggucuucuugguucuacugagugggcagaggagaauucaagacuccuucaagagcguggcguggcuuauauuaaugcugacucaucuauagaaggaaacuacacucugagaguugauuguacaccgcugauguacagcuugguacacaaccuaacaaaagagcugaaaagcccugaugaaggcuuugaaggcaaaucucuuuaugaaaguuggacuaaaaaaaguccuuccccagaguucaguggcaugcccaggauaagcaaauugggaucuggaaaugauuuugagguguucuuccaacgacuuggaauugcuucaggcagagcacgguauacuaaaaauugggaaacaaacaaauucagcggcuauccacuguaucacagugucuaugaaacauaugaguugguggaaaaguuuuaugauccaauguuuaaauaucaccucacuguggcccagguucgaggagggaugguguuugagcuagccaauuccauagugcucccuuuugauugucgagauuaugcuguaguuuuaagaaaguaugcugacaaaaucuacaguauuucuaugaaacauccacaggaaaugaagacauacaguguaucauuugauucacuuuuuucugcaguaaagaauuuuacagaaauugcuuccaaguucagugagagacuccaggacuuugacaaaagcaacccaauaguauuaagaaugaugaaugaucaacucauguuucuggaaagagcauuuauugauccauuaggguuaccagacaggccuuuuuauaggcaugucaucuaugcuccaagcagccacaacaaguaugcaggggagucauucccaggaauuuaugaugcucuguuugauauugaaagcaaaguggacccuuccaaggccuggggagaagugaagagacagauuuauguugcagccuucacagugcaggcagcugcagagacuuugagugaaguagccuaa

SEQ ID NO: 3263 - RNA, 2253 nt, Artificial Sequence
  derived and/or modified sequence opt1 from PSM__Homo_sapiens__AAA60209
auguggaaccugcuccacgagaccgacagcgccguggccaccgcgcgccggccccgcuggcugugcgccggggcccugguccucgccgggggcuucuuccugcugggguuccucuucggcugguucaucaaguccagcaacgaggccacgaacaucaccccgaagcacaacaugaaggcguuccuggacgagcugaaggccgagaacaucaagaaguuccucuacaacuucacccagaucccccaccuggccgggaccgagcagaacuuccagcuggccaagcagauccagucccaguggaaggaguucggccucgacagcguggagcuggcgcacuacgacgugcugcucuccuaccccaacaagacgcaccccaacuacaucagcaucaucaacgaggacggcaacgagaucuucaacaccucccuguucgagccgcccccgcccggguacgagaacgucagcgacaucgugccgcccuucuccgccuucagcccccagggcaugcccgagggggaccugguguacgucaacuacgcccggaccgaggacuucuucaagcucgagcgcgacaugaagaucaacugcuccggcaagaucgugaucgcccgguacgggaagguguuccgcggcaacaaggucaagaacgcccagcuggcgggcgccaagggggugauccuguacagcgaccccgccgacuacuucgcccccggcgugaaguccuaccccgacggguggaaccuccccggcggcgggguccagcggggcaacauccugaaccugaacggggccggcgacccgcucacccccggguaccccgcgaacgaguacgccuaccgccggggcaucgccgaggccgugggccugcccagcaucccggugcaccccaucggguacuacgacgcccagaagcugcucgagaagaugggcggguccgcgccgcccgacagcuccuggcgcggcagccugaagguccccuacaacguggggcccggcuucacgggcaacuucuccacccagaaggugaagaugcacauccacagcaccaacgaggucacccggaucuacaacgugaucgggacgcugcgcggcgccguggagcccgaccgguacgucauccucgggggccaccgcgacagcuggguguucgggggcaucgacccccaguccggcgccgccgugguccacgagaucgugcggagcuucgggacccugaagaaggagggcuggcgcccgcggcgcaccauccuguucgccuccugggacgcggaggaguucgggcuccugggcagcaccgagugggccgaggagaacucccggcugcuccaggagcgcggcgucgccuacaucaacgccgacagcuccaucgaggggaacuacacgcugcggguggacugcacgccccugauguacagccucgugcacaaccugaccaaggagcugaagucccccgacgagggcuucgagggcaagagccucuacgaguccuggaccaagaaguccccgagccccgaguucagcgggaugccccgcaucuccaagcuggggagcggcaacgacuucgaggucuucuuccagcgccugggcaucgcguccgggcgggcccgcuacaccaagaacugggagaccaacaaguucagcggcuacccccucuaccacuccguguacgagaccuacgagcugguggagaaguucuacgacccgauguucaaguaccaccugaccgucgcccaggugcgcgggggcaugguguucgagcucgccaacagcaucguccugcccuucgacugccgggacuacgccguggugcugcggaaguacgcggacaagaucuacagcaucuccaugaagcacccccaggagaugaagacguacagcgucuccuucgacagccuguucuccgccgugaagaacuucaccgagaucgccagcaaguucuccgagcgccuccaggacuucgacaagagcaaccccaucgugcugcggaugaugaacgaccagcugauguuccucgagcgcgccuucaucgacccgcuggggcugcccgaccggcccuucuaccgccacgucaucuacgcccccuccagccacaacaaguacgcgggcgaguccuucccgggcaucuacgacgcccucuucgacaucgagagcaagguggaccccuccaaggccuggggcgaggugaagcggcagaucuacgucgccgccuucaccgugcaggcggccgccgagacccugagcgagguggccuga

SEQ ID NO: 3264 - RNA, 2253 nt, Artificial Sequence
  derived and/or modified sequence opt2 from PSM__Homo_sapiens__AAA60209
auguggaaccuccuccacgagaccgacuccgccgucgccaccgcccgccgcccccgcuggcucugcgccggcgcccucguccucgccggcggcuucuuccuccucggcuuccucuucggcugguucaucaaguccuccaacgaggccaccaacaucacccccaagcacaacaugaaggccuuccucgacgagcucaaggccgagaacaucaagaaguuccucuacaacuucacccagaucccccaccucgccggcaccgagcagaacuuccagcucgccaagcagauccagucccaguggaaggaguucggccucgacuccgucgagcucgcccacuacgacguccuccucuccuaccccaacaagacccaccccaacuacaucuccaucaucaacgaggacggcaacgagaucuucaacaccucccucuucgagccccccccccccggcuacgagaacgucuccgacaucgucccccccuucuccgccuucuccccccagggcaugcccgagggcgaccucgucuacgucaacuacgcccgcaccgaggacuucuucaagcucgagcgcgacaugaagaucaacugcuccggcaagaucgucaucgcccgcuacggcaaggucuuccgcggcaacaaggucaagaacgcccagcucgccggcgccaagggcgucauccucuacuccgaccccgccgacuacuucgcccccggcgucaaguccuaccccgacggcuggaaccuccccggcggcggcguccagcgcggcaacauccucaaccucaacggcgccggcgacccccucacccccggcuaccccgccaacgaguacgccuaccgccgcggcaucgccgaggccgucggccuccccuccauccccguccaccccaucggcuacuacgacgcccagaagcuccucgagaagaugggcggcuccgccccccccgacuccuccuggcgcggcucccucaagguccccuacaacgucggccccggcuucaccggcaacuucuccacccagaaggucaagaugcacauccacuccaccaacgaggucacccgcaucuacaacgucaucggcacccuccgcggcgccgucgagcccgaccgcuacgucauccucggcggccaccgcgacuccugggucuucggcggcaucgacccccaguccggcgccgccgucguccacgagaucguccgcuccuucggcacccucaagaaggagggcuggcgcccccgccgcaccauccucuucgccuccugggacgccgaggaguucggccuccucggcuccaccgagugggccgaggagaacucccgccuccuccaggagcgcggcgucgccuacaucaacgccgacuccuccaucgagggcaacuacacccuccgcgucgacugcaccccccucauguacucccucguccacaaccucaccaaggagcucaagucccccgacgagggcuucgagggcaagucccucuacgaguccuggaccaagaagucccccucccccgaguucuccggcaugccccgcaucuccaagcucggcuccggcaacgacuucgaggucuucuuccagcgccucggcaucgccuccggccgcgcccgcuacaccaagaacugggagaccaacaaguucuccggcuacccccucuaccacuccgucuacgagaccuacgagcucgucgagaaguucuacgaccccauguucaaguaccaccucaccgucgcccagguccgcggcggcauggucuucgagcucgccaacuccaucguccuccccuucgacugccgcgacuacgccgucguccuccgcaaguacgccgacaagaucuacuccaucuccaugaagcacccccaggagaugaagaccuacuccgucuccuucgacucccucuucuccgccgucaagaacuucaccgagaucgccuccaaguucuccgagcgccuccaggacuucgacaaguccaaccccaucguccuccgcaugaugaacgaccagcucauguuccucgagcgcgccuucaucgacccccucggccuccccgaccgccccuucuaccgccacgucaucuacgcccccuccucccacaacaaguacgccggcgaguccuuccccggcaucuacgacgcccucuucgacaucgaguccaaggucgaccccuccaaggccuggggcgaggucaagcgccagaucuacgucgccgccuucaccguccaggccgccgccgagacccucuccgaggucgccuga

SEQ ID NO: 3265 - RNA, 2253 nt, Artificial Sequence
  derived and/or modified sequence opt3 from PSM__Homo_sapiens__AAA60209
auguggaaccugcuccacgagaccgacagcgccguggcuacagcaagaaggccccgguggcuuugcgccggcgcgcuggucuuggcugggggauucuuuuuacuggguuuccuauuuggcugguucaucaaguccucuaaugaagccacuaacauuacgccuaaacauaauaugaaggcauuucucgaugagcugaaagccgaaaacauaaagaaauuccuuuacaauuuuacccagaucccacaccuggcugggacagagcaaaacuuccaguuggcaaagcagauucagucacaauggaaggaauuuggacucgacaguguugagcuggcccauuaugaugugcugcucagcuacccgaauaaaacucaccccaacuauaucuccauuaucaaugaggacggcaacgaaauauucaauaccucuuuauuugagccuccacccccugguuacgaaaacguaucggauaucgugccacccuucucagcuuuuagcccucaggggaugccagagggagaccuggucuaugugaauuacgcccgcacagaggauuucuucaagcuagaacgagacaugaaaauuaacuguaguggcaagaucguuauugcgcguuauggcaaaguguuuagagggaauaaggucaagaacgcacaguuggccggagcuaaaggugugauccuguacuccgauccggccgacuacuucgcacccggcguaaagucuuauccugauggguggaaccuaccaggaggcgguguucagagggggaauauacucaaccugaauggagcuggcgacccccuuaccccuggcuacccagccaacgaguaugcguaccggcgcgggauugccgaagcagugggacugcccagcaucccgguccauccuauugguuauuacgaugcucaaaaauugcucgagaagaugggcggguccgcucccccagacucaaguuggagaggaagccugaaagugccuuauaaugugggccccgguuuuacugggaacuucucuacacagaaggucaaaaugcacauccacuccaccaaugaaguuacgaggaucuacaacgugauuggcacuuuacggggagccguagagccagaccgcuacgugauacugggcgggcaucgagauucaugggucuuuggagguaucgacccccagagcggcgccgcagugguucacgagauugugagaaguuucgggacccucaagaaggaaggauggaggccucggcguacaauccuuuuugccucuugggaugcugaggaguucggccuguuggguuccacugaaugggcggaagagaauagccgccuacugcaggagagaggggucgcauauauaaacgccgacucgucuauugaaggcaauuacacccucaggguggauugcacaccacugauguauucccuuguacauaaccugaccaaagaguugaagucaccggacgaaggauuugagggcaaaagucucuacgaaagcuggacgaagaaaucccccucuccugaguucagcgggaugccacggaucucaaagcugggaagugguaaugauuuugagguuuucuuucaacgauuaggcaucgcuuccgggcgcgccagauauacuaagaacugggaaacaaauaaauucagcggauacccccuguaucacucuguguacgagaccuacgaacuugucgagaaguucuaugacccuauguuuaaauaccaccucacuguggcacaggucaggggcgguaugguguucgagcuggccaacucaauuguucuuccauuugauugucgggacuaugcugugguauugcgcaaguacgccgauaaaaucuauaguauuagcaugaagcauccccaggaaaugaagacauacuccgucucuuucgacucgcuguuuagcgcagugaaaaacuucaccgagauagcguccaaguuuucagaaagacuccaagacuucgauaaaaguaauccgaucguucugaggaugaugaacgaccagcuuauguuucuggagcgugcuuucauugauccuuuggggcucccagaccggcccuuuuaucgacacgugaucuacgccccuucuagccauaauaaguacgcaggcgaauccuuccccggaaucuaugaugcccuguuugacauugagucaaaagucgauccaagcaaggcuuggggcgaggugaagagacagauauacguagccgcauucacggugcaggcugccgcggaaaccuuaucugagguugccuga

SEQ ID NO: 3266 - RNA, 2253 nt, Artificial Sequence
  derived and/or modified sequence opt4 from PSM__Homo_sapiens__AAA60209
auguggaaccugcugcacgagaccgacagcgccguggccaccgccagaagacccagauggcugugcgccggcgcccuggugcuggccggcggcuucuuccugcugggcuuccuguucggcugguucaucaagagcagcaacgaggccaccaacaucacccccaagcacaacaugaaggccuuccuggacgagcugaaggccgagaacaucaagaaguuccuguacaacuucacccagaucccccaccuggccggcaccgagcagaacuuccagcuggccaagcagauccagagccaguggaaggaguucggccuggacagcguggagcuggcccacuacgacgugcugcugagcuaccccaacaagacccaccccaacuacaucagcaucaucaacgaggacggcaacgagaucuucaacaccagccuguucgagccccccccccccggcuacgagaacgugagcgacaucgugccccccuucagcgccuucagcccccagggcaugcccgagggcgaccugguguacgugaacuacgccagaaccgaggacuucuucaagcuggagagagacaugaagaucaacugcagcggcaagaucgugaucgccagauacggcaagguguucagaggcaacaaggugaagaacgcccagcuggccggcgccaagggcgugauccuguacagcgaccccgccgacuacuucgcccccggcgugaagagcuaccccgacggcuggaaccugcccggcggcggcgugcagagaggcaacauccugaaccugaacggcgccggcgacccccugacccccggcuaccccgccaacgaguacgccuacagaagaggcaucgccgaggccgugggccugcccagcauccccgugcaccccaucggcuacuacgacgcccagaagcugcuggagaagaugggcggcagcgccccccccgacagcagcuggagaggcagccugaaggugcccuacaacgugggccccggcuucaccggcaacuucagcacccagaaggugaagaugcacauccacagcaccaacgaggugaccagaaucuacaacgugaucggcacccugagaggcgccguggagcccgacagauacgugauccugggcggccacagagacagcuggguguucggcggcaucgacccccagagcggcgccgccguggugcacgagaucgugagaagcuucggcacccugaagaaggagggcuggagacccagaagaaccauccuguucgccagcugggacgccgaggaguucggccugcugggcagcaccgagugggccgaggagaacagcagacugcugcaggagagaggcguggccuacaucaacgccgacagcagcaucgagggcaacuacacccugagaguggacugcaccccccugauguacagccuggugcacaaccugaccaaggagcugaagagccccgacgagggcuucgagggcaagagccuguacgagagcuggaccaagaagagccccagccccgaguucagcggcaugcccagaaucagcaagcugggcagcggcaacgacuucgagguguucuuccagagacugggcaucgccagcggcagagccagauacaccaagaacugggagaccaacaaguucagcggcuacccccuguaccacagcguguacgagaccuacgagcugguggagaaguucuacgaccccauguucaaguaccaccugaccguggcccaggugagaggcggcaugguguucgagcuggccaacagcaucgugcugcccuucgacugcagagacuacgccguggugcugagaaaguacgccgacaagaucuacagcaucagcaugaagcacccccaggagaugaagaccuacagcgugagcuucgacagccuguucagcgccgugaagaacuucaccgagaucgccagcaaguucagcgagagacugcaggacuucgacaagagcaaccccaucgugcugagaaugaugaacgaccagcugauguuccuggagagagccuucaucgacccccugggccugcccgacagacccuucuacagacacgugaucuacgcccccagcagccacaacaaguacgccggcgagagcuuccccggcaucuacgacgcccuguucgacaucgagagcaagguggaccccagcaaggccuggggcgaggugaagagacagaucuacguggccgccuucaccgugcaggccgccgccgagacccugagcgagguggccuga

SEQ ID NO: 3267 - RNA, 2253 nt, Artificial Sequence
  derived and/or modified sequence opt5 from PSM__Homo_sapiens__AAA60209
auguggaaccugcuccacgagaccgacagcgccguggcuacagccagacggccccgcuggcugugcgcgggcgcucuuguccuggccgggggauucuuucuccugggcuuccuuuuugggugguucaucaaguccucuaaugaagccacgaacauuaccccuaaacauaauaugaaggcuuuucuggaugagcucaaagccgaaaacaucaagaaauuccuguacaauuuuacacagauuccgcaccuggcuggaaccgagcaaaacuuccagcucgccaagcagauccagagccaauggaaggaauuuggccuggacuccguugagcuugcgcauuaugaugugcugcucucuuaccccaauaaaacacacccuaacuauauuagcaucaucaaugaggacgggaacgaaauuuucaauaccucccuguuugagcccccucccccuggauacgaaaacgugucugauaucgucccgcccuucagcgccuuuuccccucagggcaugcccgagggcgaccuuguguauguuaauuacgcuagaacagaggauuucuucaagcuggaacgggacaugaaaauuaacuguagcgggaagaucgugauugcccgcuauggaaaagucuuuagaggcaauaaggugaagaacgcucagcucgccggggcgaaaggaguuauccuguacucugauccugccgacuacuucgcucccggcgugaaguccuauccggauggguggaaccugccuggaggcggcguccagcgggggaauauucucaaccugaauggagccggcgacccccuuaccccuggguaccccgcuaacgaguaugccuaccgcagaggaaucgccgaagcugugggccugcccagcaucccugugcauccgauuggguauuacgaugcgcaaaaacuccuggagaagaugggaggcucugcucccccugacuccagcuggcggggcucucuuaaaguccccuauaauguugggccuggauuuacgggcaacuucuccacccagaaggugaaaaugcacauccacagcacaaaugaagugacccgcauuuacaacgucaucgggacacugagaggagccguggagcccgaccgguacguuauucucggcgggcaucgcgauuccuggguguuuggcggaaucgacccgcagucuggcgccgccgucgugcacgagaucguucggagcuucgggacccugaagaaggaaggauggagaccucgcagaacgauucuguuugcuuccugggaugccgaggaguucggccuccuggggagcacagagugggcggaagaaaauucucggcuucugcaggagagaggaguggcuuauaucaacgccgacuccagcauugaaggcaauuacacccuccgcgucgauugcacaccccugauguauucucuugugcauaaccugaccaaagagcucaagagcccugacgaaggguuugagggcaaaucccuguacgaaucuuggaccaagaaaagccccuccccugaguucagcggaaugccccggaucucuaagcugggcuccgggaaugauuuugaggucuucuuucaaagacucggaauugccagcggccgcgcucgguauacaaagaacugggaaacgaauaaauucucuggguacccgcuguaucacuccguguacgagaccuacgaacuuguugagaaguucuaugacccuauguuuaaauaccaccugacaguggcccaggucagaggaggcaugguguucgagcucgcuaacagcaucguucugcccuuugauugucgcgacuaugccgugguccugcggaaguacgcggauaaaaucuauuccauuucuaugaagcauccccaggaaaugaagaccuacagcguguccuucgacucucuuuuuagcgccgugaaaaacuucacagagaucgcuuccaaguuuagcgaaagacuccaagacuucgauaaaucuaauccuauuguucugcgcaugaugaacgaccagcugauguuucucgagcgggccuucaucgauccgcuggggcuucccgacagaccuuuuuaucgccacgucauuuacgcucccuccagccauaauaaguacgccggcgaaucuuucccuggaaucuaugaugcgcuguuugacauugaguccaaaguggaucccagcaaggccuggggcgaggugaagcggcagaucuacgucgcugccuucaccgugcaggcugccgccgaaacgcucucugagguugcuuga

SEQ ID NO: 3268 - protein, 1306 aa, Artificial Sequence
  PTPRC__Homo_sapiens__NP_002829
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 3269 - RNA, 3921 nt, Artificial Sequence
  PTPRC__Homo_sapiens__CCDS1397.2
augaccauguauuuguggcuuaaacucuuggcauuuggcuuugccuuucuggacacagaaguauuugugacagggcaaagcccaacaccuucccccacuggauugacuacagcaaagaugcccaguguuccacuuucaagugaccccuuaccuacucacaccacugcauucucacccgcaagcaccuuugaaagagaaaaugacuucucagagaccacaacuucucuuaguccagacaauacuuccacccaaguauccccggacucuuuggauaaugcuagugcuuuuaauaccacagguguuucaucaguacagacgccucaccuucccacgcacgcagacucgcagacgcccucugcuggaacugacacgcagacauucagcggcuccgccgccaaugcaaaacucaacccuaccccaggcagcaaugcuaucucagaugucccaggagagaggaguacagccagcaccuuuccuacagacccaguuuccccauugacaaccacccucagccuugcacaccacagcucugcugccuuaccugcacgcaccuccaacaccaccaucacagcgaacaccucagaugccuaccuuaaugccucugaaacaaccacucugagcccuucuggaagcgcugucauuucaaccacaacaauagcuacuacuccaucuaagccaacaugugaugaaaaauaugcaaacaucacuguggauuacuuauauaacaaggaaacuaaauuauuuacagcaaagcuaaauguuaaugagaauguggaauguggaaacaauacuugcacaaacaaugaggugcauaaccuuacagaauguaaaaaugcgucuguuuccauaucucauaauucauguacugcuccugauaagacauuaauauuagaugugccaccagggguugaaaaguuucaguuacaugauuguacacaaguugaaaaagcagauacuacuauuuguuuaaaauggaaaaauauugaaaccuuuacuugugauacacagaauauuaccuacagauuucagugugguaauaugauauuugauaauaaagaaauuaaauuagaaaaccuugaacccgaacaugaguauaagugugacucagaaauacucuauaauaaccacaaguuuacuaacgcaaguaaaauuauuaaaacagauuuugggaguccaggagagccucagauuauuuuuuguagaagugaagcugcacaucaaggaguaauuaccuggaaucccccucaaagaucauuucauaauuuuacccucuguuauauaaaagagacagaaaaagauugccucaaucuggauaaaaaccugaucaaauaugauuugcaaaauuuaaaaccuuauacgaaauauguuuuaucauuacaugccuacaucauugcaaaagugcaacguaauggaagugcugcaaugugucauuucacaacuaaaagugcuccuccaagccaggucuggaacaugacugucuccaugacaucagauaauaguaugcaugucaaguguaggccucccagggaccguaauggcccccaugaacguuaccauuuggaaguugaagcuggaaauacucugguuagaaaugagucgcauaagaauugcgauuuccguguaaaagaucuucaauauucaacagacuacacuuuuaaggccuauuuucacaauggagacuauccuggagaacccuuuauuuuacaucauucaacaucuuauaauucuaaggcacugauagcauuucuggcauuucugauuauugugacaucaauagcccugcuuguuguucucuacaaaaucuaugaucuacauaagaaaagauccugcaauuuagaugaacagcaggagcuuguugaaagggaugaugaaaaacaacugaugaauguggagccaauccaugcagauauuuuguuggaaacuuauaagaggaagauugcugaugaaggaagacuuuuucuggcugaauuucagagcaucccgcggguguucagcaaguuuccuauaaaggaagcucgaaagcccuuuaaccagaauaaaaaccguuauguugacauucuuccuuaugauuauaaccguguugaacucucugagauaaacggagaugcagggucaaacuacauaaaugccagcuauauugaugguuucaaagaacccaggaaauacauugcugcacaaggucccagggaugaaacuguugaugauuucuggaggaugauuugggaacagaaagccacaguuauugucauggucacucgaugugaagaaggaaacaggaacaagugugcagaauacuggccgucaauggaagagggcacucgggcuuuuggagauguuguuguaaagaucaaccagcacaaaagauguccagauuacaucauucagaaauugaacauuguaaauaaaaaagaaaaagcaacuggaagagaggugacucacauucaguucaccagcuggccagaccacggggugccugaggauccucacuugcuccucaaacugagaaggagagugaaugccuucagcaauuucuucaguggucccauuguggugcacugcagugcugguguugggcgcacaggaaccuauaucggaauugaugccaugcuagaaggccuggaagccgagaacaaaguggauguuuaugguuauguugucaagcuaaggcgacagagaugccugaugguucaaguagaggcccaguacaucuugauccaucaggcuuugguggaauacaaucaguuuggagaaacagaagugaauuugucugaauuacauccauaucuacauaacaugaagaaaagggauccacccagugagccgucuccacuagaggcugaauuccagagacuuccuucauauaggagcuggaggacacagcacauuggaaaucaagaagaaaauaaaaguaaaaacaggaauucuaaugucaucccauaugacuauaacagagugccacuuaaacaugagcuggaaaugaguaaagagagugagcaugauucagaugaauccucugaugaugacagugauucagaggaaccaagcaaauacaucaaugcaucuuuuauaaugagcuacuggaaaccugaagugaugauugcugcucagggaccacugaaggagaccauuggugacuuuuggcagaugaucuuccaaagaaaagucaaaguuauuguuaugcugacagaacugaaacauggagaccaggaaaucugugcucaguacuggggagaaggaaagcaaacauauggagauauugaaguugaccugaaagacacagacaaaucuucaacuuauacccuucgugucuuugaacugagacauuccaagaggaaagacucucgaacuguguaccaguaccaauauacaaacuggaguguggagcagcuuccugcagaacccaaggaauuaaucucuaugauucaggucgucaaacaaaaacuuccccagaagaauuccucugaagggaacaagcaucacaagaguacaccucuacucauucacugcagggauggaucucagcaaacgggaauauuuugugcuuuguuaaaucucuuagaaagugcggaaacagaagagguaguggauauuuuucaagugguaaaagcucuacgcaaagcuaggccaggcaugguuuccacauucgagcaauaucaauuccuauaugacgucauugccagcaccuacccugcucagaauggacaaguaaagaaaaacaaccaucaagaagauaaaauugaauuugauaaugaaguggacaaaguaaagcaggaugcuaauuguguuaauccacuuggugccccagaaaagcucccugaagcaaaggaacaggcugaagguucugaacccacgaguggcacugaggggccagaacauucugucaaugguccugcaaguccagcuuuaaaucaagguucauag

SEQ ID NO: 3270 - RNA, 3921 nt, Artificial Sequence
  derived and/or modified sequence opt1 from PTPRC__Homo_sapiens__CCDS1397.2
augaccauguaccuguggcucaagcugcuggccuucggcuucgccuuccucgacaccgagguguucgucacggggcagagccccaccccgucccccaccggccugaccacggcgaagaugcccagcgugccccuguccagcgacccgcuccccacccacaccaccgccuucucccccgccagcacguucgagcgcgagaacgacuucuccgagaccaccaccagccugucccccgacaacacgagcacccagguguccccggacagccuggacaacgccuccgccuucaacaccaccggggucagcuccgugcagacgccccaccuccccacccacgcggacagccagacccccuccgccggcaccgacacgcagaccuucagcggguccgccgccaacgcgaagcugaacccgacccccggcagcaacgccaucagcgacgugcccggcgagcgguccaccgccagcacguuccccaccgacccggucagcccccugaccaccacgcucucccuggcccaccacuccagcgccgcgcugcccgcccgcaccuccaacaccaccaucacggccaacaccagcgacgccuaccucaacgccuccgagaccaccacgcugagccccuccgggagcgcggugaucuccaccaccaccaucgccaccacgccgagcaagcccacgugcgacgagaaguacgccaacaucaccguggacuaccuguacaacaaggagaccaagcuguucaccgccaagcugaacgucaacgagaacguggagugcggcaacaacacgugcaccaacaacgaggugcacaaccugaccgagugcaagaacgccuccgucagcaucucccacaacagcugcaccgcgcccgacaagacccucauccuggacgugcccccggggguggagaaguuccagcugcacgacugcacccaggucgagaaggccgacaccacgaucugccucaaguggaagaacaucgagaccuucacgugcgacacccagaacaucaccuaccgguuccagugcggcaacaugaucuucgacaacaaggagaucaagcuggagaaccuggagcccgagcacgaguacaagugcgacuccgagauccucuacaacaaccacaaguucaccaacgccagcaagaucaucaagaccgacuucgggagccccggcgagccccagaucaucuucugccgcuccgaggccgcccaccagggcgugaucaccuggaacccgccccagcggagcuuccacaacuucacgcugugcuacaucaaggagaccgagaaggacugccugaaccucgacaagaaccugaucaaguacgaccugcagaaccucaagcccuacaccaaguacgugcugucccugcacgcguacaucaucgccaagguccagcgcaacgggagcgccgccaugugccacuucaccacgaaguccgcgccgcccagccagguguggaacaugaccguguccaugaccagcgacaacuccaugcacgucaagugccggccgccccgcgaccggaacggcccccacgagcgcuaccaccucgagguggaggccgggaacacccuggugcggaacgagagccacaagaacugcgacuuccgcgucaaggaccugcaguacuccacggacuacaccuucaaggccuacuuccacaacggcgacuaccccggcgagcccuucauccuccaccacagcaccuccuacaacagcaaggcccugaucgccuuccuggcguuccucaucaucgugaccuccaucgcccugcuggucgugcucuacaagaucuacgaccugcacaagaagcggagcugcaaccuggacgagcagcaggagcucguggagcgcgacgacgagaagcagcugaugaacgucgagcccauccacgccgacauccugcuggagacguacaagcggaagaucgccgacgaggggcgccucuuccuggccgaguuccaguccaucccgcggguguucagcaaguuccccaucaaggaggcgcgcaagcccuucaaccagaacaagaaccgguacguggacauccugcccuacgacuacaaccgcgucgagcucagcgagaucaacggcgacgccggguccaacuacaucaacgccagcuacaucgacggcuucaaggagccgcggaaguacaucgccgcccaggggccccgcgacgagaccguggacgacuucuggcgcaugaucugggagcagaaggcgaccgugaucgucauggugacccggugcgaggagggcaaccgcaacaagugcgccgaguacuggcccuccauggaggagggcacgcgggccuucggggacguggucgugaagaucaaccagcacaagcgcugccccgacuacaucauccagaagcugaacaucgugaacaagaaggagaaggccaccggccgggaggucacccacauccaguucaccagcuggccggaccacggggugcccgaggacccccaccuccuccugaagcugcgccggcgcgugaacgcguucuccaacuucuucagcggccccaucgucgugcacugcuccgccggggugggccggaccggcacguacaucgggaucgacgccaugcucgagggccuggaggccgagaacaaggucgacguguacggguacguggucaagcugcgccggcagcgcugccucaugguccagguggaggcccaguacauccugauccaccaggcgcugguggaguacaaccaguucggcgagaccgaggugaaccucagcgagcugcacccguaccugcacaacaugaagaagcgggacccgcccuccgagcccagcccccucgaggccgaguuccagcgccugcccuccuaccggagcuggcgcacccagcacaucgggaaccaggaggagaacaaguccaagaaccggaacagcaacgugauccccuacgacuacaaccgcgucccgcugaagcacgagcucgagauguccaaggagagcgagcacgacuccgacgagagcuccgacgacgacagcgacagcgaggagcccuccaaguacaucaacgccagcuucaucauguccuacuggaagcccgaggugaugaucgccgcccagggcccccugaaggagaccaucggcgacuucuggcagaugaucuuccagcggaaggugaaggucaucgugaugcugacggagcucaagcacggggaccaggagaucugcgcgcaguacuggggcgaggggaagcagaccuacggcgacaucgagguggaccugaaggacaccgacaagagcuccaccuacacgcugcgcgucuucgagcuccgccacagcaagcggaaggacucccgcaccguguaccaguaccaguacaccaacuggagcguggagcagcugccggccgagcccaaggagcugaucuccaugauccaggucgugaagcagaagcucccccagaagaacagcuccgagggcaacaagcaccacaagagcacgccccugcugauccacugccgggacgggucccagcagaccggcaucuucugcgcccuccugaaccugcucgagagcgccgagaccgaggagguggucgacaucuuccagguggugaaggcccugcgcaaggcgcggccggggauggucuccaccuucgagcaguaccaguuccuguacgacgugaucgccagcaccuaccccgcccagaacggccaggugaagaagaacaaccaccaggaggacaagaucgaguucgacaacgaggucgacaaggugaagcaggacgccaacugcgugaacccccucggggcgcccgagaagcugccggaggccaaggagcaggccgagggcuccgagcccacgagcggcaccgaggggcccgagcacuccgucaacggccccgccagcccggcccugaaccaggggagcuga

SEQ ID NO: 3271 - RNA, 3921 nt, Artificial Sequence
  derived and/or modified sequence opt2 from PTPRC__Homo_sapiens__CCDS1397.2
augaccauguaccucuggcucaagcuccucgccuucggcuucgccuuccucgacaccgaggucuucgucaccggccagucccccacccccucccccaccggccucaccaccgccaagaugcccuccgucccccucuccuccgacccccuccccacccacaccaccgccuucucccccgccuccaccuucgagcgcgagaacgacuucuccgagaccaccaccucccucucccccgacaacaccuccacccaggucucccccgacucccucgacaacgccuccgccuucaacaccaccggcgucuccuccguccagaccccccaccuccccacccacgccgacucccagacccccuccgccggcaccgacacccagaccuucuccggcuccgccgccaacgccaagcucaaccccacccccggcuccaacgccaucuccgacguccccggcgagcgcuccaccgccuccaccuuccccaccgaccccgucuccccccucaccaccacccucucccucgcccaccacuccuccgccgcccuccccgcccgcaccuccaacaccaccaucaccgccaacaccuccgacgccuaccucaacgccuccgagaccaccacccucucccccuccggcuccgccgucaucuccaccaccaccaucgccaccacccccuccaagcccaccugcgacgagaaguacgccaacaucaccgucgacuaccucuacaacaaggagaccaagcucuucaccgccaagcucaacgucaacgagaacgucgagugcggcaacaacaccugcaccaacaacgagguccacaaccucaccgagugcaagaacgccuccgucuccaucucccacaacuccugcaccgcccccgacaagacccucauccucgacgucccccccggcgucgagaaguuccagcuccacgacugcacccaggucgagaaggccgacaccaccaucugccucaaguggaagaacaucgagaccuucaccugcgacacccagaacaucaccuaccgcuuccagugcggcaacaugaucuucgacaacaaggagaucaagcucgagaaccucgagcccgagcacgaguacaagugcgacuccgagauccucuacaacaaccacaaguucaccaacgccuccaagaucaucaagaccgacuucggcucccccggcgagccccagaucaucuucugccgcuccgaggccgcccaccagggcgucaucaccuggaaccccccccagcgcuccuuccacaacuucacccucugcuacaucaaggagaccgagaaggacugccucaaccucgacaagaaccucaucaaguacgaccuccagaaccucaagcccuacaccaaguacguccucucccuccacgccuacaucaucgccaagguccagcgcaacggcuccgccgccaugugccacuucaccaccaaguccgccccccccucccaggucuggaacaugaccgucuccaugaccuccgacaacuccaugcacgucaagugccgccccccccgcgaccgcaacggcccccacgagcgcuaccaccucgaggucgaggccggcaacacccucguccgcaacgagucccacaagaacugcgacuuccgcgucaaggaccuccaguacuccaccgacuacaccuucaaggccuacuuccacaacggcgacuaccccggcgagcccuucauccuccaccacuccaccuccuacaacuccaaggcccucaucgccuuccucgccuuccucaucaucgucaccuccaucgcccuccucgucguccucuacaagaucuacgaccuccacaagaagcgcuccugcaaccucgacgagcagcaggagcucgucgagcgcgacgacgagaagcagcucaugaacgucgagcccauccacgccgacauccuccucgagaccuacaagcgcaagaucgccgacgagggccgccucuuccucgccgaguuccaguccaucccccgcgucuucuccaaguuccccaucaaggaggcccgcaagcccuucaaccagaacaagaaccgcuacgucgacauccuccccuacgacuacaaccgcgucgagcucuccgagaucaacggcgacgccggcuccaacuacaucaacgccuccuacaucgacggcuucaaggagccccgcaaguacaucgccgcccagggcccccgcgacgagaccgucgacgacuucuggcgcaugaucugggagcagaaggccaccgucaucgucauggucacccgcugcgaggagggcaaccgcaacaagugcgccgaguacuggcccuccauggaggagggcacccgcgccuucggcgacgucgucgucaagaucaaccagcacaagcgcugccccgacuacaucauccagaagcucaacaucgucaacaagaaggagaaggccaccggccgcgaggucacccacauccaguucaccuccuggcccgaccacggcguccccgaggacccccaccuccuccucaagcuccgccgccgcgucaacgccuucuccaacuucuucuccggccccaucgucguccacugcuccgccggcgucggccgcaccggcaccuacaucggcaucgacgccaugcucgagggccucgaggccgagaacaaggucgacgucuacggcuacgucgucaagcuccgccgccagcgcugccucaugguccaggucgaggcccaguacauccucauccaccaggcccucgucgaguacaaccaguucggcgagaccgaggucaaccucuccgagcuccaccccuaccuccacaacaugaagaagcgcgacccccccuccgagcccuccccccucgaggccgaguuccagcgccuccccuccuaccgcuccuggcgcacccagcacaucggcaaccaggaggagaacaaguccaagaaccgcaacuccaacgucauccccuacgacuacaaccgcgucccccucaagcacgagcucgagauguccaaggaguccgagcacgacuccgacgaguccuccgacgacgacuccgacuccgaggagcccuccaaguacaucaacgccuccuucaucauguccuacuggaagcccgaggucaugaucgccgcccagggcccccucaaggagaccaucggcgacuucuggcagaugaucuuccagcgcaaggucaaggucaucgucaugcucaccgagcucaagcacggcgaccaggagaucugcgcccaguacuggggcgagggcaagcagaccuacggcgacaucgaggucgaccucaaggacaccgacaaguccuccaccuacacccuccgcgucuucgagcuccgccacuccaagcgcaaggacucccgcaccgucuaccaguaccaguacaccaacugguccgucgagcagcuccccgccgagcccaaggagcucaucuccaugauccaggucgucaagcagaagcucccccagaagaacuccuccgagggcaacaagcaccacaaguccaccccccuccucauccacugccgcgacggcucccagcagaccggcaucuucugcgcccuccucaaccuccucgaguccgccgagaccgaggaggucgucgacaucuuccaggucgucaaggcccuccgcaaggcccgccccggcauggucuccaccuucgagcaguaccaguuccucuacgacgucaucgccuccaccuaccccgcccagaacggccaggucaagaagaacaaccaccaggaggacaagaucgaguucgacaacgaggucgacaaggucaagcaggacgccaacugcgucaacccccucggcgcccccgagaagcuccccgaggccaaggagcaggccgagggcuccgagcccaccuccggcaccgagggccccgagcacuccgucaacggccccgccucccccgcccucaaccagggcuccuga

SEQ ID NO: 3272 - RNA, 3921 nt, Artificial Sequence
  derived and/or modified sequence opt3 from PTPRC__Homo_sapiens__CCDS1397.2
augaccauguaccuguggcucaagcuccuggccuucggcuuugcuuucuuggacacagagguguuugucacugggcagagccccacgccuuccccaaccggauuaacaacugcaaaaaugccgucuguuccccugucaagugauccucuaccaacccacacaaccgccuucagccccgcguccacuuuugaaagagagaacgacuucucugaaacaaccacgucgcucucaccugauaauacuagcacccaagugaguccagacucccuggauaacgcuucugccuuuaauacaacugguguaagcuccgugcagacaccccaucuuccuacccacgcagacucacagaccccaagugccggcacggauacucagacauucagcgggucugcugcaaacgccaagcugaauccgacccccggauccaacgcuaucucagacgucccuggcgagaggagcacugccaguacauuuccaaccgaucccgugucuccuuugacgaccacacucucccuggcgcaucacagcucggcagcccugccagcucggacuucuaauaccacaauuacugccaacaccuccgacgcauaucucaaugcuucagaaacaaccacuuuaagucccagcgguuccgccguuauaucuacgacaaccaucgcgacuaccccgagcaaaccuacaugcgaugagaaguacgccaacauuaccguggacuaucuguacaauaaagagacuaaacuuuucacagcaaaguugaacgucaaugaaaacguggagugugggaauaacacgugcaccaacaaugaaguacauaaccugacugaguguaagaaugcuucaguuaguaucucccacaacagcugcacagcccccgauaagacccuaauucucgacgugccaccuggagucgagaaauuucaacugcacgacuguacacagguggaaaaggcugauacuaccaucugccuuaaauggaagaauauagagacguucaccugugacacacagaacaucacuuaucgcuuucagugcggcaauaugauuuucgauaacaaggaaaucaaacuggagaauuuggaacccgagcaugaguacaagugugacucugaaauucucuauaacaaucacaaauucaccaacgccucaaagaucauaaaaacagauuuuggcaguccaggggagccccaaauuaucuucugccgaagcgaagcagcccaucagggagugauuacuuggaauccuccacagcguuccuuucacaacuucacccuguguuacaucaaggagacggaaaaagacugcuuaaaucuggauaagaaccucaucaaguacgaccuucagaaccugaaaccguauacaaaguacgucuugucucuacacgcuuauauuauagcgaaaguucaaagaaaugguucggcagccaugugccauuuuaccacuaagagcgcucccccuucccagguguggaacaugacaguaucaaugaccagugauaauucuaugcacgugaaauguaggccaccccgggaccgcaacggcccucaugagagauaccaccuggaggucgaagccgggaauacucucgugaggaacgagagccauaagaauugcgauuuccggguuaaggaccugcaguauuccaccgacuacacauuuaaagcauauuuccacaacggagauuacccaggcgaacccuuuauccuucaccauucaacgagcuacaauucuaaggcccugauugcuuucuuggccuuucucaucauagugaccuccauugcacuguuagucgugcuguauaaaaucuacgaccuacacaagaaacgcaguuguaaccucgaugagcaacaggaacugguagagcgagacgaugagaagcagcuuaugaauguugaaccgauccaugcggacauuuugcuggagacuuauaagagaaaaaucgcugaugaagguaggcuuuuccuggccgaguuucagagcauuccucggguguucucuaaguucccaauaaaagaggcacguaagcccuuuaaccaaaauaaaaaccgcuacgucgacauccuuccuuaugauuacaauagaguggaacuguccgagauuaacggggacgccggaucaaacuauaucaaugcuaguuacaucgauggcuucaaggaacccaggaaguacauugccgcacagggcccacgggacgagacagucgaugacuuuuggcgaaugauaugggaacagaaagcuaccgugaucguuauggugacacgcugcgaggaggggaacagaaauaagugugccgaauauuggccuagcauggaggaaggaacuagggcguucggugacguagucgugaaaauuaaccagcacaagcggugccccgauuacaucauucaaaaauugaauaucguuaacaagaaagagaaggccaccggccgcgaagugacgcacauacaguuuacaucguggccagaccauggggucccggaggauccucaccuccuguuaaagcugagaaggcgugugaaugcuuucuccaacuuuuucucuggacccaucguagugcauuguagcgcaggcguuggucggaccgggacuuauauuggcaucgacgccaugcuagagggacucgaagcugagaauaaagucgauguguacggcuauguggucaagcugcgaagacagaggugccuuaugguucagguggaagcccaauacauuuugauccaccaggcacugguggaguauaaccaguuuggggaaaccgagguaaaucucucagagcugcauccauacuuacacaacaugaaaaagcgcgaucccccuagugaaccaucaccccuggaggcggaguuccagcggcuuccuucuuacagaagcuggaggacacaacacauaggaaaucaggaagagaacaaauccaagaaucgcaacucaaacgucauuccguaugacuacaaucgagugccauugaagcaugaacucgagaugagcaaagaaagugagcacgacucugaugaauccagcgacgaugacucggauucagaggagcccucuaaguauaucaacgccaguuuuauuauguccuacuggaaaccugaaguuaugaucgcugcccaggguccacugaaggagacuauaggcgacuucuggcaaaugaucuuucagcggaaagugaaggucauugugaugcuaaccgaacugaagcauggggaccaggagaucugugcacaguauuggggagaaggcaaacaaacauacggugauauugagguugaccucaaggauacggacaaaagcucuaccuauacucugcguguguucgagcuuagacacagcaagaggaaagauucccgcacaguauaccaguaccaguauaccaauuggucagucgaacaguugcccgcugagccuaaggaacugaucaguaugauacaaguggugaagcagaaauuaccgcagaagaacagcucugaggggaauaaacaucacaaguccacuccccuccugauucacugccgggacggcucacagcaaacaggaaucuucugugcccuucugaacuugcucgaaagugcagagaccgaggaagucguugauaucuuucaggugguaaaagcccugagaaaggcuaggccaggcauggugagcacguucgagcaguaccaauuucuauaugacgucauugcguccacuuacccugcccagaauggacaggugaaaaagaacaaucaucaggaagauaagaucgaguucgacaacgagguugauaaagugaagcaagacgcaaauugcgucaacccccugggggcuccagaaaaacucccugaggccaaggaacaggccgaggguucugaacccaccucgggcacagaggggccagagcacagcgugaauggaccggcuuccccugcacugaaccagggcuccuga

SEQ ID NO: 3273 - RNA, 3921 nt, Artificial Sequence
  derived and/or modified sequence opt4 from PTPRC__Homo_sapiens__CCDS1397.2
augaccauguaccuguggcugaagcugcuggccuucggcuucgccuuccuggacaccgagguguucgugaccggccagagccccacccccagccccaccggccugaccaccgccaagaugcccagcgugccccugagcagcgacccccugcccacccacaccaccgccuucagccccgccagcaccuucgagagagagaacgacuucagcgagaccaccaccagccugagccccgacaacaccagcacccaggugagccccgacagccuggacaacgccagcgccuucaacaccaccggcgugagcagcgugcagaccccccaccugcccacccacgccgacagccagacccccagcgccggcaccgacacccagaccuucagcggcagcgccgccaacgccaagcugaaccccacccccggcagcaacgccaucagcgacgugcccggcgagagaagcaccgccagcaccuuccccaccgaccccgugagcccccugaccaccacccugagccuggcccaccacagcagcgccgcccugcccgccagaaccagcaacaccaccaucaccgccaacaccagcgacgccuaccugaacgccagcgagaccaccacccugagccccagcggcagcgccgugaucagcaccaccaccaucgccaccacccccagcaagcccaccugcgacgagaaguacgccaacaucaccguggacuaccuguacaacaaggagaccaagcuguucaccgccaagcugaacgugaacgagaacguggagugcggcaacaacaccugcaccaacaacgaggugcacaaccugaccgagugcaagaacgccagcgugagcaucagccacaacagcugcaccgcccccgacaagacccugauccuggacgugccccccggcguggagaaguuccagcugcacgacugcacccagguggagaaggccgacaccaccaucugccugaaguggaagaacaucgagaccuucaccugcgacacccagaacaucaccuacagauuccagugcggcaacaugaucuucgacaacaaggagaucaagcuggagaaccuggagcccgagcacgaguacaagugcgacagcgagauccuguacaacaaccacaaguucaccaacgccagcaagaucaucaagaccgacuucggcagccccggcgagccccagaucaucuucugcagaagcgaggccgcccaccagggcgugaucaccuggaaccccccccagagaagcuuccacaacuucacccugugcuacaucaaggagaccgagaaggacugccugaaccuggacaagaaccugaucaaguacgaccugcagaaccugaagcccuacaccaaguacgugcugagccugcacgccuacaucaucgccaaggugcagagaaacggcagcgccgccaugugccacuucaccaccaagagcgccccccccagccagguguggaacaugaccgugagcaugaccagcgacaacagcaugcacgugaagugcagaccccccagagacagaaacggcccccacgagagauaccaccuggagguggaggccggcaacacccuggugagaaacgagagccacaagaacugcgacuucagagugaaggaccugcaguacagcaccgacuacaccuucaaggccuacuuccacaacggcgacuaccccggcgagcccuucauccugcaccacagcaccagcuacaacagcaaggcccugaucgccuuccuggccuuccugaucaucgugaccagcaucgcccugcugguggugcuguacaagaucuacgaccugcacaagaagagaagcugcaaccuggacgagcagcaggagcugguggagagagacgacgagaagcagcugaugaacguggagcccauccacgccgacauccugcuggagaccuacaagagaaagaucgccgacgagggcagacuguuccuggccgaguuccagagcauccccagaguguucagcaaguuccccaucaaggaggccagaaagcccuucaaccagaacaagaacagauacguggacauccugcccuacgacuacaacagaguggagcugagcgagaucaacggcgacgccggcagcaacuacaucaacgccagcuacaucgacggcuucaaggagcccagaaaguacaucgccgcccagggccccagagacgagaccguggacgacuucuggagaaugaucugggagcagaaggccaccgugaucgugauggugaccagaugcgaggagggcaacagaaacaagugcgccgaguacuggcccagcauggaggagggcaccagagccuucggcgacgugguggugaagaucaaccagcacaagagaugccccgacuacaucauccagaagcugaacaucgugaacaagaaggagaaggccaccggcagagaggugacccacauccaguucaccagcuggcccgaccacggcgugcccgaggacccccaccugcugcugaagcugagaagaagagugaacgccuucagcaacuucuucagcggccccaucguggugcacugcagcgccggcgugggcagaaccggcaccuacaucggcaucgacgccaugcuggagggccuggaggccgagaacaagguggacguguacggcuacguggugaagcugagaagacagagaugccugauggugcagguggaggcccaguacauccugauccaccaggcccugguggaguacaaccaguucggcgagaccgaggugaaccugagcgagcugcaccccuaccugcacaacaugaagaagagagacccccccagcgagcccagcccccuggaggccgaguuccagagacugcccagcuacagaagcuggagaacccagcacaucggcaaccaggaggagaacaagagcaagaacagaaacagcaacgugauccccuacgacuacaacagagugccccugaagcacgagcuggagaugagcaaggagagcgagcacgacagcgacgagagcagcgacgacgacagcgacagcgaggagcccagcaaguacaucaacgccagcuucaucaugagcuacuggaagcccgaggugaugaucgccgcccagggcccccugaaggagaccaucggcgacuucuggcagaugaucuuccagagaaaggugaaggugaucgugaugcugaccgagcugaagcacggcgaccaggagaucugcgcccaguacuggggcgagggcaagcagaccuacggcgacaucgagguggaccugaaggacaccgacaagagcagcaccuacacccugagaguguucgagcugagacacagcaagagaaaggacagcagaaccguguaccaguaccaguacaccaacuggagcguggagcagcugcccgccgagcccaaggagcugaucagcaugauccagguggugaagcagaagcugccccagaagaacagcagcgagggcaacaagcaccacaagagcaccccccugcugauccacugcagagacggcagccagcagaccggcaucuucugcgcccugcugaaccugcuggagagcgccgagaccgaggaggugguggacaucuuccagguggugaaggcccugagaaaggccagacccggcauggugagcaccuucgagcaguaccaguuccuguacgacgugaucgccagcaccuaccccgcccagaacggccaggugaagaagaacaaccaccaggaggacaagaucgaguucgacaacgagguggacaaggugaagcaggacgccaacugcgugaacccccugggcgcccccgagaagcugcccgaggccaaggagcaggccgagggcagcgagcccaccagcggcaccgagggccccgagcacagcgugaacggccccgccagccccgcccugaaccagggcagcuga

SEQ ID NO: 3274 - RNA, 3921 nt, Artificial Sequence
  derived and/or modified sequence opt5 from PTPRC__Homo_sapiens__CCDS1397.2
augaccauguaccuguggcucaagcugcuugccuucggcuuugcuuuccuggacacagagguguuugucacggggcagagccccaccccuuccccgacaggacucaccacagccaaaaugcccucuguuccucugagcuccgauccccuuccuacccacacaaccgcguucucucccgcuagcacguuugaaagagagaacgacuucuccgaaaccacaaccucucugagcccugauaauacauccacccaagugagcccggacucucucgauaacgccuccgccuuuaauacgacaggcgugagcucuguccagacaccccaucugccuacccacgcugacucccagacccccagcgccgggaccgauacacagacguucucuggauccgcugccaacgcgaagcugaauccuacccccggcagcaacgccaucuccgacgugccgggggagcggucuacagcuagcaccuuuccuacagaucccguuuccccucucaccacgacacugagccuugcccaucacucuuccgcugcccugcccgcgcgcaccagcaauaccacaauuaccgccaacacaucugacgcuuaucucaaugccagcgaaacgaccacacugucccccucuggaagcgcugugaucuccaccacaaccauugccacgaccccuagcaaaccgacaugcgaugagaaguacgccaacaucaccgucgacuaucuuuacaauaaagagacaaagcuguucaccgcuaagcucaacgugaaugaaaacguugaguguggcaauaacacgugcacaaacaaugaagugcauaaccugaccgaguguaaaaaugcgucugucuccauuagccacaacucuugcacagcccccgauaagacccugauccucgacgugccucccggcguggagaaauuucaacugcacgacuguacccaggucgaaaaggcugauacaacgaucugccuuaaauggaagaauauugagaccuucacaugugacacccagaacaucacauauagauuucagugcgggaauaugauuuucgauaacaaggaaaucaaacuggagaaucucgaaccugagcaugaguacaagugugacuccgaaauucuguauaacaaucacaaauucaccaacgccagcaagaucauuaaaacggauuuuggaucccccggcgagccgcaaaucaucuucugccggucugaagccgcucaucaggggguuauuacauggaauccuccccagcgcagcuuucacaacuucacccuuuguuacaucaaggagaccgaaaaagacugccugaaucucgauaagaaccugauuaaguacgaccugcagaaccucaaaccuuauacaaaguacgugcugucccuucacgccuauaucauugcgaaagugcaaagaaauggaucugcugccaugugccauuuuaccacaaagagcgcucccccuucccaggucuggaacaugacggugagcaugaccucugauaauuccaugcacguuaaaugucggcccccgcgcgacagaaacggcccucaugagcgguaccaccuggagguggaagccgggaauacacucguccgcaacgagagccauaagaauugcgauuucagagugaaggaccugcaguauucuaccgacuacacauuuaaagccuauuuccacaacggagauuaccccggcgaacccuuuauccuucaccauuccaccagcuacaauucuaaggcucugaucgccuuccucgcguuucugauuaucguuacgagcauugcccugcucgugguccuguauaaaaucuacgaccuucacaagaaacgguccuguaaccuggaugagcaacaggaacucguggagcgcgacgaugagaagcagcugaugaaugucgaaccuauucaugcugacauccugcuugagaccuauaagagaaaaaucgccgaugaaggccgccucuuccuggcugaguuucagagcauuccgcggguguucucuaaguuccccaucaaagaggccagaaagccuuuuaaccaaaauaaaaaccgguacguugacauucugcccuaugauuacaauagaguggaacucuccgagaucaacggggacgcgggaagcaacuauauuaaugccuccuacaucgauggcuucaaggaaccucgcaaguacauugcugcccaggggccccgggacgagacagucgaugacuuuuggagaaugaucugggaacagaaagcuaccgugaucguuauggugacacgcugcgaggagggaaaccggaauaagugugccgaauauuggccuucuauggaggaaggcaccagagccuucggggacgucguggugaaaauuaaccagcacaagcgcugccccgauuacaucauucaaaaacugaauaucguuaacaagaaagagaaggcuacaggacgggaagucacccacauucaguuuacgagcuggccggaccauggcgugccugaggauccccaccuucugcucaagcugagacgccgggugaaugcguucuccaacuuuuucucuggcccuaucgucgugcauuguagcgccgggguuggaagaacaggcaccuauaucgggauugacgcuaugcuggagggacuugaagccgagaauaaaguggaugucuacggcuaugugguuaagcuccgccggcagagaugccugauggugcaggucgaagcccaauacauccugauucaccaggcucucguggaguauaaccaguuuggggaaaccgagguuaaucuguccgagcuucaucccuaccugcacaacaugaaaaagcgggacccgccuucugaacccagcccucucgaggccgaguuccagcgccugcccuccuacagaagcuggcggacacaacacaucggcaaucaggaagagaacaaaucuaagaauagaaacuccaacgugauucccuaugauuacaaucgcgucccucugaagcaugaacuugagaugagcaaagaaucugagcacgacuccgaugaaagcucugacgaugacuccgauagcgaggagccguccaaguauaucaacgcgagcuuuaucaugucuuacuggaaacccgaagugaugauugcugcccagggaccucucaaggagaccaucggcgacuucuggcaaaugauuuuucagcggaaagugaaggucaucguuaugcugacggaacugaagcauggggaccaggagauuugugcccaguauuggggagaaggcaaacaaacauacggggauaucgagguggaccucaaggauaccgacaaaagcuccacauauacccugagaguguucgagcuucgccacucuaagagaaaagauagccggacagucuaccaguaccaguauaccaauugguccguggaacagcugcccgcugagccuaaggaacucaucucuaugauucaaguugugaagcagaaacugccccagaagaacagcuccgagggaaauaaacaucacaagucuacgccucugcuuauccacugccgcgacggcagccagcaaaccgggauuuucugugcccuccugaaccugcucgaauccgcggagacagaggaagucguggauaucuuucagguugugaaagcucugagaaaggcccggccgggcauggucagcaccuucgagcaguaccaauuucuuuaugacgugauugccucuacauaccccgcucagaauggacagguuaaaaagaacaaucaucaggaagauaagaucgaguucgacaacgagguggauaaagucaagcaagacgccaauugcgugaacccucugggcgcucccgaaaaacucccugaggccaaggaacaggcggagggguccgaacccaccagcggaacggagggcccggagcacucugugaaugggccugccucccccgcucugaaccagggaagcuga

SEQ ID NO: 3275 - protein, 207 aa, Artificial Sequence
  RAB8A__Homo_sapiens__P61006
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 3276 - RNA, 624 nt, Artificial Sequence
  RAB8A__Homo_sapiens__AAH02977
auggcgaagaccuacgauuaccuguucaagcugcugcugaucggggacucggggguggggaagaccuguguccuguuccgcuucuccgaggacgccuucaacuccacuuuuaucuccaccauaggaauugacuuuaaaauuaggaccauagagcucgauggcaagagaauuaaacugcagauaugggacacagccggucaggaacgguuucggacgaucacaacggccuacuacaggggugcaaugggcaucaugcuggucuacgacaucaccaacgagaaguccuucgacaacauccggaacuggauucgcaacauugaggagcacgccucugcagacgucgaaaagaugauacucgggaacaagugugaugugaaugacaagagacaaguuuccaaggaacggggagaaaagcuggcccucgacuauggaaucaaguucauggagaccagcgcgaaggccaacaucaauguggaaaaugcauuuuucacucucgccagagauaucaaagcaaaaauggacaaaaaauuggaaggcaacagcccccaggggagcaaccagggagucaaaaucacaccggaccagcagaagaggagcagcuuuuuccgauguguucuucuguga

SEQ ID NO: 3277 - RNA, 624 nt, Artificial Sequence
  derived and/or modified sequence opt1 from RAB8A__Homo_sapiens__AAH02977
auggccaagaccuacgacuaccuguucaagcuccugcugaucggcgacagcggggugggcaagaccugcguccucuuccgcuucuccgaggacgccuucaacagcacguucaucuccaccaucgggaucgacuucaagauccggaccaucgagcuggacggcaagcgcaucaagcugcagaucugggacaccgcggggcaggagcgguuccgcacgaucaccaccgccuacuaccggggcgccaugggcaucaugcucguguacgacaucaccaacgagaaguccuucgacaacauccgcaacuggauccggaacaucgaggagcacgccagcgccgacguggagaagaugauccuggggaacaagugcgacgucaacgacaagcgccaggugagcaaggagcggggcgagaagcuggcgcucgacuacgggaucaaguucauggagacguccgccaaggccaacaucaacguggagaacgccuucuucacccuggcgcgcgacaucaaggccaagauggacaagaagcuggagggcaacagcccccagggguccaaccagggcgucaagaucaccccggaccagcagaagcggagcuccuucuuccgcugcgugcuccuguga

SEQ ID NO: 3278 - RNA, 624 nt, Artificial Sequence
  derived and/or modified sequence opt2 from RAB8A__Homo_sapiens__AAH02977
auggccaagaccuacgacuaccucuucaagcuccuccucaucggcgacuccggcgucggcaagaccugcguccucuuccgcuucuccgaggacgccuucaacuccaccuucaucuccaccaucggcaucgacuucaagauccgcaccaucgagcucgacggcaagcgcaucaagcuccagaucugggacaccgccggccaggagcgcuuccgcaccaucaccaccgccuacuaccgcggcgccaugggcaucaugcucgucuacgacaucaccaacgagaaguccuucgacaacauccgcaacuggauccgcaacaucgaggagcacgccuccgccgacgucgagaagaugauccucggcaacaagugcgacgucaacgacaagcgccaggucuccaaggagcgcggcgagaagcucgcccucgacuacggcaucaaguucauggagaccuccgccaaggccaacaucaacgucgagaacgccuucuucacccucgcccgcgacaucaaggccaagauggacaagaagcucgagggcaacuccccccagggcuccaaccagggcgucaagaucacccccgaccagcagaagcgcuccuccuucuuccgcugcguccuccucuga

SEQ ID NO: 3279 - RNA, 624 nt, Artificial Sequence
  derived and/or modified sequence opt3 from RAB8A__Homo_sapiens__AAH02977
auggccaagaccuacgacuaucuguucaaacuccuucugaucggcgauaguggggugggaaagacaugcgucuuguuuagauucuccgaggacgcuuuuaacucuacuuucauuucaacgauagguaucgauuuuaaaauuaggaccaucgaauuagacggcaagcggauuaaacugcagaucugggauacagcagggcaagagcgcuuccgaacuauaaccacagccuacuaucguggagcgaugggcaucaugcuaguuuacgacauuaccaaugaaaagaguuuugauaacaucagaaauuggauuaggaacaucgaggaacacgcuagcgccgacguggagaagaugauacucgguaauaaaugugauguaaacgacaagcggcaaguguccaaagagcgcggggaaaagcuggcacuugauuauggaauuaaauucauggagacuucugccaaggcuaauaucaacgucgaaaaugcauuuuucacacuggccagagacauuaaggcuaaaauggauaagaaauuggagggcaacucgccccagggcucaaaucagggggugaagaucaccccugaccagcagaaaaggagcagcuuuuuccggugcguucuccuguga

SEQ ID NO: 3280 - RNA, 624 nt, Artificial Sequence
  derived and/or modified sequence opt4 from RAB8A__Homo_sapiens__AAH02977
auggccaagaccuacgacuaccuguucaagcugcugcugaucggcgacagcggcgugggcaagaccugcgugcuguucagauucagcgaggacgccuucaacagcaccuucaucagcaccaucggcaucgacuucaagaucagaaccaucgagcuggacggcaagagaaucaagcugcagaucugggacaccgccggccaggagagauucagaaccaucaccaccgccuacuacagaggcgccaugggcaucaugcugguguacgacaucaccaacgagaagagcuucgacaacaucagaaacuggaucagaaacaucgaggagcacgccagcgccgacguggagaagaugauccugggcaacaagugcgacgugaacgacaagagacaggugagcaaggagagaggcgagaagcuggcccuggacuacggcaucaaguucauggagaccagcgccaaggccaacaucaacguggagaacgccuucuucacccuggccagagacaucaaggccaagauggacaagaagcuggagggcaacagcccccagggcagcaaccagggcgugaagaucacccccgaccagcagaagagaagcagcuucuucagaugcgugcugcuguga

SEQ ID NO: 3281 - RNA, 624 nt, Artificial Sequence
  derived and/or modified sequence opt5 from RAB8A__Homo_sapiens__AAH02977
auggccaagaccuacgacuaucuguucaaacuccugcuuaucggcgauagcggggugggaaagacaugcguccuguuuagauucuccgaggacgcuuuuaacucuacguucauuagcaccaucggcauugauuuuaaaauccggacaauugaacucgacgggaagcgcaucaaacugcagaucugggauaccgccggacaagagagauuccggacaauuaccacagcguacuaucgcggcgcuauggggaucaugcuuguuuacgacauuaccaaugaaaaguccuuugauaacaucagaaauuggauucggaacaucgaggaacacgccucugccgacguggagaagaugauucugggaaauaaaugugaugugaacgacaagcgccaggucagcaaagagagaggcgaaaagcucgcucuggauuauggcaucaaauucauggagacguccgccaaggcuaauaucaacguggaaaaugccuuuuucacccuggcgcgggacauuaaggccaaaauggauaagaaacucgaggggaacucuccccagggaagcaaucagggcguuaagaucacaccugaccaacagaaacgcuccagcuuuuucagaugcgugcugcuuuga

SEQ ID NO: 3282 - protein, 419 aa, Artificial Sequence
  RAGE-1__Homo_sapiens__Q9UQ07
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 3283 - RNA, 1260 nt, Artificial Sequence
  RAGE-1__Homo_sapiens__BAA81688
augaagaacuauaaagcaauuggcaaaauaggagagggaacguuuucugaaguuaugaagaugcaaagccugagagauggaaacuacuaugcauguaaacaaaugaagcagcgcuuugaaaguauugagcaagucaacaaccuacgagagauccaagcacugaggcgccugaauccgcacccaaacauucuuauguugcaugaagugguuuuugacagaaaaucugguucucuugcacuaauaugugaacuuauggacaugaauauuuaugagcuaauacgagggagaagauacccauuaucagaaaaaaaaauuaugcacuauauguaccaguuauguaagucccuggaucauauucacagaaauggaauauuucacagagauguaaaaccagaaaauauacuaauaaagcaggauguccugaaauuaggggacuuuggcuccugccggagugucuauuccaagcagccguacacggaauacaucuccacccgcugguaccgggccccggagugucuccucacugauggguucuacacguacaagauggaccuguggagcgccggcuguguguucuacgagaucgccagucugcagccccucuuuccuggaguaaaugaacuggaccaaaucucaaaaauccacgaugucaucggcacacccgcucagaagauccucaccaaguucaaacagucgagagcuaugaauuuugauuuuccuuuuaaaaagggaucaggaauaccucuacuaacaaccaauuuguccccacaaugccucucccuccugcacgcaaugguggccuaugaucccgaugagagaaucgccgcccaccaggcccugcagcaccccuacuuccaagaacagaggaaaacagagaagcgggcucugggcagccacagaaaagcuggcuuuccggagcacccuguggcaccggaaccacucaguaacagcugccagauuuccaaggagggcagaaagcagaaacagucccuaaagcaagaggaggaccgucccaagagacgaggaccggccuaugucauggaacugcccaaacuaaagcuuucgggaguggucagacugucgucuuacuccagccccacgcugcaguccgugcuuggaucuggaacaaauggaagagugccggugcugagacccuugaagugcaucccugcgagcaagaagacagauccgcagaaggaccuuaagccugccccgcagcagugucgccugcccaccauagugcggaaaggcggaagauaa

SEQ ID NO: 3284 - RNA, 1260 nt, Artificial Sequence
  derived and/or modified sequence opt1 from RAGE-1__Homo_sapiens__BAA81688
augaagaacuacaaggccaucggcaagaucggggagggcaccuucagcgaggugaugaagaugcagucccugcgcgacgggaacuacuacgccugcaagcagaugaagcagcgguucgagagcaucgagcaggucaacaaccuccgcgagauccaggcccugcggcgccugaacccccacccgaacauccucaugcugcacgaggugguguucgaccggaaguccggcagccuggcccucaucugcgagcugauggacaugaacaucuacgagcugauccgcgggcggcgcuacccccucuccgagaagaagaucaugcacuacauguaccagcugugcaagagccuggaccacauccaccggaacggcaucuuccaccgcgacgucaagcccgagaacauccucaucaagcaggacgugcugaagcugggcgacuucggguccugccggagcguguacuccaagcagcccuacaccgaguacaucagcacgcgcugguaccgggccccggagugccuccugaccgacggcuucuacaccuacaagauggaccugugguccgccgggugcgucuucuacgagaucgccagccuccagccccuguuccccggcgugaacgagcuggaccagaucuccaagauccacgacgugaucgggacccccgcgcagaagauccucacgaaguucaagcagagccgcgccaugaacuucgacuucccguucaagaagggcuccggcaucccccugcugaccaccaaccucagcccccagugccugucccugcuccacgccauggucgccuacgaccccgacgagcggaucgcggcccaccaggcccugcagcacccguacuuccaggagcagcgcaagaccgagaagcgggcccuggggagccaccgcaaggccggcuuccccgagcaccccguggcgcccgagccgcucuccaacagcugccagaucagcaaggaggggcggaagcagaagcagucccugaagcaggaggaggaccgccccaagcggcgcggccccgccuacgugauggagcugcccaagcucaagcugagcggcgucgugcgccuguccagcuacuccagcccgacgcuccaguccgugcuggggagcggcaccaacgggcggguccccgugcugcgcccccucaagugcauccccgccuccaagaagaccgacccgcagaaggaccugaagcccgcgccccagcagugccggcugcccaccaucgugcgcaagggcgggcgguga

SEQ ID NO: 3285 - RNA, 1260 nt, Artificial Sequence
  derived and/or modified sequence opt2 from RAGE-1__Homo_sapiens__BAA81688
augaagaacuacaaggccaucggcaagaucggcgagggcaccuucuccgaggucaugaagaugcagucccuccgcgacggcaacuacuacgccugcaagcagaugaagcagcgcuucgaguccaucgagcaggucaacaaccuccgcgagauccaggcccuccgccgccucaacccccaccccaacauccucaugcuccacgaggucgucuucgaccgcaaguccggcucccucgcccucaucugcgagcucauggacaugaacaucuacgagcucauccgcggccgccgcuacccccucuccgagaagaagaucaugcacuacauguaccagcucugcaagucccucgaccacauccaccgcaacggcaucuuccaccgcgacgucaagcccgagaacauccucaucaagcaggacguccucaagcucggcgacuucggcuccugccgcuccgucuacuccaagcagcccuacaccgaguacaucuccacccgcugguaccgcgcccccgagugccuccucaccgacggcuucuacaccuacaagauggaccucugguccgccggcugcgucuucuacgagaucgccucccuccagccccucuuccccggcgucaacgagcucgaccagaucuccaagauccacgacgucaucggcacccccgcccagaagauccucaccaaguucaagcagucccgcgccaugaacuucgacuuccccuucaagaagggcuccggcaucccccuccucaccaccaaccucuccccccagugccucucccuccuccacgccauggucgccuacgaccccgacgagcgcaucgccgcccaccaggcccuccagcaccccuacuuccaggagcagcgcaagaccgagaagcgcgcccucggcucccaccgcaaggccggcuuccccgagcaccccgucgcccccgagccccucuccaacuccugccagaucuccaaggagggccgcaagcagaagcagucccucaagcaggaggaggaccgccccaagcgccgcggccccgccuacgucauggagcuccccaagcucaagcucuccggcgucguccgccucuccuccuacuccucccccacccuccaguccguccucggcuccggcaccaacggccgcguccccguccuccgcccccucaagugcauccccgccuccaagaagaccgacccccagaaggaccucaagcccgccccccagcagugccgccuccccaccaucguccgcaagggcggccgcuga

SEQ ID NO: 3286 - RNA, 1260 nt, Artificial Sequence
  derived and/or modified sequence opt3 from RAGE-1__Homo_sapiens__BAA81688
augaagaacuacaaagccaucggcaagauuggggagggaaccuucagcgaagugaugaaaaugcagucccugagagacgguaauuauuacgcuugcaagcaaaugaaacagagguuugagucuauagaacaggucaacaaucuccgggagauccaggcacuucgccgacugaacccccacccuaauauuuugauguuacaugaaguuguguucgaucguaagucaggcagucuggcccuaaucugugagcucauggacaugaacauuuaugagcugaucagagggaggcgguacccacuuagcgaaaagaaaauaaugcacuauauguaccaacugugcaaguccuuggaucauauccaccgcaauggaauuuuucauagagacguaaaaccggagaacauccucauuaagcaggaugugcugaaacugggcgacuucgguucuuguaggucggucuauucaaagcagcccuacacagaauacaucagcacucggugguaucgcgcgccugagugccucuuaacggauggguuuuacaccuauaagauggaccuguggagugcuggauguguguucuacgagauagccucccuucagccauuguuucccggcguuaaugaacuggaucaaauuucuaaaauccacgacgugauuggcacuccugcacagaagauccuaacaaaauucaagcagagccgagccaugaacuuugauuucccauuuaaaaagggguccggaaucccccuccugaccacaaaucuuucaccucagugccugaguuugcuccacgcuauggucgcauaugacccagaugagagaauugccgcucaucaagcccugcagcacccguacuuccaggaacaaaggaaaaccgagaagcgggcguuagguagccaucguaaggcaggcuuucccgaacacccuguggccccagagccccugucuaacuccugucagauaucaaaagaggggcgcaagcagaaacagagccucaagcaagaagaggacagaccuaaaaggcggggaccagcuuauguaauggaacuucccaagcugaaguugaguggcguugugcgacuaucuuccuacagcucgccgacucugcagucuguccucgguuccgggacaaauggacgcgugccugugcugagaccccuuaaaugcaucccagccucaaagaaaaccgacccucagaaggaucugaaacccgcaccacagcaauguagguugcccacgauuguccggaagggcggccgcuga

SEQ ID NO: 3287 - RNA, 1260 nt, Artificial Sequence
  derived and/or modified sequence opt4 from RAGE-1__Homo_sapiens__BAA81688
augaagaacuacaaggccaucggcaagaucggcgagggcaccuucagcgaggugaugaagaugcagagccugagagacggcaacuacuacgccugcaagcagaugaagcagagauucgagagcaucgagcaggugaacaaccugagagagauccaggcccugagaagacugaacccccaccccaacauccugaugcugcacgaggugguguucgacagaaagagcggcagccuggcccugaucugcgagcugauggacaugaacaucuacgagcugaucagaggcagaagauacccccugagcgagaagaagaucaugcacuacauguaccagcugugcaagagccuggaccacauccacagaaacggcaucuuccacagagacgugaagcccgagaacauccugaucaagcaggacgugcugaagcugggcgacuucggcagcugcagaagcguguacagcaagcagcccuacaccgaguacaucagcaccagaugguacagagcccccgagugccugcugaccgacggcuucuacaccuacaagauggaccuguggagcgccggcugcguguucuacgagaucgccagccugcagccccuguuccccggcgugaacgagcuggaccagaucagcaagauccacgacgugaucggcacccccgcccagaagauccugaccaaguucaagcagagcagagccaugaacuucgacuuccccuucaagaagggcagcggcaucccccugcugaccaccaaccugagcccccagugccugagccugcugcacgccaugguggccuacgaccccgacgagagaaucgccgcccaccaggcccugcagcaccccuacuuccaggagcagagaaagaccgagaagagagcccugggcagccacagaaaggccggcuuccccgagcaccccguggcccccgagccccugagcaacagcugccagaucagcaaggagggcagaaagcagaagcagagccugaagcaggaggaggacagacccaagagaagaggccccgccuacgugauggagcugcccaagcugaagcugagcggcguggugagacugagcagcuacagcagccccacccugcagagcgugcugggcagcggcaccaacggcagagugcccgugcugagaccccugaagugcauccccgccagcaagaagaccgacccccagaaggaccugaagcccgccccccagcagugcagacugcccaccaucgugagaaagggcggcagauga

SEQ ID NO: 3288 - RNA, 1260 nt, Artificial Sequence
  derived and/or modified sequence opt5 from RAGE-1__Homo_sapiens__BAA81688
augaagaacuacaaagccaucggcaagauuggggagggaaccuucagcgaagugaugaaaaugcagucccugagagacggcaauuauuacgcuugcaagcaaaugaaacagcgguuugagucuaucgaacaggucaacaaucuccgcgagauucaggcccugagacggcuuaacccccacccuaauauccugaugcuccaugaaguuguguucgaucgcaagagcgggucccuggcgcuuauuugugagcugauggacaugaacaucuaugagcucaucagaggacggcgcuacccgcugucugaaaagaaaauuaugcacuauauguaccaacugugcaagagccucgaucauauccacagaaauggcauuuuucaucgggacgugaaacccgagaacauccugauuaagcaggauguccuuaaacugggggacuucggauccugucgcucuguguauagcaagcagccuuacacagaauacaucuccacgagaugguaucgggcucccgagugccuccugaccgauggcuuuuacacauauaagauggaccuuuggagcgccggcuguguuuucuacgagauugccucucugcagccucucuuucccggggugaaugaacuggaucaaaucuccaaaauccacgacgucauuggaaccccugcucagaagauccugacaaaauucaagcagagccgcgccaugaacuuugauuucccguuuaaaaagggcucugggauuccccuccugaccacaaaucuuuccccucagugccugagccuccugcacgcuaugguggccuaugaccccgaugagagaaucgcggcccaucaagcccuucagcacccuuacuuccaggaacaacggaaaaccgagaagcgcgcucugggaucucauagaaaggcuggcuuucccgaacacccgguugccccugagccccucuccaacagcugucagauuuccaaagaggggcggaagcagaaacagucucugaagcaagaagaggacagaccuaaacgccggggacccgcguaugugauggaacugcccaagcucaagcugagcggcgucgugagacuuuccagcuacucuuccccuacgcugcagagcgugcucggcucugggaccaauggacgcgucccgguucugcggccccuuaaaugcaucccugccagcaagaaaacagacccccagaaggaucugaaaccugcuccccagcaauguagacucccgaccaucgugcgcaagggcgggcgguga

SEQ ID NO: 3289 - protein, 462 aa, Artificial Sequence
  RARA__Homo_sapiens__P10276
MASNSSSCPTPGGGHLNGYPVPPYAFFFPPMLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 3290 - RNA, 1389 nt, Artificial Sequence
  RARA__Homo_sapiens__AAH08727
auggccagcaacagcagcuccugcccgacaccugggggcgggcaccucaauggguacccggugccucccuacgccuucuucuuccccccuaugcuggguggacucuccccgccaggcgcucugaccacucuccagcaccagcuuccaguuaguggauauagcacaccauccccagccaccauugagacccagagcagcaguucugaagagauagugcccagcccucccucgccacccccucuaccccgcaucuacaagccuugcuuugucugucaggacaaguccucaggcuaccacuauggggucagcgccugugagggcugcaagggcuucuuccgccgcagcauccagaagaacaugguguacacgugucaccgggacaagaacugcaucaucaacaaggugacccggaaccgcugccaguacugccgacugcagaagugcuuugaagugggcauguccaaggagucugugagaaacgaccgaaacaagaagaagaaggaggugcccaagcccgagugcucugagagcuacacgcugacgccggaggugggggagcucauugagaaggugcgcaaagcgcaccaggaaaccuucccugcccucugccagcugggcaaauacacuacgaacaacagcucagaacaacgugucucucuggacauugaccucugggacaaguucagugaacucuccaccaagugcaucauuaagacuguggaguucgccaagcagcugcccggcuucaccacccucaccaucgccgaccagaucacccuccucaaggcugccugccuggacauccugauccugcggaucugcacgcgguacacgcccgagcaggacaccaugaccuucucggacgggcugacccugaaccggacccagaugcacaacgcuggcuucggcccccucaccgaccuggucuuugccuucgccaaccagcugcugccccuggagauggaugaugcggagacggggcugcucagcgccaucugccucaucugcggagaccgccaggaccuggagcagccggaccggguggacaugcugcaggagccgcugcuggaggcgcuaaaggucuacgugcggaagcggaggcccagccgcccccacauguuccccaagaugcuaaugaagauuacugaccugcgaagcaucagcgccaagggggcugagcgggugaucacgcugaagauggagaucccgggcuccaugccgccucucauccaggaaauguuggagaacucagagggccuggacacucugagcggacagccgggggguggggggcgggacggggguggccuggcccccccgccaggcagcuguagccccagccucagccccagcuccaacagaagcagcccggccacccacuccccguga

SEQ ID NO: 3291 - RNA, 1389 nt, Artificial Sequence
  derived and/or modified sequence opt1 from RARA__Homo_sapiens__AAH08727
auggccagcaacuccagcuccugccccacccccggcgggggccaccugaacggguaccccgugccgcccuacgccuucuucuucccgcccaugcucggcgggcugagcccgcccggcgcgcugaccacgcuccagcaccagcugcccgucuccggcuacagcacccccucccccgccaccaucgagacccagagcuccagcuccgaggagaucgugcccagcccgcccuccccgccgccccugccccgcaucuacaagcccugcuucgugugccaggacaagagcuccggguaccacuacggcgucagcgccugcgaggggugcaagggcuucuuccggcgcuccauccagaagaacaugguguacacgugccaccgggacaagaacugcaucaucaacaaggugacccgcaaccggugccaguacugccgccuccagaagugcuucgaggucgggaugagcaaggaguccgugcggaacgaccgcaacaagaagaagaaggaggugcccaagcccgagugcagcgagagcuacacccugacccccgaggucggcgagcugaucgagaaggugcggaaggcccaccaggagacguuccccgcccucugccagcugggcaaguacaccaccaacaacuccagcgagcagcgcgugucccuggacaucgaccucugggacaaguucagcgagcuguccaccaagugcaucaucaagacggucgaguucgcgaagcagcugcccggguucaccacccucaccaucgccgaccagaucacgcugcugaaggccgccugccucgacauccugauccugcggaucugcacccgcuacacccccgagcaggacaccaugacguucagcgacggccucacccugaaccggacccagaugcacaacgcgggguucggcccccugaccgaccucguguucgccuucgccaaccagcugcugccccucgagauggacgacgccgagacgggccugcuguccgccaucugccucaucugcggggaccgccaggaccuggagcagcccgaccggguggacaugcugcaggagccgcuccuggaggcgcugaaggucuacgugcgcaagcggcgccccagccggccccacauguucccgaagaugcucaugaagaucaccgaccugcgcuccaucagcgccaagggcgccgagcgggugaucacccugaagauggagauccccggguccaugccgccccucauccaggagaugcuggagaacagcgagggccuggacacccucuccgggcagcccggcggcgggggccgcgacgggggcgggcuggccccgccgcccggcagcugcucccccagccugucccccagcuccaaccgcagcagccccgccacgcacucccccuga

SEQ ID NO: 3292 - RNA, 1389 nt, Artificial Sequence
  derived and/or modified sequence opt2 from RARA__Homo_sapiens__AAH08727
auggccuccaacuccuccuccugccccacccccggcggcggccaccucaacggcuaccccgucccccccuacgccuucuucuucccccccaugcucggcggccucuccccccccggcgcccucaccacccuccagcaccagcuccccgucuccggcuacuccacccccucccccgccaccaucgagacccaguccuccuccuccgaggagaucguccccuccccccccuccccccccccccucccccgcaucuacaagcccugcuucgucugccaggacaaguccuccggcuaccacuacggcgucuccgccugcgagggcugcaagggcuucuuccgccgcuccauccagaagaacauggucuacaccugccaccgcgacaagaacugcaucaucaacaaggucacccgcaaccgcugccaguacugccgccuccagaagugcuucgaggucggcauguccaaggaguccguccgcaacgaccgcaacaagaagaagaaggagguccccaagcccgagugcuccgaguccuacacccucacccccgaggucggcgagcucaucgagaagguccgcaaggcccaccaggagaccuuccccgcccucugccagcucggcaaguacaccaccaacaacuccuccgagcagcgcgucucccucgacaucgaccucugggacaaguucuccgagcucuccaccaagugcaucaucaagaccgucgaguucgccaagcagcuccccggcuucaccacccucaccaucgccgaccagaucacccuccucaaggccgccugccucgacauccucauccuccgcaucugcacccgcuacacccccgagcaggacaccaugaccuucuccgacggccucacccucaaccgcacccagaugcacaacgccggcuucggcccccucaccgaccucgucuucgccuucgccaaccagcuccucccccucgagauggacgacgccgagaccggccuccucuccgccaucugccucaucugcggcgaccgccaggaccucgagcagcccgaccgcgucgacaugcuccaggagccccuccucgaggcccucaaggucuacguccgcaagcgccgccccucccgcccccacauguuccccaagaugcucaugaagaucaccgaccuccgcuccaucuccgccaagggcgccgagcgcgucaucacccucaagauggagauccccggcuccaugcccccccucauccaggagaugcucgagaacuccgagggccucgacacccucuccggccagcccggcggcggcggccgcgacggcggcggccucgcccccccccccggcuccugcucccccucccucucccccuccuccaaccgcuccucccccgccacccacucccccuga

SEQ ID NO: 3293 - RNA, 1389 nt, Artificial Sequence
  derived and/or modified sequence opt3 from RARA__Homo_sapiens__AAH08727
auggccagcaacuccucuucaugccccaccccuggcgggggacaccugaaugguuacccagugccgcccuaugcuuucuuuuucccuccaaugcucggcgggcuuagucccccuggagcacugacaacuuugcagcaucaauuaccagucagcggcuacuccacgcccucuccugccaccaucgagacacagucgucaagcagugaggagauuguuccauccccgcccucuccuccaccccugccuagaauauauaagccauguuuugugugccaggacaaaagcuccgguuaccacuaugggguaucagcgugugaaggaugcaagggcuucuuuaggcggaguauccagaaaaacaugguguacacuugucaucgcgauaagaauugcauuaucaacaaagucacccgaaaucguugucaauauugcagacuacagaaguguuucgaggugggcaugagcaaggaaucuguuaggaacgaccggaauaaaaagaaaaaggaggugcccaaaccggagugcuccgaaucauacacacucaccccugaggucggggaacugauugagaaggugcgcaaggcucaccaggagacuuuucccgcccuuugucagcugggaaaauacacaaccaacaauagcagugaacaaagaguaucuuuggauaucgaccucugggauaaguucuccgagcugagcacgaaaugcauaaucaagacuguugaauuugcaaaacagcugccagguuucaccacacucacuauugccgaccagaucaccuuacugaaggcugcaugccuugauauuuugauccugaggauauguacacgguauaccccugagcaggacacgaugacuuuuucggauggccuaacacucaaccgcacccaaaugcauaaugccggguucggaccccugacugaccuuguguuugcuuucgccaaccagcuguugccacucgaaauggaugacgcggagacaggccuguuaucugcaauuugccugaucuguggugaucgacaggaccucgagcaacccgacagagucgauaugcuucaggaaccucuguuggaggcccuaaaaguguacgugaggaagcggcguccaucccgcccgcacauguuccccaagaugcugaugaaaauuaccgaccucagaucaaucagugcuaagggggccgaaagggucaucacgcugaaaauggagauuccuggaagcaugccaccccuuauacaggaaaugcuggaaaauuccgagggcuuggauacccucucuggccagccugggggagguggccgggacgggggaggccuggcaccacccccggguagcugcucaccuaguuuauccccaagcucuaaccgaucaagucccgcuacacacagcccuuga

SEQ ID NO: 3294 - RNA, 1389 nt, Artificial Sequence
  derived and/or modified sequence opt4 from RARA__Homo_sapiens__AAH08727
auggccagcaacagcagcagcugccccacccccggcggcggccaccugaacggcuaccccgugccccccuacgccuucuucuucccccccaugcugggcggccugagcccccccggcgcccugaccacccugcagcaccagcugcccgugagcggcuacagcacccccagccccgccaccaucgagacccagagcagcagcagcgaggagaucgugcccagcccccccagcccccccccccugcccagaaucuacaagcccugcuucgugugccaggacaagagcagcggcuaccacuacggcgugagcgccugcgagggcugcaagggcuucuucagaagaagcauccagaagaacaugguguacaccugccacagagacaagaacugcaucaucaacaaggugaccagaaacagaugccaguacugcagacugcagaagugcuucgaggugggcaugagcaaggagagcgugagaaacgacagaaacaagaagaagaaggaggugcccaagcccgagugcagcgagagcuacacccugacccccgaggugggcgagcugaucgagaaggugagaaaggcccaccaggagaccuuccccgcccugugccagcugggcaaguacaccaccaacaacagcagcgagcagagagugagccuggacaucgaccugugggacaaguucagcgagcugagcaccaagugcaucaucaagaccguggaguucgccaagcagcugcccggcuucaccacccugaccaucgccgaccagaucacccugcugaaggccgccugccuggacauccugauccugagaaucugcaccagauacacccccgagcaggacaccaugaccuucagcgacggccugacccugaacagaacccagaugcacaacgccggcuucggcccccugaccgaccugguguucgccuucgccaaccagcugcugccccuggagauggacgacgccgagaccggccugcugagcgccaucugccugaucugcggcgacagacaggaccuggagcagcccgacagaguggacaugcugcaggagccccugcuggaggcccugaagguguacgugagaaagagaagacccagcagaccccacauguuccccaagaugcugaugaagaucaccgaccugagaagcaucagcgccaagggcgccgagagagugaucacccugaagauggagauccccggcagcaugcccccccugauccaggagaugcuggagaacagcgagggccuggacacccugagcggccagcccggcggcggcggcagagacggcggcggccuggcccccccccccggcagcugcagccccagccugagccccagcagcaacagaagcagccccgccacccacagccccuga

SEQ ID NO: 3295 - RNA, 1389 nt, Artificial Sequence
  derived and/or modified sequence opt5 from RARA__Homo_sapiens__AAH08727
auggccagcaacuccucuagcugccccaccccuggcgggggacaccugaauggcuacccggugcccccuuaugcuuucuuuuucccucccaugcucgggggacugucucccccuggcgcccuuacaacgcugcagcaucaacucccggucuccggguacagcacccccuccccugcgacaaucgagacccagucuagcuccagcgaagagauuguucccucuccucccuccccgccuccccugccuagaaucuauaagcccuguuuugugugccaggacaaaagcucuggauaccacuauggcguguccgcuugugaaggcugcaagggguucuuucggcgcagcauucagaaaaacauggucuacacaugucauagagauaagaauugcaucauuaacaaagugacccggaaucgcugucaauauugcagacuucagaaguguuucgagguuggaaugucuaaggaauccgugcggaacgaccgcaauaaaaagaaaaaggagguccccaaaccugagugcagcgaauccuacacacugaccccggaggugggcgaacucaucgagaagguuagaaaggcccaccaggagacguuucccgcccugugucagcuggggaaauacaccacaaacaauucuagcgaacaacgggugucccucgauaucgaccugugggauaaguucagcgagcuuucuaccaaaugcauuaucaagacagucgaauuugcuaaacagcugccuggauucaccacgcucacaauugccgaccagaucacccugcuuaaggcugccugccuggauauucucauccugcgcauuuguacaagauauacccccgagcaggacaccaugacauuuuccgauggccugacgcucaaccggacccaaaugcauaaugcgggguucggaccucugacagaccuuguguuugccuucgcuaaccagcugcucccccuggaaauggaugacgccgagaccggccuucugagcgcuaucugccucaucuguggcgaucgccaggaccuggagcaaccggacagaguggauaugcugcaggaaccucuccuggaggcccuuaaagucuacguucggaagcgcagacccucucggccucacauguuccccaagaugcugaugaaaauuacagaccucagaagcaucuccgcgaagggggccgaacgcgugauuacccugaaaauggagaucccuggaucuaugcccccgcuuauucaggaaaugcuggagaauagcgagggccucgauacgcuguccgggcagccuggaggcgggggacgggacggcggcgggcuggcucccccucccggaagcugcucuccgucccucagccccucuuccaacagaagcuccccugccacacacucucccuga

SEQ ID NO: 3296 - protein, 189 aa, Artificial Sequence
  RASH__Homo_sapiens__P01112
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 3297 - RNA, 570 nt, Artificial Sequence
  RASH__Homo_sapiens__AAB02605
augacggaauauaagcuggugguggugggcgccggcggugugggcaagagugcgcugaccauccagcugauccagaaccauuuuguggacgaauacgaccccacuauagaggauuccuaccggaagcagguggucauugauggggagacgugccuguuggacauccuggauaccgccggccaggaggaguacagcgccaugcgggaccaguacaugcgcaccggggagggcuuccuguguguguuugccaucaacaacaccaagucuuuugaggacauccaccaguacagggagcagaucaaacgggugaaggacucggaugacgugcccauggugcugguggggaacaagugugaccuggcugcacgcacuguggaaucucggcaggcucaggaccucgcccgaagcuacggcauccccuacaucgagaccucggccaagacccggcagggaguggaggaugccuucuacacguuggugcgugagauccggcagcacaagcugcggaagcugaacccuccugaugagaguggccccggcugcaugagcugcaagugugugcucuccuga

SEQ ID NO: 3298 - RNA, 570 nt, Artificial Sequence
  derived and/or modified sequence opt1 from RASH__Homo_sapiens__AAB02605
augaccgaguacaagcugguggucgugggcgccgggggcgugggcaagagcgcccucaccauccagcugauccagaaccacuucgucgacgaguacgaccccacgaucgaggacuccuaccgcaagcaggucgugaucgacggggagaccugccugcucgacauccuggacaccgcggggcaggaggaguacagcgccaugcgggaccaguacaugcgcaccggcgagggcuuccugugcguguucgccaucaacaacacgaaguccuucgaggacauccaccaguaccgggagcagaucaagcgcgugaaggacagcgacgacgugccgaugguccucguggggaacaagugcgaccuggccgcccggaccguggagucccgccaggcgcaggaccuggcccggagcuacggcauccccuacaucgagaccuccgccaagacccgccagggggucgaggacgccuucuacacgcucgugcgggagauccgccagcacaagcugcggaagcugaacccgcccgacgagagcggccccgggugcauguccugcaagugcgugcucagcuga

SEQ ID NO: 3299 - RNA, 570 nt, Artificial Sequence
  derived and/or modified sequence opt2 from RASH__Homo_sapiens__AAB02605
augaccgaguacaagcucgucgucgucggcgccggcggcgucggcaaguccgcccucaccauccagcucauccagaaccacuucgucgacgaguacgaccccaccaucgaggacuccuaccgcaagcaggucgucaucgacggcgagaccugccuccucgacauccucgacaccgccggccaggaggaguacuccgccaugcgcgaccaguacaugcgcaccggcgagggcuuccucugcgucuucgccaucaacaacaccaaguccuucgaggacauccaccaguaccgcgagcagaucaagcgcgucaaggacuccgacgacguccccaugguccucgucggcaacaagugcgaccucgccgcccgcaccgucgagucccgccaggcccaggaccucgcccgcuccuacggcauccccuacaucgagaccuccgccaagacccgccagggcgucgaggacgccuucuacacccucguccgcgagauccgccagcacaagcuccgcaagcucaacccccccgacgaguccggccccggcugcauguccugcaagugcguccucuccuga

SEQ ID NO: 3300 - RNA, 570 nt, Artificial Sequence
  derived and/or modified sequence opt3 from RASH__Homo_sapiens__AAB02605
augaccgaguacaagcugguggucguuggcgccgggggaguggguaaaagcgcucucacaauccagcuuauucaaaaccacuucguagacgaauaugaucccacuauagaggacuccuacagaaaacagguggucaucgauggcgaaacgugccuguuggacauuuuagauaccgcagggcaggaggaauauucugccaugagggaccaguacaugcggacaggagagggcuuucuguguguguucgcgaucaauaacacuaagucauuugaggauauucaucaauaucgcgaacagaucaagcgaguuaaagacagugaugacgugccuaugguccuaguggguaauaagugcgaucucgcugcccguaccguagagagcagacaggcacaggaccuggccagguccuacgggauaccauauaucgaaacaucugcuaagacccggcaaggaguugaggaugcauucuacacucuugugcgcgagauuagacagcacaaacugaggaaguugaacccgcccgacgaaucgggcccuggcuguaugucaugcaaauguguccucagcuga

SEQ ID NO: 3301 - RNA, 570 nt, Artificial Sequence
  derived and/or modified sequence opt4 from RASH__Homo_sapiens__AAB02605
augaccgaguacaagcuggugguggugggcgccggcggcgugggcaagagcgcccugaccauccagcugauccagaaccacuucguggacgaguacgaccccaccaucgaggacagcuacagaaagcagguggugaucgacggcgagaccugccugcuggacauccuggacaccgccggccaggaggaguacagcgccaugagagaccaguacaugagaaccggcgagggcuuccugugcguguucgccaucaacaacaccaagagcuucgaggacauccaccaguacagagagcagaucaagagagugaaggacagcgacgacgugcccauggugcuggugggcaacaagugcgaccuggccgccagaaccguggagagcagacaggcccaggaccuggccagaagcuacggcauccccuacaucgagaccagcgccaagaccagacagggcguggaggacgccuucuacacccuggugagagagaucagacagcacaagcugagaaagcugaacccccccgacgagagcggccccggcugcaugagcugcaagugcgugcugagcuga

SEQ ID NO: 3302 - RNA, 570 nt, Artificial Sequence
  derived and/or modified sequence opt5 from RASH__Homo_sapiens__AAB02605
augaccgaguacaagcugguggucguuggcgccgggggagugggcaaaagcgcucucacaauccagcugauucaaaaccacuucguggacgaauaugaucccacgaucgaggacuccuacagaaagcaggucgugauugauggggaaaccugccuucuggacauccucgauacagccggacaggaggaauauucugcgaugcgggaccaguacaugcgcaccggcgagggguuucuguguguuuucgcuauuaacaacacaaagagcuuugaggauauccaucaauauagagaacagaucaaacgggugaaagacuccgaugacgucccuauggugcuuguuggaaauaagugcgaucuggccgcccgcaccguggagucuagacaggcucaggaccucgcccggagcuacggcauuccguauaucgaaacauccgcuaagacccgccaaggcgucgaggaugccuucuacacgcuggugagagagauucggcagcacaaacugcgcaagcucaaucccccugacgaaucugggcccggauguaugagcugcaaaugugugcuguccuga

SEQ ID NO: 3303 - protein, 189 aa, Artificial Sequence [sequence omitted]

SEQ ID NO: 3304 - RNA, 570 nt, Artificial Sequence
  RASK__Homo_sapiens__AAB59445
augacugaauauaaacuugugguaguuggagcugguggcguaggcaagagugccuugacgauacagcuaauucagaaucauuuuguggacgaauaugauccaacaauagaggauuccuacaggaagcaaguaguaauugauggagaaaccugucucuuggauauucucgacacagcaggucaagaggaguacagugcaaugagggaccaguacaugaggacuggggagggcuuucuuuguguauuugccauaaauaauacuaaaucauuugaagauauucaccauuauagagaacaaauuaaaagaguuaaggacucugaagauguaccuaugguccuaguaggaaauaaaugugauuugccuucuagaacaguagacacaaaacaggcucaggacuuagcaagaaguuauggaauuccuuuuauugaaacaucagcaaagacaagacagagaguggaggaugcuuuuuauacauuggugagagagauccgacaauacagauugaaaaaaaucagcaaagaagaaaagacuccuggcugugugaaaauuaaaaaaugcauuauaauguaa

SEQ ID NO: 3305 - RNA, 570 nt, Artificial Sequence
  derived and/or modified sequence opt1 from RASK__Homo_sapiens__AAB59445
augaccgaguacaagcugguggucgugggcgccgggggcgugggcaagagcgcccucaccauccagcugauccagaaccacuucgucgacgaguacgaccccacgaucgaggacuccuaccgcaagcaggucgugaucgacggggagaccugccugcucgacauccuggacaccgcggggcaggaggaguacagcgccaugcgggaccaguacaugcgcaccggcgagggcuuccugugcguguucgccaucaacaacacgaaguccuucgaggacauccaccacuaccgggagcagaucaagcgcgugaaggacagcgaggacgugccgaugguccucguggggaacaagugcgaccugcccucccggaccguggacaccaagcaggcccaggaccuggcccgcagcuacggcauccccuucaucgagaccuccgcgaagacgcggcagcgcgucgaggacgccuucuacacccucgugcgggagauccgccaguaccggcugaagaagaucagcaaggaggagaagacccccgggugcgugaagaucaagaagugcaucaucauguga

SEQ ID NO: 3306 - RNA, 570 nt, Artificial Sequence
  derived and/or modified sequence opt2 from RASK__Homo_sapiens__AAB59445
augaccgaguacaagcucgucgucgucggcgccggcggcgucggcaaguccgcccucaccauccagcucauccagaaccacuucgucgacgaguacgaccccaccaucgaggacuccuaccgcaagcaggucgucaucgacggcgagaccugccuccucgacauccucgacaccgccggccaggaggaguacuccgccaugcgcgaccaguacaugcgcaccggcgagggcuuccucugcgucuucgccaucaacaacaccaaguccuucgaggacauccaccacuaccgcgagcagaucaagcgcgucaaggacuccgaggacguccccaugguccucgucggcaacaagugcgaccuccccucccgcaccgucgacaccaagcaggcccaggaccucgcccgcuccuacggcauccccuucaucgagaccuccgccaagacccgccagcgcgucgaggacgccuucuacacccucguccgcgagauccgccaguaccgccucaagaagaucuccaaggaggagaagacccccggcugcgucaagaucaagaagugcaucaucauguga

SEQ ID NO: 3307 - RNA, 570 nt, Artificial Sequence
  derived and/or modified sequence opt3 from RASK__Homo_sapiens__AAB59445
augaccgaguacaagcugguggucguuggcgccgggggaguggguaaaagcgcucucacaauccagcuuauucaaaaccacuucguagacgaauaugaucccacuauagaggacuccuacagaaaacagguggucaucgauggcgaaacgugccuguuggacauuuuagauaccgcagggcaggaggaauauucugccaugagggaccaguacaugcggacaggagagggcuuucuguguguguucgcgaucaauaacacuaagucauuugaggauauucaucacuaucgcgaacaaaucaagcgaguuaaagacagugaggaugugccuaugguccuaguggguaauaagugcgaccucccaagccguaccguagauacaaagcaggcucaggaccuggccagauccuacgggauaccguucaucgaaaccucugcaaaaacuaggcagcggguugaggaugccuuuuauacacuugugcgcgagauuagacaauacaggcugaagaaaaucucgaaggaagagaaaacccccggaugugucaagauuaagaaaugcaucauaauguga

SEQ ID NO: 3308 - RNA, 570 nt, Artificial Sequence
  derived and/or modified sequence opt4 from RASK__Homo_sapiens__AAB59445
augaccgaguacaagcuggugguggugggcgccggcggcgugggcaagagcgcccugaccauccagcugauccagaaccacuucguggacgaguacgaccccaccaucgaggacagcuacagaaagcagguggugaucgacggcgagaccugccugcuggacauccuggacaccgccggccaggaggaguacagcgccaugagagaccaguacaugagaaccggcgagggcuuccugugcguguucgccaucaacaacaccaagagcuucgaggacauccaccacuacagagagcagaucaagagagugaaggacagcgaggacgugcccauggugcuggugggcaacaagugcgaccugcccagcagaaccguggacaccaagcaggcccaggaccuggccagaagcuacggcauccccuucaucgagaccagcgccaagaccagacagagaguggaggacgccuucuacacccuggugagagagaucagacaguacagacugaagaagaucagcaaggaggagaagacccccggcugcgugaagaucaagaagugcaucaucauguga

SEQ ID NO: 3309 - RNA, 570 nt, Artificial Sequence
  derived and/or modified sequence opt5 from RASK__Homo_sapiens__AAB59445
augaccgaguacaagcugguggucguuggcgccgggggagugggcaaaagcgcucucacaauccagcugauucaaaaccacuucguggacgaauaugaucccacgaucgaggacuccuacagaaagcaggucgugauugauggggaaaccugccuucuggacauccucgauacagccggacaggaggaauauucugcgaugcgggaccaguacaugcgcaccggcgagggguuucuguguguuuucgcuauuaauaacacaaagagcuuugaggauauccaucacuauagagaacaaaucaaacgggugaaagacuccgaggaugucccuauggugcuuguuggaaauaagugcgaccugccgucucgcaccguggauacaaagcaggcccaggaccucgccagaagcuacggcauucccuucaucgaaaccuccgcuaaaacgcggcagcgcgucgaggaugccuuuuauacccuggugagagagauucggcaauaccgccugaagaaaaucucuaaggaagagaaaacaccuggcugugugaagauuaagaaaugcaucauuauguga

SEQ ID NO: 3310 - protein, 189 aa, Artificial Sequence
  RASN__Homo_sapiens__P01111
MTEYKLVVVGAGGVGKSALTIQLIQNHFVDEYDPTIEDSYRKQVVIDGETCLLDILDTAGQEEYSAMRDQYMRTGEGFLCVFAINNSKSFADINLYREQIKRVKDSDDVPMVLVGNKCDLPTRTVDTKQAHELAKSYGIPFIETSAKTRQGVEDAFYTLVREIRQYRMKKLNSSDDGTQGCMGLPCVVM

SEQ ID NO: 3311 - RNA, 570 nt, Artificial Sequence
  RASN__Homo_sapiens__AAA60255
augacugaguacaaacugguggugguuggagcaggugguguugggaaaagcgcacugacaauccagcuaauccagaaccacuuuguagaugaauaugaucccaccauagaggauucuuacagaaaacaagugguuauagauggugaaaccuguuuguuggacauacuggauacagcuggacaagaagaguacagugccaugagagaccaauacaugaggacaggcgaaggcuuccucuguguauuugccaucaauaauagcaagucauuugcggauauuaaccucuacagggagcagauuaagcgaguaaaagacucggaugauguaccuauggugcuagugggaaacaagugugauuugccaacaaggacaguugauacaaaacaagcccacgaacuggccaagaguuacgggauuccauucauugaaaccucagccaagaccagacaggguguugaagaugcuuuuuacacacugguaagagaaauacgccaguaccgaaugaaaaaacucaacagcagugaugaugggacucaggguuguaugggauugccauguguggugauguaa

SEQ ID NO: 3312 - RNA, 570 nt, Artificial Sequence
  derived and/or modified sequence opt1 from RASN__Homo_sapiens__AAA60255
augaccgaguacaagcugguggucgugggcgccgggggcgugggcaagagcgcccucaccauccagcugauccagaaccacuucgucgacgaguacgaccccacgaucgaggacuccuaccgcaagcaggucgugaucgacggggagaccugccugcucgacauccuggacaccgcggggcaggaggaguacagcgccaugcgggaccaguacaugcgcaccggcgagggcuuccugugcguguucgccaucaacaacuccaagagcuucgccgacaucaaccucuaccgggagcagaucaagcgcgugaaggacuccgacgacgugccgaugguccugguggggaacaagugcgaccugcccacgcggaccguggacaccaagcaggcccacgagcucgccaagagcuacggcauccccuucaucgagaccuccgcgaagacgcgccagggggucgaggacgccuucuacacccuggugcgggagauccgccaguaccggaugaagaagcugaacagcuccgacgacggcacccaggggugcaugggccuccccugcguggucauguga

SEQ ID NO: 3313 - RNA, 570 nt, Artificial Sequence
  derived and/or modified sequence opt2 from RASN__Homo_sapiens__AAA60255
augaccgaguacaagcucgucgucgucggcgccggcggcgucggcaaguccgcccucaccauccagcucauccagaaccacuucgucgacgaguacgaccccaccaucgaggacuccuaccgcaagcaggucgucaucgacggcgagaccugccuccucgacauccucgacaccgccggccaggaggaguacuccgccaugcgcgaccaguacaugcgcaccggcgagggcuuccucugcgucuucgccaucaacaacuccaaguccuucgccgacaucaaccucuaccgcgagcagaucaagcgcgucaaggacuccgacgacguccccaugguccucgucggcaacaagugcgaccuccccacccgcaccgucgacaccaagcaggcccacgagcucgccaaguccuacggcauccccuucaucgagaccuccgccaagacccgccagggcgucgaggacgccuucuacacccucguccgcgagauccgccaguaccgcaugaagaagcucaacuccuccgacgacggcacccagggcugcaugggccuccccugcgucgucauguga

SEQ ID NO: 3314 - RNA, 570 nt, Artificial Sequence
  derived and/or modified sequence opt3 from RASN__Homo_sapiens__AAA60255
augaccgaguacaagcugguggucguuggcgccgggggaguggguaaaagcgcucucacaauccagcuuauucaaaaccacuucguagacgaauaugaucccacuauagaggacuccuacagaaaacagguggucaucgauggcgaaacgugccuguuggacauuuuagauaccgcagggcaggaggaauauucugccaugagggaccaguacaugcggacaggagagggcuuucuguguguguucgcgaucaauaacucaaagaguuuugcugauauuaaucuauaucgcgagcaaaucaagcgaguuaaagacagcgaugacgugccuaugguccucguggguaacaagugcgaucugccaacucguaccguagacacaaagcaggcccaugaacuugcaaaauccuacgggauaccguucaucgagaccucugccaagacuagacagggaguugaagaugcuuuuuauacacuggugagggagauucggcaguaccgcaugaaaaagcucaauucgucagacgacggcacccaaggcuguaugggguugcccugcgucgugauguga

SEQ ID NO: 3315 - RNA, 570 nt, Artificial Sequence
  derived and/or modified sequence opt4 from RASN__Homo_sapiens__AAA60255
augaccgaguacaagcuggugguggugggcgccggcggcgugggcaagagcgcccugaccauccagcugauccagaaccacuucguggacgaguacgaccccaccaucgaggacagcuacagaaagcagguggugaucgacggcgagaccugccugcuggacauccuggacaccgccggccaggaggaguacagcgccaugagagaccaguacaugagaaccggcgagggcuuccugugcguguucgccaucaacaacagcaagagcuucgccgacaucaaccuguacagagagcagaucaagagagugaaggacagcgacgacgugcccauggugcuggugggcaacaagugcgaccugcccaccagaaccguggacaccaagcaggcccacgagcuggccaagagcuacggcauccccuucaucgagaccagcgccaagaccagacagggcguggaggacgccuucuacacccuggugagagagaucagacaguacagaaugaagaagcugaacagcagcgacgacggcacccagggcugcaugggccugcccugcguggugauguga

SEQ ID NO: 3316 - RNA, 570 nt, Artificial Sequence
  derived and/or modified sequence opt5 from RASN__Homo_sapiens__AAA60255
augaccgaguacaagcugguggucguuggcgccgggggagugggcaaaagcgcucucacaauccagcugauucaaaaccacuucguggacgaauaugaucccacgaucgaggacuccuacagaaagcaggucgugauugauggggaaaccugccuucuggacauccucgauacagccggacaggaggaauauucugcgaugcgggaccaguacaugcgcaccggcgagggguuucuguguguuuucgcuauuaauaacagcaaauccuuugccgauaucaaucuuuauagagagcaaaucaagcgggugaaagacucugaugacgucccuauggugcugguuggaaacaagugcgaucucccgacacgcaccguggacacaaagcaggcccaugaacuggcuaaaagcuacggcauucccuucaucgagaccuccgccaagacgagacagggcgucgaagaugcuuuuuauacccuggugcgggagauucgccaguacagaaugaaaaagcucaauucuagcgacgacgggacacaaggauguaugggccugccuugcguggucauguga

SEQ ID NO: 3317 - protein, 181 aa, Artificial Sequence
  RGS5__Homo_sapiens__O15539
MCKGLAALPHSCLERAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVNIDHFTKDITMKNLVEPSLSSFDMAQKRIHALMEKDSLPRFVRSEFYQELIK

SEQ ID NO: 3318 - RNA, 546 nt, Artificial Sequence
  RGS5__Homo_sapiens__AAB84001
augugcaaaggacuugcagcuuugccccacucaugccuggaaagggccaaggagauuaagaucaaguugggaauucuccuccagaagccagacucaguuggugaccuugucauuccguacaaugagaagccagagaaaccagccaagacccagaaaaccucgcuggacgaggcccugcaguggcgugauucccuggacaaacuccugcagaacaacuauggacuugccaguuucaaaaguuuccugaagucugaauucagugaggaaaaccuugaguucuggauugccugugaggauuacaagaagaucaaguccccugccaagauggcugagaaggcaaagcaaauuuaugaagaauucauucaaacggaggcuccuaaagaggugaauauugaccacuucacuaaggacaucacaaugaagaaccugguggaaccuucccugagcagcuuugacauggcccagaaaagaauccaugcccugauggaaaaggauucucugccucgcuuugugcgcucugaguuuuaucaggaguuaaucaaguag

SEQ ID NO: 3319 - RNA, 546 nt, Artificial Sequence
  derived and/or modified sequence opt1 from RGS5__Homo_sapiens__AAB84001
augugcaagggccuggccgcccucccccacagcugccuggagcgcgcgaaggagaucaagaucaagcuggggauccuccugcagaagccggacuccgugggcgaccuggucauccccuacaacgagaagcccgagaagcccgccaagacccagaagaccagccucgacgaggcccugcaguggcgggacucccuggacaagcuccugcagaacaacuacgggcuggccagcuucaaguccuuccucaagagcgaguucuccgaggagaaccuggaguucuggaucgccugcgaggacuacaagaagaucaagagcccggcgaagauggccgagaaggccaagcagaucuacgaggaguucauccagacggaggcccccaaggaggugaacaucgaccacuucaccaaggacaucaccaugaagaaccugguggagcccucccucagcuccuucgacauggcgcagaagcgcauccacgcccugauggagaaggacagccugccccgguucguccgcuccgaguucuaccaggagcucaucaaguga

SEQ ID NO: 3320 - RNA, 546 nt, Artificial Sequence
  derived and/or modified sequence opt2 from RGS5__Homo_sapiens__AAB84001
augugcaagggccucgccgcccucccccacuccugccucgagcgcgccaaggagaucaagaucaagcucggcauccuccuccagaagcccgacuccgucggcgaccucgucauccccuacaacgagaagcccgagaagcccgccaagacccagaagaccucccucgacgaggcccuccaguggcgcgacucccucgacaagcuccuccagaacaacuacggccucgccuccuucaaguccuuccucaaguccgaguucuccgaggagaaccucgaguucuggaucgccugcgaggacuacaagaagaucaagucccccgccaagauggccgagaaggccaagcagaucuacgaggaguucauccagaccgaggcccccaaggaggucaacaucgaccacuucaccaaggacaucaccaugaagaaccucgucgagcccucccucuccuccuucgacauggcccagaagcgcauccacgcccucauggagaaggacucccucccccgcuucguccgcuccgaguucuaccaggagcucaucaaguga

SEQ ID NO: 3321 - RNA, 546 nt, Artificial Sequence
  derived and/or modified sequence opt3 from RGS5__Homo_sapiens__AAB84001
augugcaagggccuggccgcucucccccacagcugucuugagagagcaaaagaaaucaagauuaaacuggggauauuguuacagaagccugacuccgugggagaucuggucaucccauacaacgagaaaccggaaaagcccgccaagacccagaaaacaucucuagacgaggcgcuccaauggagggauucacuggacaaacuucugcagaauaacuaugguuuggcuaguuucaagagcuuucucaaguccgaguucucugaagagaaucuggaauuuuggauugccugcgaggauuacaaaaagaucaagucgccugcaaaaauggccgaaaaggcuaaacagauuuaugaggaguucauccaaacugaagcaccaaaggagguuaacauagaccauuuuacgaaagauaucaccaugaagaaucugguggaacccucacucagcaguuucgacauggcccagaaacggauucacgcuuuaauggagaaggauucccugccucgcuuuguacgaucugaguucuaccaggaacuuaucaaguga

SEQ ID NO: 3322 - RNA, 546 nt, Artificial Sequence
  derived and/or modified sequence opt4 from RGS5__Homo_sapiens__AAB84001
augugcaagggccuggccgcccugccccacagcugccuggagagagccaaggagaucaagaucaagcugggcauccugcugcagaagcccgacagcgugggcgaccuggugauccccuacaacgagaagcccgagaagcccgccaagacccagaagaccagccuggacgaggcccugcaguggagagacagccuggacaagcugcugcagaacaacuacggccuggccagcuucaagagcuuccugaagagcgaguucagcgaggagaaccuggaguucuggaucgccugcgaggacuacaagaagaucaagagccccgccaagauggccgagaaggccaagcagaucuacgaggaguucauccagaccgaggcccccaaggaggugaacaucgaccacuucaccaaggacaucaccaugaagaaccugguggagcccagccugagcagcuucgacauggcccagaagagaauccacgcccugauggagaaggacagccugcccagauucgugagaagcgaguucuaccaggagcugaucaaguga

SEQ ID NO: 3323 - RNA, 546 nt, Artificial Sequence
  derived and/or modified sequence opt5 from RGS5__Homo_sapiens__AAB84001
augugcaagggccuggccgcucucccccacagcugucuggagagagccaaagaaaucaagauuaaacuugggauccugcuccagaagccugacuccgugggagaucuggucauuccguacaacgagaaacccgaaaagccugcgaagacccaaaagacaucucuugacgaggcucugcaguggcgggauagccucgacaagcugcugcagaauaacuauggccucgccuccuucaaaucuuuucugaaaagcgaguucuccgaagagaaucuugaauuuuggaucgccugcgaggauuacaaaaagauuaagucucccgcuaaaauggccgaaaaggcuaaacagaucuaugaggaguucauccaaacggaagccccuaaggagguuaacauugaccauuuuaccaaagauaucacaaugaagaaucugguggaacccagccucuccagcuucgacauggcgcagaaacgcauucacgcccugauggagaaggauucucuuccuagauuugugcgguccgaguucuaccaggaacugaucaaguga

SEQ ID NO: 3324 - protein, 724 aa, Artificial Sequence
  RHAMM/CD168__Homo_sapiens__O75330
MSFPKAPLKRFNDPSGCAPSPGAYDVKTLEVLKGPVSFQKSQRFKQQKESKQNLNVDKDTTLPASARKVKSSESKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 3325 - RNA, 2175 nt, Artificial Sequence
  RHAMM/CD168__Homo_sapiens__CCDS4362.1
auguccuuuccuaaggcgcccuugaaacgauucaaugacccuucugguugugcaccaucuccaggugcuuaugauguuaaaacuuuagaaguauugaaaggaccaguauccuuucagaaaucacaaagauuuaaacaacaaaaagaaucuaaacaaaaucuuaauguugacaaagauacuaccuugccugcuucagcuagaaaaguuaagucuucggaaucaaaggaaucucaaaagaaugauaaagauuugaagauauuagagaaagagauucguguucuucuacaggaacguggugcccaggacaggcggauccaggaucuggaaacugaguuggaaaagauggaagcaaggcuaaaugcugcacuaagggaaaaaacaucucucucugcaaauaaugcuacacuggaaaaacaacuuauugaauugaccaggacuaaugaacuacuaaaaucuaaguuuucugaaaaugguaaccagaagaauuugagaauucuaagcuuggaguugaugaaacuuagaaacaaaagagaaacaaagaugagggguaugauggcuaagcaagaaggcauggagaugaagcugcaggucacccaaaggagucucgaagagucucaagggaaaauagcccaacuggagggaaaacuuguuucaauagagaaagaaaagauugaugaaaaaucugaaacagaaaaacucuuggaauacaucgaagaaauuaguugugcuucagaucaaguggaaaaauacaagcuagauauugcccaguuagaagaaaauuugaaagagaagaaugaugaaauuuuaagccuuaagcagucucuugaggagaauauuguuauauuaucuaaacaaguagaagaucuaaaugugaaaugucagcugcuugaaaaagaaaaagaagaccaugucaacaggaauagagaacacaacgaaaaucuaaaugcagagaugcaaaacuuaaaacagaaguuuauucuugaacaacaggaacgugaaaagcuucaacaaaaagaauuacaaauugauucacuucugcaacaagagaaagaauuaucuucgagucuucaucagaagcucuguucuuuucaagaggaaaugguuaaagagaagaaucuguuugaggaagaauuaaagcaaacacuggaugagcuugauaaauuacagcaaaaggaggaacaagcugaaaggcuggucaagcaauuggaagaggaagcaaaaucuagagcugaagaauuaaaacuccuagaagaaaagcugaaagggaaggaggcugaacuggagaaaaguagugcugcucauacccaggccacccugcuuuugcaggaaaaguaugacaguauggugcaaagccuugaagauguuacugcucaauuugaaagcuauaaagcguuaacagccagugagauagaagaucuuaagcuggagaacucaucauuacaggaaaaagcggccaaggcugggaaaaaugcagaggauguucagcaucagauuuuggcaacugagagcucaaaucaagaauauguaaggaugcuucuagaucugcagaccaagucagcacuaaaggaaacagaaauuaaagaaaucacaguuucuuuucuucaaaaaauaacugauuugcagaaccaacucaagcaacaggaggaagacuuuagaaaacagcuggaagaugaagaaggaagaaaagcugaaaaagaaaauacaacagcagaauuaacugaagaaauuaacaaguggcgucuccucuaugaagaacuauauaauaaaacaaaaccuuuucagcuacaacuagaugcuuuugaaguagaaaaacaggcauuguugaaugaacauggugcagcucaggaacagcuaaauaaaauaagagauucauaugcuaaauuauugggucaucagaauuugaaacaaaaaaucaagcauguugugaaguugaaagaugaaaauagccaacucaaaucggaaguaucaaaacuccgcugucagcuugcuaaaaaaaaacaaagugagacaaaacuucaagaggaauugaauaaaguucuagguaucaaacacuuugauccuucaaaggcuuuucaucaugaaaguaaagaaaauuuugcccugaagaccccauuaaaagaaggcaauacaaacuguuaccgagcuccuauggagugucaagaaucauggaaguaa

SEQ ID NO: 3326 - RNA, 2175 nt, Artificial Sequence
  derived and/or modified sequence opt1 from RHAMM/CD168__Homo_sapiens__CCDS4362.1
augagcuuccccaaggccccgcugaagcgcuucaacgaccccuccggcugcgcccccagccccggggcguacgacgugaagacccucgagguccugaagggcccgguguccuuccagaagucccagcgguucaagcagcagaaggagagcaagcagaaccugaacguggacaaggacaccacgcuccccgccagcgcccgcaaggucaaguccagcgaguccaaggagagccagaagaacgacaaggaccugaagauccuggagaaggagauccgggugcuccugcaggagcgcggggcccaggaccggcgcauccaggaccuggagaccgagcucgagaagauggaggcccggcugaacgcggcccugcgcgagaagaccucccucagcgccaacaacgccacccuggagaagcagcugaucgagcucacgcggaccaacgagcugcugaaguccaaguucagcgagaacggcaaccagaagaaccuccgcauccugucccuggagcucaugaagcugcggaacaagcgcgagaccaagaugcgggggaugauggcgaagcaggagggcauggagaugaagcuccaggugacccagcgcagccuggaggagucccagggcaagaucgcccagcuggaggggaagcuggucagcaucgagaaggagaagaucgacgagaaguccgagacggagaagcuccuggaguacaucgaggagaucagcugcgccagcgaccagguggagaaguacaagcuggacaucgcccagcucgaggagaaccugaaggagaagaacgacgagauccugucccucaagcagagccuggaggagaacaucgugauccuguccaagcaggucgaggaccucaacgugaagugccagcugcuggagaaggagaaggaggaccacgugaaccggaaccgcgagcacaacgagaaccucaacgccgagaugcagaaccugaagcagaaguucauccuggagcagcaggagcgggagaagcuccagcagaaggagcugcagaucgacagccugcuccagcaggagaaggagcuguccagcucccugcaccagaagcucugcagcuuccaggaggagauggucaaggagaagaaccuguucgaggaggagcugaagcagacccuggacgagcucgacaagcugcagcagaaggaggagcaggcggagcgccuggugaagcagcucgaggaggaggccaagucccgggccgaggagcugaagcugcucgaggagaagcugaagggcaaggaggccgagcuggagaaguccagcgccgcgcacacccaggccacccuccugcugcaggagaaguacgacagcauggugcagucccucgaggacgucacggcccaguucgagagcuacaaggcccugaccgccuccgagaucgaggaccugaagcucgagaacagcucccugcaggagaaggcggccaaggccgggaagaacgccgaggacgugcagcaccagauccuggccaccgagagcuccaaccaggaguacgugcgcaugcuccuggaccugcagaccaagagcgcgcucaaggagacggagaucaaggagaucaccgucagcuuccugcagaagaucaccgaccugcagaaccagcucaagcagcaggaggaggacuuccggaagcagcuggaggacgaggagggccgcaaggccgagaaggagaacaccacggccgagcugaccgaggagaucaacaaguggcgccuccuguacgaggagcuguacaacaagaccaagcccuuccagcuccagcuggacgccuucgagguggagaagcaggcgcugcucaacgagcacggggccgcccaggagcagcugaacaagauccgggacuccuacgccaagcugcucggccaccagaaccugaagcagaagaucaagcacguggucaagcugaaggacgagaacagccagcucaaguccgaggugagcaagcugcgcugccagcuggccaagaagaagcaguccgagaccaagcuccaggaggagcugaacaaggugcugggcaucaagcacuucgaccccagcaaggcguuccaccacgaguccaaggagaacuucgcccucaagacgccgcugaaggaggggaacaccaacugcuaccgggcccccauggagugccaggagagcuggaaguga

SEQ ID NO: 3327 - RNA, 2175 nt, Artificial Sequence
  derived and/or modified sequence opt2 from RHAMM/CD168__Homo_sapiens__CCDS4362.1
auguccuuccccaaggccccccucaagcgcuucaacgaccccuccggcugcgcccccucccccggcgccuacgacgucaagacccucgagguccucaagggccccgucuccuuccagaagucccagcgcuucaagcagcagaaggaguccaagcagaaccucaacgucgacaaggacaccacccuccccgccuccgcccgcaaggucaaguccuccgaguccaaggagucccagaagaacgacaaggaccucaagauccucgagaaggagauccgcguccuccuccaggagcgcggcgcccaggaccgccgcauccaggaccucgagaccgagcucgagaagauggaggcccgccucaacgccgcccuccgcgagaagaccucccucuccgccaacaacgccacccucgagaagcagcucaucgagcucacccgcaccaacgagcuccucaaguccaaguucuccgagaacggcaaccagaagaaccuccgcauccucucccucgagcucaugaagcuccgcaacaagcgcgagaccaagaugcgcggcaugauggccaagcaggagggcauggagaugaagcuccaggucacccagcgcucccucgaggagucccagggcaagaucgcccagcucgagggcaagcucgucuccaucgagaaggagaagaucgacgagaaguccgagaccgagaagcuccucgaguacaucgaggagaucuccugcgccuccgaccaggucgagaaguacaagcucgacaucgcccagcucgaggagaaccucaaggagaagaacgacgagauccucucccucaagcagucccucgaggagaacaucgucauccucuccaagcaggucgaggaccucaacgucaagugccagcuccucgagaaggagaaggaggaccacgucaaccgcaaccgcgagcacaacgagaaccucaacgccgagaugcagaaccucaagcagaaguucauccucgagcagcaggagcgcgagaagcuccagcagaaggagcuccagaucgacucccuccuccagcaggagaaggagcucuccuccucccuccaccagaagcucugcuccuuccaggaggagauggucaaggagaagaaccucuucgaggaggagcucaagcagacccucgacgagcucgacaagcuccagcagaaggaggagcaggccgagcgccucgucaagcagcucgaggaggaggccaagucccgcgccgaggagcucaagcuccucgaggagaagcucaagggcaaggaggccgagcucgagaaguccuccgccgcccacacccaggccacccuccuccuccaggagaaguacgacuccaugguccagucccucgaggacgucaccgcccaguucgaguccuacaaggcccucaccgccuccgagaucgaggaccucaagcucgagaacuccucccuccaggagaaggccgccaaggccggcaagaacgccgaggacguccagcaccagauccucgccaccgaguccuccaaccaggaguacguccgcaugcuccucgaccuccagaccaaguccgcccucaaggagaccgagaucaaggagaucaccgucuccuuccuccagaagaucaccgaccuccagaaccagcucaagcagcaggaggaggacuuccgcaagcagcucgaggacgaggagggccgcaaggccgagaaggagaacaccaccgccgagcucaccgaggagaucaacaaguggcgccuccucuacgaggagcucuacaacaagaccaagcccuuccagcuccagcucgacgccuucgaggucgagaagcaggcccuccucaacgagcacggcgccgcccaggagcagcucaacaagauccgcgacuccuacgccaagcuccucggccaccagaaccucaagcagaagaucaagcacgucgucaagcucaaggacgagaacucccagcucaaguccgaggucuccaagcuccgcugccagcucgccaagaagaagcaguccgagaccaagcuccaggaggagcucaacaagguccucggcaucaagcacuucgaccccuccaaggccuuccaccacgaguccaaggagaacuucgcccucaagaccccccucaaggagggcaacaccaacugcuaccgcgcccccauggagugccaggaguccuggaaguga

SEQ ID NO: 3328 - RNA, 2175 nt, Artificial Sequence
  derived and/or modified sequence opt3 from RHAMM/CD168__Homo_sapiens__CCDS4362.1
augagcuuccccaaggccccucugaaaagauuuaacgacccauccggcugcgcuccgucucccggggcauacgaugugaagacccucgagguccuuaaaggaccuguuucauuccagaagagucaaagguuuaaacagcagaaggaaagcaagcagaaucugaacguggacaaagauacaacuuugccagccuccgcgcggaagguaaaaucuucggagucaaaggaaagccaaaagaaugacaaggauuuaaagauccuggagaaagaaauucgcgugcuacuccaggagcgaggugcucaggaccguagaauacaggaucuggagacggaacuugagaagauggaagccaggcugaacgcagccuugcgggagaaaaccagucucuccgcuaauaacgcaacacuggagaagcaacugaucgaacucacucgcaccaaugaguuacugaaaucuaaguucagcgaaaacggcaaucagaaaaaccuuagaauuuugucccuggagcuaaugaagcucaggaauaagcgggaaacaaaaaugcgcgggaugauggccaagcaggagggaauggagaugaaacugcaggucacccaacgaucacuugaagagagucagggcaagaucgcucagcuggaagguaaauuggugagcauugagaaggaaaagaucgacgagaaaucugagacugaaaagcuccuggaguauauagaagagaucuccugugccucagaucaaguugaaaaauacaaguuagacauugcgcagcuggaggagaaccucaaagaaaagaaugaugagauccuuagccugaagcagaguuuggaagagaacauugugauccuaucuaaacaggucgaggaccugaaugugaagugccaacuccuggaaaaagagaaggaagaucacguaaacagaaacagggagcauaaugaaaaccuuaaugcagagaugcagaaccugaaacagaaguuuauauuggagcagcaagaacgggagaagcuccagcagaaagaacugcagauugacuccuuacugcaacaggagaaggaacuaagcucgucucuccaccagaaacuguguuccuuccaggaggagaugguuaaggagaaaaaucuuuuugaagaagaguugaagcaaacacuggacgaacucgauaaacugcagcagaaggaggagcaagccgaacgucuugugaagcagcuggaggaagaggcuaaaucacgcgccgaggaauugaagcuccuggaggaaaaauuaaaggggaaagaggcagaacuggagaagaguagcgcugcccauacccaggcgacgcuacuccugcaggagaaguaugacuccaugguccaaucucuugaagaugugacugcccaguucgagagcuacaaagcauugaccgcuucagaaaucgaggaccugaagcucgaaaacaguucccugcaggagaaagccgcuaaggccggcaaaaaugcagaggaugugcagcaccaaauuuuagccacagaaagcucuaaccaggaguaugucagaaugcugcuugacuugcagacuaagucagcucucaaggaaaccgagaucaaagaaaucacaguuaguuuucugcagaagauuaccgaucuacaaaaucagcugaaacagcaagaggaggacuucaggaagcagcucgaagaugaggaaggacggaaagcggagaaggagaacacgacugcagaacugacagaggaaauaaauaaguggcgacuuuuguacgaggaacuguauaacaaaaccaagcccuuucaguuacagcucgacgccuucgagguggagaaacaagcucugcuuaaugaacauggcgccgcacaggagcagcugaacaagauccgcgauagcuacgccaaauugcucgggcaccagaaucugaagcagaaaauuaagcacguagugaagcuaaaagacgaaaacucccaacugaagucugaggucucgaaacucagaugccagcuggcuaagaaaaagcagagcgaaacuaaacuucaagaggaguugaacaaagugcugggaaucaagcauuuugacccuuccaaagccuuccaccaugaaucaaaggagaauuucgcauuaaaaacaccacucaaggaagguaacaccaauuguuacagggcgcccauggagugccaggaaaguuggaaguga

SEQ ID NO: 3329 - RNA, 2175 nt, Artificial Sequence
  derived and/or modified sequence opt4 from RHAMM/CD168__Homo_sapiens__CCDS4362.1
augagcuuccccaaggccccccugaagagauucaacgaccccagcggcugcgcccccagccccggcgccuacgacgugaagacccuggaggugcugaagggccccgugagcuuccagaagagccagagauucaagcagcagaaggagagcaagcagaaccugaacguggacaaggacaccacccugcccgccagcgccagaaaggugaagagcagcgagagcaaggagagccagaagaacgacaaggaccugaagauccuggagaaggagaucagagugcugcugcaggagagaggcgcccaggacagaagaauccaggaccuggagaccgagcuggagaagauggaggccagacugaacgccgcccugagagagaagaccagccugagcgccaacaacgccacccuggagaagcagcugaucgagcugaccagaaccaacgagcugcugaagagcaaguucagcgagaacggcaaccagaagaaccugagaauccugagccuggagcugaugaagcugagaaacaagagagagaccaagaugagaggcaugauggccaagcaggagggcauggagaugaagcugcaggugacccagagaagccuggaggagagccagggcaagaucgcccagcuggagggcaagcuggugagcaucgagaaggagaagaucgacgagaagagcgagaccgagaagcugcuggaguacaucgaggagaucagcugcgccagcgaccagguggagaaguacaagcuggacaucgcccagcuggaggagaaccugaaggagaagaacgacgagauccugagccugaagcagagccuggaggagaacaucgugauccugagcaagcagguggaggaccugaacgugaagugccagcugcuggagaaggagaaggaggaccacgugaacagaaacagagagcacaacgagaaccugaacgccgagaugcagaaccugaagcagaaguucauccuggagcagcaggagagagagaagcugcagcagaaggagcugcagaucgacagccugcugcagcaggagaaggagcugagcagcagccugcaccagaagcugugcagcuuccaggaggagauggugaaggagaagaaccuguucgaggaggagcugaagcagacccuggacgagcuggacaagcugcagcagaaggaggagcaggccgagagacuggugaagcagcuggaggaggaggccaagagcagagccgaggagcugaagcugcuggaggagaagcugaagggcaaggaggccgagcuggagaagagcagcgccgcccacacccaggccacccugcugcugcaggagaaguacgacagcauggugcagagccuggaggacgugaccgcccaguucgagagcuacaaggcccugaccgccagcgagaucgaggaccugaagcuggagaacagcagccugcaggagaaggccgccaaggccggcaagaacgccgaggacgugcagcaccagauccuggccaccgagagcagcaaccaggaguacgugagaaugcugcuggaccugcagaccaagagcgcccugaaggagaccgagaucaaggagaucaccgugagcuuccugcagaagaucaccgaccugcagaaccagcugaagcagcaggaggaggacuucagaaagcagcuggaggacgaggagggcagaaaggccgagaaggagaacaccaccgccgagcugaccgaggagaucaacaaguggagacugcuguacgaggagcuguacaacaagaccaagcccuuccagcugcagcuggacgccuucgagguggagaagcaggcccugcugaacgagcacggcgccgcccaggagcagcugaacaagaucagagacagcuacgccaagcugcugggccaccagaaccugaagcagaagaucaagcacguggugaagcugaaggacgagaacagccagcugaagagcgaggugagcaagcugagaugccagcuggccaagaagaagcagagcgagaccaagcugcaggaggagcugaacaaggugcugggcaucaagcacuucgaccccagcaaggccuuccaccacgagagcaaggagaacuucgcccugaagaccccccugaaggagggcaacaccaacugcuacagagcccccauggagugccaggagagcuggaaguga

SEQ ID NO: 3330 - RNA, 2175 nt, Artificial Sequence
  derived and/or modified sequence opt5 from RHAMM/CD168__Homo_sapiens__CCDS4362.1
augagcuuccccaaggccccucugaaaagauuuaacgacccguccggcugcgcucccucuccuggggccuacgaugugaagacccucgagguccugaaaggacccguuagcuuccagaagucccaacgguuuaaacagcagaaggaaucuaagcagaaucuuaacguggacaaagauacaacgcugccugcgagcgcucgcaaggugaaauccucugagagcaaggaaucccaaaagaaugacaaggaucucaagauccuggagaaagaaauuagaguccuucugcaggagcggggcgcccaggaccgcagaauccaggaucucgagaccgaacuggagaagauggaagcccggcugaacgcugcccuccgcgagaaaacaagccugucugcuaauaacgccacccuugagaagcaacugauugaacucacaagaaccaaugagcugcuuaaauccaaguucagcgaaaacgggaaucagaaaaaccugcggauccucucucuggagcugaugaagcuccgcaauaagagagaaacaaaaaugcggggaaugauggcgaagcaggagggcauggagaugaaacuucaggugacccaacgcucccuggaagagagccaggggaagauugcccagcuggaaggaaaacucguuucuaucgagaaggaaaagaucgacgagaaauccgagacggaaaagcugcuugaguauauugaagagaucagcugugcuuccgaucaaguggaaaaauacaagcuggacauugcccagcucgaggagaaccugaaagaaaagaaugaugagauccugucucucaagcagagccuggaagagaacauugucauccuuuccaaacagguggaggaccugaauguuaagugccaacuccuggaaaaagagaaggaagaucacgugaacagaaaccgggagcauaaugaaaaccuuaaugcugagaugcagaaccugaaacagaaguuuauucucgagcagcaagaacgcgagaagcugcagcagaaagaacugcagaucgacagccuccugcaacaggagaaggaacuuucuuccagccugcaccagaaacucuguucuuuccaggaggagauggucaaggaaaagaaucuguuugaggaggaacugaagcaaacccuugacgaacucgauaaacugcagcagaaggaggagcaagccgaaagacuggugaagcagcucgaggaagaggcgaaaagccgggccgaggaacugaaacuucuggaggaaaaacucaagggcaaagaggcugaacuggagaaguccucugccgcucauacacaggccacccugcuucuccaggagaaguaugacagcauggugcaaucccuggaagaugucacagcccaguucgagagcuacaaagcucugaccgcgucugaaaucgaggaccucaagcuggaaaacuccagccuucaggagaaagccgcuaaggccggcaaaaaugccgaggauguucagcaccaaauucuggcuacggaaucuuccaaccaggaguaugugagaaugcuccuggaccugcagacaaagagcgcccuuaaggaaaccgagaucaaagaaauuacaguguccuuucuccagaagaucaccgaucugcaaaaucagcugaaacagcaagaggaggacuuccgcaagcagcucgaagaugaggaagggcggaaagcggagaaggagaacaccacagcugaacugacggaggaaauuaauaaguggagacuucuguacgaggaacucuauaacaaaaccaagcccuuucagcugcagcuggacgccuucgaggucgagaaacaagcccuucucaaugaacauggagcugcccaggagcagcugaacaagauccgcgauucuuacgcuaaacugcucggccaccagaaucugaagcagaaaaucaagcacgugguuaaacuuaaagacgaaaacagccaacugaaguccgaggugucuaaacuccggugccagcuggccaagaaaaagcagagcgaaacaaagcugcaagaggagcuuaacaaaguccuggggauuaagcauuuugacccuuccaaagcguuccaccaugaaagcaaggagaauuucgcccucaaaaccccgcugaaggaaggaaacacaaauuguuacagagcucccauggagugccaggaaucuuggaaguga

SEQ ID NO: 3331 - protein, 193 aa, Artificial Sequence
  RHOC__Homo_sapiens__P08134
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 3332 - RNA, 582 nt, Artificial Sequence
  RHOC__Homo_sapiens__AAC33179
auggcugcaauccgaaagaagcuggugaucguuggggauggugccugugggaagaccugccuccucaucgucuucagcaaggaucaguuuccggaggucuacgucccuacugucuuugagaacuauauugcggacauugagguggacggcaagcagguggagcuggcucugugggacacagcagggcaggaagacuaugaucgacugcggccucucuccuacccggacacugaugucauccucaugugcuucuccaucgacagcccugacagccuggaaaacauuccugagaaguggaccccagaggugaagcacuucugccccaacgugcccaucauccugguggggaauaagaaggaccugaggcaagacgagcacaccaggagagagcuggccaagaugaagcaggagcccguucggucugaggaaggccgggacauggcgaaccggaucagugccuuuggcuaccuugagugcucagccaagaccaaggagggagugcgggagguguuugagauggccacucgggcuggccuccagguccgcaagaacaagcgucggaggggcugucccauucucuga

SEQ ID NO: 3333 - RNA, 582 nt, Artificial Sequence
  derived and/or modified sequence opt1 from RHOC__Homo_sapiens__AAC33179
auggccgccauccgcaagaagcuggugaucgucggcgacggggcgugcggcaagaccugccuccugaucguguucagcaaggaccaguuccccgagguguacgucccgaccguguucgagaacuacaucgccgacaucgagguggacgggaagcaggucgagcuggcccucugggacacggccggccaggaggacuacgaccggcugcgcccccuguccuaccccgacaccgacgugauccucaugugcuucagcaucgacucccccgacagccuggagaacaucccggagaaguggacccccgaggugaagcacuucugccccaacguccccaucauccugguggggaacaagaaggaccuccggcaggacgagcacacccgccgggagcuggccaagaugaagcaggagccggugcgcuccgaggagggccgggacauggcgaaccgcaucagcgccuucggcuaccuggagugcuccgccaagacgaaggaggggguccgggagguguucgagauggccacccgcgcgggccuccaggugcggaagaacaagcgccggcgcgggugccccauccuguga

SEQ ID NO: 3334 - RNA, 582 nt, Artificial Sequence
  derived and/or modified sequence opt2 from RHOC__Homo_sapiens__AAC33179
auggccgccauccgcaagaagcucgucaucgucggcgacggcgccugcggcaagaccugccuccucaucgucuucuccaaggaccaguuccccgaggucuacguccccaccgucuucgagaacuacaucgccgacaucgaggucgacggcaagcaggucgagcucgcccucugggacaccgccggccaggaggacuacgaccgccuccgcccccucuccuaccccgacaccgacgucauccucaugugcuucuccaucgacucccccgacucccucgagaacauccccgagaaguggacccccgaggucaagcacuucugccccaacguccccaucauccucgucggcaacaagaaggaccuccgccaggacgagcacacccgccgcgagcucgccaagaugaagcaggagcccguccgcuccgaggagggccgcgacauggccaaccgcaucuccgccuucggcuaccucgagugcuccgccaagaccaaggagggcguccgcgaggucuucgagauggccacccgcgccggccuccagguccgcaagaacaagcgccgccgcggcugccccauccucuga

SEQ ID NO: 3335 - RNA, 582 nt, Artificial Sequence
  derived and/or modified sequence opt3 from RHOC__Homo_sapiens__AAC33179
auggccgcuaucagaaagaaacuggugauugucggcgacggggcaugcggaaagaccugucuccuuauaguuuucagcaaagaucaguuucccgagguguacguaccuacaguguucgaaaacuauaucgccgacauugaggucgaugguaagcaaguggaacuggcguugugggacacugcuggccaggaggauuacgacagguuacggccacuguccuauccggauacggacguuauccuaaugugcuuuucuauugauucacccgacagucucgaaaauaucccugagaaauggaccccagaggugaagcacuucugucccaacgucccuauaauccugguggggaauaagaaagaucuucgccaggacgaacauacacgacgugagcuggccaagaugaaacaggaaccaguaagaagcgaggagggaagggauauggcaaaccggauuuccgccuuuggcuacuuggaaugcucugcuaagacuaaagaggguguucgcgaaguguucgagauggcaaccagagccgggcuccaagucaggaagaauaagcggcgccgaggaugucccauccuguga

SEQ ID NO: 3336 - RNA, 582 nt, Artificial Sequence
  derived and/or modified sequence opt4 from RHOC__Homo_sapiens__AAC33179
auggccgccaucagaaagaagcuggugaucgugggcgacggcgccugcggcaagaccugccugcugaucguguucagcaaggaccaguuccccgagguguacgugcccaccguguucgagaacuacaucgccgacaucgagguggacggcaagcagguggagcuggcccugugggacaccgccggccaggaggacuacgacagacugagaccccugagcuaccccgacaccgacgugauccugaugugcuucagcaucgacagccccgacagccuggagaacauccccgagaaguggacccccgaggugaagcacuucugccccaacgugcccaucauccuggugggcaacaagaaggaccugagacaggacgagcacaccagaagagagcuggccaagaugaagcaggagcccgugagaagcgaggagggcagagacauggccaacagaaucagcgccuucggcuaccuggagugcagcgccaagaccaaggagggcgugagagagguguucgagauggccaccagagccggccugcaggugagaaagaacaagagaagaagaggcugccccauccuguga

SEQ ID NO: 3337 - RNA, 582 nt, Artificial Sequence
  derived and/or modified sequence opt5 from RHOC__Homo_sapiens__AAC33179
auggccgcuaucagaaagaaacuggugauugucggcgacggggccugcggaaagaccugucuccugaucguuuucagcaaagaucaguuucccgagguguacgugccuacagucuucgaaaacuauauugcggacaucgagguggauggcaagcaaguugaacuugcucugugggacacggccgggcaggaggauuacgaccggcuccgcccgcuguccuaucccgauaccgacgugauucuuaugugcuuuucuaucgauagcccugacucccuggaaaauauccccgagaaauggacaccugaggucaagcacuucugucccaacgugccuauuauccucguuggaaauaagaaagaucugagacaggacgaacauacccggcgcgagcuggccaagaugaaacaggaaccggugagaucugaggagggccgggauauggcuaaccgcauuagcgccuuuggguaccucgaaugcuccgcuaagacaaaagagggagucagagaaguguucgagauggccacccgggcgggccugcaagugcgcaagaauaagagacggcgcggcugucccauccuuuga

SEQ ID NO: 3338 - protein, 295 aa, Artificial Sequence [sequence omitted]

SEQ ID NO: 3339 - RNA, 888 nt, Artificial Sequence
  RSSA__Homo_sapiens__AAA36161
auguccggagcccuugauguccugcaaaugaaggaggaggauguccuuaaguuccuugcagcaggaacccacuuagguggcaccaaucuugacuuccagauggaacaguacaucuauaaaaggaaaagugauggcaucuauaucauaaaucucaagaggaccugggagaagcuucugcuggcagcucgugcaauuguugccauugaaaacccugcugaugucaguguuauauccuccaggaauacuggccagagggcugugcugaaguuugcugcugccacuggagccacuccaauugcuggccgcuucacuccuggaaccuucacuaaccagauccaggcagccuuccgggagccacggcuucuugugguuacugaccccagggcugaccaccagccucucacggaggcaucuuauguuaaccuaccuaccauugcgcuguguaacacagauucuccucugcgcuauguggacauugccaucccaugcaacaacaagggagcucacucaguggguuugaugugguggaugcuggcucgggaaguucugcgcaugcguggcaccauuucccgugaacacccaugggaggucaugccugaucuguacuucuacagagauccugaagagauugaaaaagaagagcaggcugcugcugagaaggcagugaccaaggaggaauuucagggugaauggacugcucccgcuccugaguucacugcuacucagccugagguugcagacuggucugaagguguacaggugcccucugugccuauucagcaauucccuacugaagacuggagcgcucagccugccacggaagacuggucugcagcucccacugcucaggccacugaauggguaggagcaaccacugacuggucuuaa

SEQ ID NO: 3340 - RNA, 888 nt, Artificial Sequence
  derived and/or modified sequence opt1 from RSSA__Homo_sapiens__AAA36161
augagcggcgcccuggacgugcuccagaugaaggaggaggacguccugaaguuccuggccgcggggacccaccucggcgggaccaaccuggacuuccagauggagcaguacaucuacaagcgcaaguccgacggcaucuacaucaucaaccugaagcggacgugggagaagcuccugcuggccgcccgcgccaucguggccaucgagaaccccgcggacgugagcgucaucuccagccggaacaccgggcagcgcgccgugcucaaguucgccgccgcgaccggcgccaccccgaucgccggccgguucacgcccgggaccuucaccaaccagauccaggccgccuuccgcgagccccggcugcugguggucaccgacccccgcgcggaccaccagccgcucacggaggccuccuacgugaaccugcccaccaucgcccugugcaacaccgacagcccccuccgguacguggacaucgccauccccugcaacaacaagggcgcccacuccgucgggcugaugugguggaugcuggcgcgcgaggugcuccggaugcgcggcaccaucagccgggagcacccgugggaggugaugcccgaccuguacuucuaccgcgaccccgaggagaucgagaaggaggagcaggccgccgccgagaaggccgucacgaaggaggaguuccagggggaguggaccgcgcccgccccggaguucaccgccacccagcccgagguggccgacugguccgagggcgugcagguccccagcgugcccauccagcaguucccgacggaggacugguccgcccagcccgcgaccgaggacuggagcgccgcccccaccgcccaggcgaccgagugggugggcgccacgaccgacugguccuga

SEQ ID NO: 3341 - RNA, 888 nt, Artificial Sequence
  derived and/or modified sequence opt2 from RSSA__Homo_sapiens__AAA36161
auguccggcgcccucgacguccuccagaugaaggaggaggacguccucaaguuccucgccgccggcacccaccucggcggcaccaaccucgacuuccagauggagcaguacaucuacaagcgcaaguccgacggcaucuacaucaucaaccucaagcgcaccugggagaagcuccuccucgccgcccgcgccaucgucgccaucgagaaccccgccgacgucuccgucaucuccucccgcaacaccggccagcgcgccguccucaaguucgccgccgccaccggcgccacccccaucgccggccgcuucacccccggcaccuucaccaaccagauccaggccgccuuccgcgagccccgccuccucgucgucaccgacccccgcgccgaccaccagccccucaccgaggccuccuacgucaaccuccccaccaucgcccucugcaacaccgacuccccccuccgcuacgucgacaucgccauccccugcaacaacaagggcgcccacuccgucggccucaugugguggaugcucgcccgcgagguccuccgcaugcgcggcaccaucucccgcgagcaccccugggaggucaugcccgaccucuacuucuaccgcgaccccgaggagaucgagaaggaggagcaggccgccgccgagaaggccgucaccaaggaggaguuccagggcgaguggaccgcccccgcccccgaguucaccgccacccagcccgaggucgccgacugguccgagggcguccagguccccuccguccccauccagcaguuccccaccgaggacugguccgcccagcccgccaccgaggacugguccgccgcccccaccgcccaggccaccgagugggucggcgccaccaccgacugguccuga

SEQ ID NO: 3342 - RNA, 888 nt, Artificial Sequence
  derived and/or modified sequence opt3 from RSSA__Homo_sapiens__AAA36161
augagcggcgcccuggacgugcuccagaugaaggaggaagauguccuuaaauuccuggcugcagggacccacuugggagguacaaacuuagacuuucaaauggagcaguacaucuauaagagaaaauccgauggcauuuacauaaucaaucugaagaggacuugggaaaaacuacuccuggccgcgcgggcuauuguugccaucgagaaccccgcagacgugucuguaauuucaagucgcaauacggggcagcgagccgugcuuaaguucgcugcagccaccggagcuacaccuaucgccggccguuuuacuccagguaccuucacaaaccagauacaagcggcauuuagagaaccgaggcuguuggucgugaccgauccccgggccgaccaucagccucucacugaggcuagcuauguuaaucugccaacaaucgcccugugcaacaccgauucuccccuccgcuacguggacauugcaaucccuuguaauaacaagggggcucacuccgucggauuaaugugguggaugcuggccagagaggugcuuaggaugcggggcacgauuucgcgcgaacauccaugggagguaaugcccgauuuguauuucuaccgagacccugaagagaucgagaaagaggaacaggcggccgcagaaaaggcuguuacuaaagaggaauuucagggcgaguggaccgccccagcuccggaguucacagccacucaacccgaaguggcagauuggucagaggggguccaggugccuagcgugccaauacagcaguuucccaccgaagacuggagugcccaaccugcuacagaggauugguccgcggcaccaaccgcccaggcuacggaaugggucggagccacuacagacuggucuuga

SEQ ID NO: 3343 - RNA, 888 nt, Artificial Sequence
  derived and/or modified sequence opt4 from RSSA__Homo_sapiens__AAA36161
augagcggcgcccuggacgugcugcagaugaaggaggaggacgugcugaaguuccuggccgccggcacccaccugggcggcaccaaccuggacuuccagauggagcaguacaucuacaagagaaagagcgacggcaucuacaucaucaaccugaagagaaccugggagaagcugcugcuggccgccagagccaucguggccaucgagaaccccgccgacgugagcgugaucagcagcagaaacaccggccagagagccgugcugaaguucgccgccgccaccggcgccacccccaucgccggcagauucacccccggcaccuucaccaaccagauccaggccgccuucagagagcccagacugcugguggugaccgaccccagagccgaccaccagccccugaccgaggccagcuacgugaaccugcccaccaucgcccugugcaacaccgacagcccccugagauacguggacaucgccauccccugcaacaacaagggcgcccacagcgugggccugaugugguggaugcuggccagagaggugcugagaaugagaggcaccaucagcagagagcaccccugggaggugaugcccgaccuguacuucuacagagaccccgaggagaucgagaaggaggagcaggccgccgccgagaaggccgugaccaaggaggaguuccagggcgaguggaccgcccccgcccccgaguucaccgccacccagcccgagguggccgacuggagcgagggcgugcaggugcccagcgugcccauccagcaguuccccaccgaggacuggagcgcccagcccgccaccgaggacuggagcgccgcccccaccgcccaggccaccgagugggugggcgccaccaccgacuggagcuga

SEQ ID NO: 3344 - RNA, 888 nt, Artificial Sequence
  derived and/or modified sequence opt5 from RSSA__Homo_sapiens__AAA36161
augagcggcgcccuggacgugcuccagaugaaggaggaagauguccugaaauuccuugcugccgggacccaccugggaggcacaaaccucgacuuucaaauggagcaguacaucuauaagagaaaauccgaugggauuuacaucauuaaucugaagcggacgugggaaaaacuucugcucgcggcucgcgccaucguugccauugagaaccccgcugacgugucugugaucagcuccagaaauaccggacagcgggccguccugaaguucgcugccgcgacaggcgccaccccuaucgcugggcgcuuuacaccgggaaccuucacaaaccagauucaagccgcuuuuagagaaccccggcugcucgugguuaccgauccucgcgccgaccaucagccccugacggaggcgucuuaugugaaucuuccuaccaucgcccugugcaacacagauagcccccucagauacgucgacauugcuaucccuuguaauaacaagggcgcccacuccgugggccugaugugguggaugcuugcucgggagguucugcgcaugagagggaccauuucucgggaacauccgugggaggugaugcccgaucucuauuucuaccgcgacccugaagagaucgagaaagaggaacaggccgccgcugaaaaggcggucacaaaagaggaauuucagggagaguggaccgcccccgcuccugaguucacggccacacaacccgaaguggccgauuggagcgagggcgugcaggucccguccguuccuauucagcaguuucccaccgaagacuggagcgcucaaccugccacagaggauuggucugcggcucccaccgcccaggccaccgaaugggugggggcuacaacggacugguccuga

SEQ ID NO: 3345 - protein, 866 aa, Artificial Sequence
  RU1__Homo_sapiens__Q9UHJ3
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPEGIRDKVSDWDEFLRQTLIGACSPPVPLLEGLRNGRNPLDLIAPGSRLECQAFQDSLSTWIVTVVENIGGRLKLRYEGLESSDNYEHWLYYLDPFLHHVGWAAQQGYELQPPSAIRHLKNEAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKEIRIEVAERLHLDSNPLKWSVADVVRFIRSTDCAPLARIFLDQEIDGQALLLLTLPTVQECMDLKLGPAIKLCHHIERIKFAFYEQFAN

SEQ ID NO: 3346 - RNA, 2601 nt, Artificial Sequence
  RU1__Homo_sapiens__AAH14614
augaacggggagcagcagcuugaugcagaugccggcucugguauggaagagguagaauuaagcugggaagauuaucuagaagaaacaggguccacagcaguucccuaugggucuuuuaaacauguggacacacgucugcaaaauggauuugcuccugggaugaagcuggagguggcugugagaacagauccugagaccuacuggguugccaccguuaucacuaccugugagcaguugcuccuucuccgcuaugauggcuauggggaggaucggagagcagauuucuggugugacaucaggaaggcugaucucuaccccauuggguggugugagcagaauaagaagacccuugaagccccagaaggcaucagagauaaaguaucugacugggaugaguuucugcggcagacccugauaggagcauguaguccuccuguuccgcugcuagagggccuccguaaugggaggaauccuuuagaucucauugcuccaggauccagacuagaaugucaagcuuuccaggacucuuuaagcacuuggauuguuacuguaguagaaaacauuggaggaaggcugaagcuacguuaugaaggacuugaaaguucugacaauuaugaacauugguuguauuacuuggauccauuucuucaucacguugguugggcugcucaacagggauaugagcuucagcccccuucagccauuagacaucuaaaaaaugaagcugaguggcaagagauuuuggccaaagugaaagaggaagaggaagagccauuaccaucuuacuuauuuaaggacaaacaaguuauuggcauucauacauucucuguaaacaugaaauuggaagcuguagaccccuggucuccuuuugggaucucuccugcuacaguuguuaagguuuuugaugagaaguacuuucugguggaaauggaugacuugcguccugagaaccacgcacggcgauccuuugugugccacgccgacaguccuggcaucuucccugugcaguggagucugaagaauggccuacacaucagccccccuccaggcuacccaagccaggacuuugacugggcugacuaccucaaacaguguggugcugaagcugcuccccagaggugcuucccuccguuaauuucugaacaugaauuuaaggagaacaugaagcucgaggcggugaaccccauucucccugaagaaguguguguugcuaccaucacugcagugagaggcuccuaccuguggcuccagcuggaggguucuaagaagccuauaccugaauguauugugaguguggaauccauggauauauuuccuuugggcuggugugaaaccaacggccacccccucagcacuccucgccgagcacgaguauauaaacagaggaaaauugcagugguucagccagaaaaacaaguaccauccucgaggacuguccacgagggccugaggaaucaggagcugaacuccacagagucaguuaugauuaauggaaaauauugcuguccaaagauauacuucaaccaccguugcuucucagggccauaucuuaacaaaggaagaauugcugagcugccucaauguguaggaccugggaacuguguucugguccuuagagagguccucacuuuacuuaucaaugcagccuacaaacccagccguguccuucgggagcuccagcuggacaaagacucuguguggcacggauguggggaaguccuaaaagccaaauauaaaggaaagaguuaucgggcuacuguugagauagugaaaacagcagaucgggugacugaauucugccggcaaaccuguaucaaacuggaaugcuguccuaaccucuucgguccacggaugguucuggauaaguguucugagaacuguucuguacuuacaaagaccaaauacacacacuauuacggaaagaagaaaaauaaaagaauugggaggccaccuggugggcauaguaacuuagcuugugcccugaaaaaagccaguaagaggagaaagaggcggaaaaauguuuuuguucauaagaagaaacgcuccucugcaucuguugauaauaccccagcgggcucuccccagggaagugggggugaagaugaggaugacccagaugaaggggaugaugauucccuaagugaaggcaguacauccgagcagcaggaugagcuacaggaagaaucagaaaugucagaaaaaaagucaugcuccucuucucccacccaaagugagauauccacaucgcugccuccagauagacaaaggagaaaaagggagcuucgcaccuuuucauuuucugacgaugaaaauaaaccuccuucaccaaaggaaauaaggaucgaaguugcugaaaggcuucaccuggacaguaaccccuugaaguggaguguggcagacguugugcgguucaucagauccacugacugugcuccauuagcaagaauauuccuagaccaggaaauugaugggcaggcccuguugcuccuuacccuucccacuguucaagaaugcauggacuuaaaauugggcccugccaucaaacuuugccaucacauagagaggaucaaguuugcuuuuuaugagcaguuugccaacuga

SEQ ID NO: 3347 - RNA, 2601 nt, Artificial Sequence
  derived and/or modified sequence opt1 from RU1__Homo_sapiens__AAH14614
augaacggcgagcagcagcuggacgccgacgccgggagcggcauggaggagguggagcucuccugggaggacuaccuggaggagaccgggagcaccgcgguccccuacggcuccuucaagcacguggacacgcgccugcagaacggguucgccccgggcaugaagcucgagguggccguccggaccgaccccgagaccuacuggguggccaccgugaucacgaccugcgagcagcugcugcuccugcgcuacgacggcuacggggaggaccggcgcgccgacuucuggugcgacauccggaaggcggaccuguaccccaucggcuggugcgagcagaacaagaagacccucgaggcccccgaggggauccgcgacaaggucagcgacugggacgaguuccugcggcagacccugaucggcgccugcuccccgcccgugccccuccuggaggggcugcgcaacggccggaacccccucgaccugaucgccccgggcagccgccuggagugccaggcguuccaggacucccucagcacguggaucgugaccgucguggagaacaucgggggccggcugaagcugcgcuacgaggggcucgaguccagcgacaacuacgagcacuggcuguacuaccuggaccccuuccuccaccacgugggcugggccgcccagcagggcuacgagcugcagccgcccuccgccauccggcaccugaagaacgaggccgaguggcaggagauccucgcgaaggucaaggaggaggaggaggagccccugcccagcuaccuguucaaggacaagcaggucaucgggauccacaccuucuccgugaacaugaagcucgaggccguggaccccuggagccccuucggcaucuccccggccaccguggugaaggucuucgacgagaaguacuuccugguggagauggacgaccugcgccccgagaaccacgcccggcgcagcuucgugugccacgccgacucccccgggaucuuccccguccaguggagccucaagaacggccugcacaucuccccgccgcccggguaccccagccaggacuucgacugggcggacuaccugaagcagugcggcgccgaggccgcgccccagcggugcuucccgccccucaucagcgagcacgaguucaaggagaacaugaagcuggaggccgugaaccccauccugcccgaggaggugugcgucgccacgaucaccgccgugcgcggcuccuaccucuggcugcagcuggaggggagcaagaagcccauccccgagugcaucgucuccguggagagcauggacaucuucccgcucggcuggugcgagaccaacgggcacccccuguccacgccccggcgcgcccggguguacaagcagcgcaagaucgccgucgugcagcccgagaagcaggucccgagcucccgcaccgugcacgagggccugcggaaccaggagcucaacagcaccgaguccgugaugaucaacgggaaguacugcugccccaagaucuacuucaaccaccgcugcuucagcggccccuaccugaacaagggccggaucgccgagcugccccagugcguggggccgggcaacugcguccucgugcugcgcgaggugcugacccugcucaucaacgcggccuacaagcccucccggguccugcgcgagcugcagcucgacaaggacagcguguggcacgggugcggcgaggugcugaaggccaaguacaaggggaaguccuaccgggccaccgucgagaucgugaagacggcggaccgcgugaccgaguucugccggcagaccugcaucaagcuggagugcugccccaaccucuucggcccccgcaugguccuggacaagugcagcgagaacugcuccgugcugaccaagacgaaguacacccacuacuacggcaagaagaagaacaagcggaucgggcgcccgcccggcgggcacagcaaccucgccugcgcccugaagaaggccuccaagcggcgcaagcggcgcaagaacguguucguccacaagaagaagcggagcuccgccagcguggacaacacccccgcgggcagcccccagggcuccgggggcgaggacgaggacgacccggacgagggggacgacgacagccuguccgagggcagcaccuccgagcagcaggacgagcuccaggaggagagcgagauguccgagaagaaguccugcagcagcucccccacgcagagcgagaucuccaccagccugccgcccgaccgccagcggcgcaagcgcgagcugcggaccuucuccuucagcgacgacgagaacaagccgcccucccccaaggagauccgcaucgagguggccgagcggcuccaccuggacagcaacccccugaaguggagcgucgccgacguggugcgcuucauccgguccaccgacugcgcgccccucgcccgcaucuuccuggaccaggagaucgacgggcaggcccugcuccugcugacgcuccccaccguccaggagugcauggaccugaagcugggccccgccaucaagcucugccaccacaucgagcggaucaaguucgccuucuacgagcaguucgccaacuga

SEQ ID NO: 3348 - RNA, 2601 nt, Artificial Sequence
  derived and/or modified sequence opt2 from RU1__Homo_sapiens__AAH14614
augaacggcgagcagcagcucgacgccgacgccggcuccggcauggaggaggucgagcucuccugggaggacuaccucgaggagaccggcuccaccgccguccccuacggcuccuucaagcacgucgacacccgccuccagaacggcuucgcccccggcaugaagcucgaggucgccguccgcaccgaccccgagaccuacugggucgccaccgucaucaccaccugcgagcagcuccuccuccuccgcuacgacggcuacggcgaggaccgccgcgccgacuucuggugcgacauccgcaaggccgaccucuaccccaucggcuggugcgagcagaacaagaagacccucgaggcccccgagggcauccgcgacaaggucuccgacugggacgaguuccuccgccagacccucaucggcgccugcuccccccccgucccccuccucgagggccuccgcaacggccgcaacccccucgaccucaucgcccccggcucccgccucgagugccaggccuuccaggacucccucuccaccuggaucgucaccgucgucgagaacaucggcggccgccucaagcuccgcuacgagggccucgaguccuccgacaacuacgagcacuggcucuacuaccucgaccccuuccuccaccacgucggcugggccgcccagcagggcuacgagcuccagccccccuccgccauccgccaccucaagaacgaggccgaguggcaggagauccucgccaaggucaaggaggaggaggaggagccccuccccuccuaccucuucaaggacaagcaggucaucggcauccacaccuucuccgucaacaugaagcucgaggccgucgaccccuggucccccuucggcaucucccccgccaccgucgucaaggucuucgacgagaaguacuuccucgucgagauggacgaccuccgccccgagaaccacgcccgccgcuccuucgucugccacgccgacucccccggcaucuuccccguccaguggucccucaagaacggccuccacaucucccccccccccggcuaccccucccaggacuucgacugggccgacuaccucaagcagugcggcgccgaggccgccccccagcgcugcuuccccccccucaucuccgagcacgaguucaaggagaacaugaagcucgaggccgucaaccccauccuccccgaggaggucugcgucgccaccaucaccgccguccgcggcuccuaccucuggcuccagcucgagggcuccaagaagcccauccccgagugcaucgucuccgucgaguccauggacaucuucccccucggcuggugcgagaccaacggccacccccucuccaccccccgccgcgcccgcgucuacaagcagcgcaagaucgccgucguccagcccgagaagcagguccccuccucccgcaccguccacgagggccuccgcaaccaggagcucaacuccaccgaguccgucaugaucaacggcaaguacugcugccccaagaucuacuucaaccaccgcugcuucuccggccccuaccucaacaagggccgcaucgccgagcucccccagugcgucggccccggcaacugcguccucguccuccgcgagguccucacccuccucaucaacgccgccuacaagcccucccgcguccuccgcgagcuccagcucgacaaggacuccgucuggcacggcugcggcgagguccucaaggccaaguacaagggcaaguccuaccgcgccaccgucgagaucgucaagaccgccgaccgcgucaccgaguucugccgccagaccugcaucaagcucgagugcugccccaaccucuucggcccccgcaugguccucgacaagugcuccgagaacugcuccguccucaccaagaccaaguacacccacuacuacggcaagaagaagaacaagcgcaucggccgcccccccggcggccacuccaaccucgccugcgcccucaagaaggccuccaagcgccgcaagcgccgcaagaacgucuucguccacaagaagaagcgcuccuccgccuccgucgacaacacccccgccggcuccccccagggcuccggcggcgaggacgaggacgaccccgacgagggcgacgacgacucccucuccgagggcuccaccuccgagcagcaggacgagcuccaggaggaguccgagauguccgagaagaaguccugcuccuccucccccacccaguccgagaucuccaccucccucccccccgaccgccagcgccgcaagcgcgagcuccgcaccuucuccuucuccgacgacgagaacaagccccccucccccaaggagauccgcaucgaggucgccgagcgccuccaccucgacuccaacccccucaagugguccgucgccgacgucguccgcuucauccgcuccaccgacugcgccccccucgcccgcaucuuccucgaccaggagaucgacggccaggcccuccuccuccucacccuccccaccguccaggagugcauggaccucaagcucggccccgccaucaagcucugccaccacaucgagcgcaucaaguucgccuucuacgagcaguucgccaacuga

SEQ ID NO: 3349 - RNA, 2601 nt, Artificial Sequence
  derived and/or modified sequence opt3 from RU1__Homo_sapiens__AAH14614
augaacggcgagcagcaacuggacgccgaugcugggagcggaauggaagagguggaacucuccugggaggacuaccuugaagagaccgguucuacagcaguccccuauggcucauucaagcacguugauacuagacugcagaauggguuugccccuggaaugaaauuggagguggcgguaaggacggacccagaaaccuacuggguggcuacagucaucacuaccugcgagcaguuacugcuacuccgguaugauggcuacggugaagaccgccgagccgauuucuggugugacauucguaaggcagaucuguauccgauaggguggugcgagcagaacaaaaagacacuugaggcccccgaaggaaucagagacaaagugagugauugggacgaguuucugaggcaaaccuugauuggcgcuuguagcccuccaguuccccuccuggaaggccugcggaaugggcgcaacccucucgauuuaaucgcaccaggauccagacuggagugccaggccuuccaggacucucuuucgacuuggauugugacagucguggaaaauaucgguggcagguugaagcugcgguacgaggggcuagagucaagcgacaacuaugaacauuggcucuacuaccuggaucccuuucuucaccauguaggaugggcugcccagcaaggcuaugagcugcagccuccaagugcgauacgccacuugaagaaugaagcagaguggcaggaaauccucgccaaaguuaaggaggaggaagaggaaccgcugcccuccuacuuauucaaagacaaacaggugauugguauccauaccuuuucugucaacaugaagcuggaggcuguggauccuuggagcccauucgggauuucccccgccacgguggucaagguuuuugacgaaaaguauuuccucguggagauggaugaccuucgaccugagaaucacgcaagaaggucauuuguaugucacgcugauaguccaggaaucuuccccgugcaauggagccugaaaaacggcuugcauauaucuccgccucccggcuacccaucccaggacuuugauugggccgacuaucuaaagcagugcggggcggaagccgcaccucaacgguguuuucccccacugauuucagagcacgaguucaaagaaaauaugaagcucgaggcugucaaccccauccugccugaagaggugugcguugccacuauuaccgcugugcguggaagcuaccuuuggcugcaguuggaagguaguaaaaagccaaucccggaguguaucgucucuguggaauccauggauauuuucccccucggcuggugcgagacaaaugggcauccucugagcacuccacgcagagccaggguauauaaacagcggaagauagcaguugugcagcccgagaagcaagucccuucgucucgaaccgugcacgaaggauuacgcaaccaggagcuuaauuccacagaaucagucaugaucaacggcaaauacuguugcccaaagauuuacuucaaccacagaugcuuuaguggucccuaucuaaauaaagggaggaucgccgagcucccgcagugugugggcccuggaaacugcguucuggugcuucgggaaguauugacccugcucauaaaugcugcguacaagccaagccgcguccugagagagcuucagcuggacaaagacuccguguggcauggcuguggggagguuuugaaggcaaaguauaaaggaaagucuuacagggccacgguggaaauugucaaaacugcugaucgugugacagaguucugccggcaaaccuguaucaagcucgaaugcugucccaaccuguuugguccucgaaugguauuagacaaaugcagcgagaauuguucagugcugacuaagacaaaguauacccacuacuauggcaaaaagaaaaacaagagaaucgggaggcccccaggaggccauaguaaucuagccugcgcacucaaaaaggccuccaagcgccggaaaagaaggaagaacguuuucguccacaaaaagaaacgcagcucugcuucaguggauaauacgccugccgguaguccccaggggagcggcggagaagacgaggaugacccagaugagggcgacgaugacucccugucugaagggucgaccagcgagcagcaggaugaacuucaagaggaguccgaaaugucagagaagaaaaguuguucuagcuccccgacacagucagaaauuagcacuucuuugccucccgaccgacagcggcguaagagagagcugaggaccuuuuccuucagugaugacgaaaacaagccacccagcccuaaagagauccgcauugagguggcagaacggcuccaucuggacucuaauccauuaaagugguccgucgcggauguugugagauuuauaaggucaacagacugcgcuccccuggcccgaaucuuccuugaucaggagauugacggacaagcauugcuccugcuaacucugccuaccgugcaggaaugcauggaucucaaacuggguccggccaucaagcugugucaccacaucgagcgcauuaaauuugcuuucuacgaacaguuugccaacuga

SEQ ID NO: 3350 - RNA, 2601 nt, Artificial Sequence
  derived and/or modified sequence opt4 from RU1__Homo_sapiens__AAH14614
augaacggcgagcagcagcuggacgccgacgccggcagcggcauggaggagguggagcugagcugggaggacuaccuggaggagaccggcagcaccgccgugcccuacggcagcuucaagcacguggacaccagacugcagaacggcuucgcccccggcaugaagcuggagguggccgugagaaccgaccccgagaccuacuggguggccaccgugaucaccaccugcgagcagcugcugcugcugagauacgacggcuacggcgaggacagaagagccgacuucuggugcgacaucagaaaggccgaccuguaccccaucggcuggugcgagcagaacaagaagacccuggaggcccccgagggcaucagagacaaggugagcgacugggacgaguuccugagacagacccugaucggcgccugcagcccccccgugccccugcuggagggccugagaaacggcagaaacccccuggaccugaucgcccccggcagcagacuggagugccaggccuuccaggacagccugagcaccuggaucgugaccgugguggagaacaucggcggcagacugaagcugagauacgagggccuggagagcagcgacaacuacgagcacuggcuguacuaccuggaccccuuccugcaccacgugggcugggccgcccagcagggcuacgagcugcagccccccagcgccaucagacaccugaagaacgaggccgaguggcaggagauccuggccaaggugaaggaggaggaggaggagccccugcccagcuaccuguucaaggacaagcaggugaucggcauccacaccuucagcgugaacaugaagcuggaggccguggaccccuggagccccuucggcaucagccccgccaccguggugaagguguucgacgagaaguacuuccugguggagauggacgaccugagacccgagaaccacgccagaagaagcuucgugugccacgccgacagccccggcaucuuccccgugcaguggagccugaagaacggccugcacaucagccccccccccggcuaccccagccaggacuucgacugggccgacuaccugaagcagugcggcgccgaggccgccccccagagaugcuuccccccccugaucagcgagcacgaguucaaggagaacaugaagcuggaggccgugaaccccauccugcccgaggaggugugcguggccaccaucaccgccgugagaggcagcuaccuguggcugcagcuggagggcagcaagaagcccauccccgagugcaucgugagcguggagagcauggacaucuucccccugggcuggugcgagaccaacggccacccccugagcacccccagaagagccagaguguacaagcagagaaagaucgccguggugcagcccgagaagcaggugcccagcagcagaaccgugcacgagggccugagaaaccaggagcugaacagcaccgagagcgugaugaucaacggcaaguacugcugccccaagaucuacuucaaccacagaugcuucagcggccccuaccugaacaagggcagaaucgccgagcugccccagugcgugggccccggcaacugcgugcuggugcugagagaggugcugacccugcugaucaacgccgccuacaagcccagcagagugcugagagagcugcagcuggacaaggacagcguguggcacggcugcggcgaggugcugaaggccaaguacaagggcaagagcuacagagccaccguggagaucgugaagaccgccgacagagugaccgaguucugcagacagaccugcaucaagcuggagugcugccccaaccuguucggccccagaauggugcuggacaagugcagcgagaacugcagcgugcugaccaagaccaaguacacccacuacuacggcaagaagaagaacaagagaaucggcagaccccccggcggccacagcaaccuggccugcgcccugaagaaggccagcaagagaagaaagagaagaaagaacguguucgugcacaagaagaagagaagcagcgccagcguggacaacacccccgccggcagcccccagggcagcggcggcgaggacgaggacgaccccgacgagggcgacgacgacagccugagcgagggcagcaccagcgagcagcaggacgagcugcaggaggagagcgagaugagcgagaagaagagcugcagcagcagccccacccagagcgagaucagcaccagccugccccccgacagacagagaagaaagagagagcugagaaccuucagcuucagcgacgacgagaacaagccccccagccccaaggagaucagaaucgagguggccgagagacugcaccuggacagcaacccccugaaguggagcguggccgacguggugagauucaucagaagcaccgacugcgccccccuggccagaaucuuccuggaccaggagaucgacggccaggcccugcugcugcugacccugcccaccgugcaggagugcauggaccugaagcugggccccgccaucaagcugugccaccacaucgagagaaucaaguucgccuucuacgagcaguucgccaacuga

SEQ ID NO: 3351 - RNA, 2601 nt, Artificial Sequence
  derived and/or modified sequence opt5 from RU1__Homo_sapiens__AAH14614
augaacggcgagcagcaacuggacgccgaugcugggagcggaauggaagagguggaacucuccugggaggacuaccuggaagagaccggcucuacagccguccccuaugggagcuucaagcacguugauacgagacuucagaauggauuugcgccuggcaugaaacuggagguggcugugcggaccgacccggaaacauacugggucgccaccgugaucacaaccugcgagcagcuccugcuucugcgcuaugauggguacggagaagacagacgggccgauuucuggugugacauucgcaaggcugaucucuaucccaucggcuggugcgagcagaacaaaaagacacuggaggccccugaaggcauuagagacaaaguuuccgauugggacgaguuucugcggcaaacccucaucggggcuuguucucccccugugccccugcuugaaggacugcgcaauggcagaaacccucucgaucugauugccccggggagccggcuugagugccaggcguuccaggacucccugucuacguggaucgucaccgugguugaaaauaucggaggccgccucaagcugagauacgaggggcuggagagcuccgacaacuaugaacauuggcucuacuaccuggaucccuuucuucaccaugugggaugggccgcucagcaaggcuaugagcugcagccucccagcgccauucggcaccucaagaaugaagcugaguggcaggaaauccuggccaaagucaaggaggaggaagaggaaccucuucccucuuaccuguucaaagacaaacaggugauuggcauccauacauuuuccgugaacaugaagcucgaggcggucgauccguggagcccuuucgggauuucucccgccaccguugugaagguguuugacgaaaaguauuuccuggucgagauggaugaccugcgcccugagaaucacgcuagacgguccuuugugugucacgccgauagccccggaaucuuccccguucaauggucucucaaaaacggccugcauauuuccccuccgcccggguacccuagccaggacuuugauugggcugacuaucuuaagcagugcggagccgaagccgcuccccaacgcuguuucccuccccugaucuccgagcacgaguucaaagaaaauaugaagcucgaggcggugaacccgauccugccugaagaggucugcguggccacaauuaccgcuguuagaggcucuuaccuuuggcugcagcucgaagggagcaaaaagcccaucccugaguguauuguguccgucgaaagcauggauaucuuuccccugggauggugcgagacgaauggccauccucugucuacaccccggagagcccgcguguauaaacagcggaagauugccgucgugcagccggagaagcaaguuccuuccagcagaaccgugcacgaaggccuccgcaaccaggagcuuaauucuacagaaagcgucaugaucaacgggaaauacuguugccccaagaucuacuucaaccaccggugcuuuuccggacccuaucuuaauaaaggcagaauugcugagcugccucaguguguggggccgggaaacugcguucucgugcugcgcgaaguccugacccuucucaucaaugccgcguacaagcccucucgggugcugagagagcugcagcucgacaaagacagcguguggcauggcuguggggagguucugaaggcuaaguauaaaggcaaguccuaccgcgccaccgucgaaauugugaaaacagccgaucgggugacggaguucugcagacaaaccuguaucaagcuggaaugcuguccuaaccuguuuggaccccgcaugguccucgacaaaugcagcgagaauuguucugugcugacaaagaccaaguauacacacuacuauggcaaaaagaaaaacaagcggauugggagaccucccggaggccauuccaaucuggcuugcgcccuuaaaaaggcuagcaagcggcgcaaaagacggaagaacguuuucgugcacaaaaagaaaagaucuuccgccagcgucgauaauaccccugcggggucuccccagggauccggcggggaagacgaggaugacccggaugagggcgacgaugacagccucuccgaaggaucuacgagcgagcagcaggaugaacugcaagaggaguccgaaaugagcgagaagaaaucuuguuccagcucuccuacacaguccgaaaucagcaccucucugcccccugaccgccagcggagaaagcgcgagcucagaaccuuuagcuucuccgaugacgaaaacaagcccccgagcccuaaagagauccggauugagguggccgaacgccugcaucuugacucuaauccccugaagugguccguugcugauguggucagauuuauccggagcacagacugcgccccucucgcucgcauuuuccuggaucaggagaucgacggccaagcccugcuucuccugacccugcccacagugcaggaaugcauggaucucaaacuggggcccgcgauuaaacuuugucaccacaucgagagaauuaaguuugccuucuacgaacaguuugcuaacuga

SEQ ID NO: 3352 - protein, 476 aa, Artificial Sequence
  RU2__Homo_sapiens__Q9UHG0
MSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEVKPVIHSRINVSARFRKPLQEPCTIFLIANGDLINPASRLLIPRKTLNQWDHVLQMVTEKITLRSGAVHRLYTLEGKLVESGAELENGQFYVAVGRDKFKKLPYSELLFDKSTMRRPFGQKASSLPPIVGSRKSKGSGNDRHSKSTVGSSDNSSPQPLKRKGKKEDVNSEKLTKLKQNVKLKNSQETIPNSDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 3353 - RNA, 1431 nt, Artificial Sequence
  RU2__Homo_sapiens__CCDS4550.1
augagcggcagcagcgccagguccagccaccugucucagcccgucgugaagagcgugcuuguguaccgcaacggggaccccuucuacgcggggcgccgcgucgucauccaugagaagaagguguccagcuucgaagucuuccugaaggaggugaccggcggcguucaggcacccuuuggggccgucaggaacaucuacaccccgcggacuggccaccgaauccggaagcuagaccagauccagagcgggggcaauuacguggcuggaggccaggaagccuucaagaaacucaauuacuuggacauaggagaaaucaagaaaagaccaauggaaguuguuaauacagagguaaaaccaguaauccauagcaggaucaacgugucagcucgcuuuagaaaaccgcuucaggagccgugcacuaucuucuugauugcaaauggagaccucauaaacccagcuucucgccuccuuauccccagaaaaaccuugaaucagugggaucauguacuacaaauggucacagaaaaaaucacucugaggagcggggcuguucacaggcuuuauacuuuagaaggaaaacuuguugagaguggagcagaguuggagaaugggcaguuuuauguggcuguuggcagagauaaguuuaagaaacugccuuacagugaguuacuuuuugacaagucaacgaugagaaggccuuuuggucagaaagcuucuucacuaccuccuauuguaggauccagaaagucuaaagggaguggaaaugaucgccacucuaagucaacaguuggauccagugacaacucaucuccucagccccugaagaggaaagggaaaaaagaagacgugaauucagaaaaacugacgaaauugaaacaaaauguaaaauuaaagaauucacaagaaaccauuccaaauagugaugaaggcauuuucaaagcuggagcagagaggucugaaacacggggggcagcagaaguccaagaagaugaagauacucagguugagguuccagucgaucagaggccagcagaaauaguagacgaggaagaagauggagagaaggcaaacaaggaugcagaacagaaagaagacuuuucaggaaugaauggugaccuugaagaggaaggagguagggaggcuacagaugccccugagcaagucgaggagauucuggaucacagugagcagcaggcacgcccugcucguguaaauggaggcaccgaugaggagaauggugaggagcugcagcagguuaauaaugagcuucaacugguccuagacaaggaaagaaagucucaaggagcuggcaguggacaagaugaggcugauguagacccucaaagaccaccaaggccagaaguaaaaauuaccaguccagaagaaaaugaaaacaaccaacaaaacaaggacuaugcugccguggcuuag

SEQ ID NO: 3354 - RNA, 1431 nt, Artificial Sequence
  derived and/or modified sequence opt1 from RU2__Homo_sapiens__CCDS4550.1
augagcggcuccagcgcccgcuccagccaccugucccagcccguggucaagagcgugcucguguaccggaacggggacccguucuacgccggccgccgggucgugauccacgagaagaagguguccagcuucgaggucuuccugaaggaggugaccgggggcgugcaggcgcccuucggggccguccgcaacaucuacacgccccggacgggccaccgcauccggaagcuggaccagauccaguccggcgggaacuacguggccggcgggcaggaggccuucaagaagcucaacuaccuggacaucggcgagaucaagaagcgccccauggagguggucaacaccgaggugaagccggugauccacagccggaucaacgucuccgcccgcuuccggaagccccugcaggagcccugcaccaucuuccucaucgcgaacggggaccugaucaaccccgccagccgccugcucaucccgcggaagacccugaaccagugggaccacgugcugcagauggugacggagaagaucacccuccgcuccggcgccguccaccggcuguacacccuggagggcaagcucguggagagcggggccgagcuggagaacggccaguucuacguggcggucgggcgcgacaaguucaagaagcugcccuacuccgagcuccuguucgacaagagcaccaugcggcgccccuucggccagaaggccuccagccugcccccgaucgugggcucccgcaagagcaaggggagcggcaacgaccggcacuccaagagcacggugggguccagcgacaacuccagcccccagccccucaagcggaagggcaagaaggaggacgucaacuccgagaagcugaccaagcugaagcagaacgugaagcucaagaacagccaggagaccauccccaacuccgacgaggggaucuucaaggccggcgccgagcgcagcgagacccgcggcgccgcggagguccaggaggacgaggacacccagguggaggugccggucgaccagcggcccgccgagaucguggacgaggaggaggacggggagaaggccaacaaggacgccgagcagaaggaggacuucuccggcaugaacggggaccuggaggaggagggcgggcgcgaggccaccgacgcgcccgagcaggucgaggagauccuggaccacagcgagcagcaggcccggcccgcccgcgugaacggcggcaccgacgaggagaacggggaggagcuccagcaggucaacaacgagcugcagcuggugcucgacaaggagcggaagucccagggcgccgggagcggccaggacgaggccgacguggacccgcagcgcccgccccggcccgaggugaagaucaccucccccgaggagaacgagaacaaccagcagaacaaggacuacgcggccguggccuga

SEQ ID NO: 3355 - RNA, 1431 nt, Artificial Sequence
  derived and/or modified sequence opt2 from RU2__Homo_sapiens__CCDS4550.1
auguccggcuccuccgcccgcuccucccaccucucccagcccgucgucaaguccguccucgucuaccgcaacggcgaccccuucuacgccggccgccgcgucgucauccacgagaagaaggucuccuccuucgaggucuuccucaaggaggucaccggcggcguccaggcccccuucggcgccguccgcaacaucuacaccccccgcaccggccaccgcauccgcaagcucgaccagauccaguccggcggcaacuacgucgccggcggccaggaggccuucaagaagcucaacuaccucgacaucggcgagaucaagaagcgccccauggaggucgucaacaccgaggucaagcccgucauccacucccgcaucaacgucuccgcccgcuuccgcaagccccuccaggagcccugcaccaucuuccucaucgccaacggcgaccucaucaaccccgccucccgccuccucaucccccgcaagacccucaaccagugggaccacguccuccagauggucaccgagaagaucacccuccgcuccggcgccguccaccgccucuacacccucgagggcaagcucgucgaguccggcgccgagcucgagaacggccaguucuacgucgccgucggccgcgacaaguucaagaagcuccccuacuccgagcuccucuucgacaaguccaccaugcgccgccccuucggccagaaggccuccucccucccccccaucgucggcucccgcaaguccaagggcuccggcaacgaccgccacuccaaguccaccgucggcuccuccgacaacuccuccccccagccccucaagcgcaagggcaagaaggaggacgucaacuccgagaagcucaccaagcucaagcagaacgucaagcucaagaacucccaggagaccauccccaacuccgacgagggcaucuucaaggccggcgccgagcgcuccgagacccgcggcgccgccgagguccaggaggacgaggacacccaggucgagguccccgucgaccagcgccccgccgagaucgucgacgaggaggaggacggcgagaaggccaacaaggacgccgagcagaaggaggacuucuccggcaugaacggcgaccucgaggaggagggcggccgcgaggccaccgacgcccccgagcaggucgaggagauccucgaccacuccgagcagcaggcccgccccgcccgcgucaacggcggcaccgacgaggagaacggcgaggagcuccagcaggucaacaacgagcuccagcucguccucgacaaggagcgcaagucccagggcgccggcuccggccaggacgaggccgacgucgacccccagcgccccccccgccccgaggucaagaucaccucccccgaggagaacgagaacaaccagcagaacaaggacuacgccgccgucgccuga

SEQ ID NO: 3356 - RNA, 1431 nt, Artificial Sequence
  derived and/or modified sequence opt3 from RU2__Homo_sapiens__CCDS4550.1
augagcggcuccucugccagaucaagucaccugagccagcccguggucaaguccguucucguguacaggaacggggacccuuucuaugcuggacggcgcguagugauccaugagaaaaaggucucuucguuugaaguguuccuuaaagagguuaccgguggcgugcaagcaccauuuggggccguccgaaauauuuacacaccgcguacuggacacagaauaaggaagcuggaucagauccagucaggcgguaacuauguggcugggggacaggaagcguucaaaaaguugaauuacuuagacauuggcgagaucaagaaacggcccauggaaguaguuaacacggaggugaagccugucauucauagccgcaucaaugugagugccagauuuaggaaaccacugcaagagcccugcaccauauuccuaaucgcaaacggcgaucucauuaauccugccucccggcugcuuaucccacgcaagacacugaaccagugggaccacguguugcagauggucacugaaaagauuacccuccgaucuggggcuguucauagacuguauacacuggagggaaagcucguggaaagcggugcagaguuagagaauggccaguuuuacguagccguggggagggauaaguucaaaaagcugcccuauuccgaacuuuuguuugacaaaucaaccaugcggcguccuuucggacaaaaggcuaguagccugccaccgaucgucggcucucgcaaauccaaggguucagggaacgauagacacagcaaaaguacugugggaucuuccgacaauagcucgccccagccucuaaagaggaagggcaaaaaggaggauguuaacucugaaaaacucacaaagcugaaacagaaugugaaacuuaagaacucccaggagaccauaccaaauucagacgaaggcauuuuuaaagccggggcggagcggagugagacgcgaggagcagccgaaguccaagaggaugaagacacucagguggagguacccguugaucagcgcccugcugaaaucguggacgaggaggaagacggugagaaggccaacaaagaugcagaacaaaaggaggacuucagcggcaugaacggggaucuggaagaggagggaggcagagaagcuaccgacgccccagagcaggucgaagagauuuuggaucacuccgagcagcaggcgaggcccgcccgggugaauggugggacagacgaagagaacggcgaggaacuccaacaggucaauaacgaacugcaguuagugcuggauaaagagcgcaagucucagggagcaggcagcgggcaagacgaggcugauguugacccgcagagaccucccaggccagaagugaagaucacuucaccugaggaaaaugagaacaaucagcagaacaaagauuacgccgcuguagccuga

SEQ ID NO: 3357 - RNA, 1431 nt, Artificial Sequence
  derived and/or modified sequence opt4 from RU2__Homo_sapiens__CCDS4550.1
augagcggcagcagcgccagaagcagccaccugagccagcccguggugaagagcgugcugguguacagaaacggcgaccccuucuacgccggcagaagaguggugauccacgagaagaaggugagcagcuucgagguguuccugaaggaggugaccggcggcgugcaggcccccuucggcgccgugagaaacaucuacacccccagaaccggccacagaaucagaaagcuggaccagauccagagcggcggcaacuacguggccggcggccaggaggccuucaagaagcugaacuaccuggacaucggcgagaucaagaagagacccauggagguggugaacaccgaggugaagcccgugauccacagcagaaucaacgugagcgccagauucagaaagccccugcaggagcccugcaccaucuuccugaucgccaacggcgaccugaucaaccccgccagcagacugcugauccccagaaagacccugaaccagugggaccacgugcugcagauggugaccgagaagaucacccugagaagcggcgccgugcacagacuguacacccuggagggcaagcugguggagagcggcgccgagcuggagaacggccaguucuacguggccgugggcagagacaaguucaagaagcugcccuacagcgagcugcuguucgacaagagcaccaugagaagacccuucggccagaaggccagcagccugccccccaucgugggcagcagaaagagcaagggcagcggcaacgacagacacagcaagagcaccgugggcagcagcgacaacagcagcccccagccccugaagagaaagggcaagaaggaggacgugaacagcgagaagcugaccaagcugaagcagaacgugaagcugaagaacagccaggagaccauccccaacagcgacgagggcaucuucaaggccggcgccgagagaagcgagaccagaggcgccgccgaggugcaggaggacgaggacacccagguggaggugcccguggaccagagacccgccgagaucguggacgaggaggaggacggcgagaaggccaacaaggacgccgagcagaaggaggacuucagcggcaugaacggcgaccuggaggaggagggcggcagagaggccaccgacgcccccgagcagguggaggagauccuggaccacagcgagcagcaggccagacccgccagagugaacggcggcaccgacgaggagaacggcgaggagcugcagcaggugaacaacgagcugcagcuggugcuggacaaggagagaaagagccagggcgccggcagcggccaggacgaggccgacguggacccccagagaccccccagacccgaggugaagaucaccagccccgaggagaacgagaacaaccagcagaacaaggacuacgccgccguggccuga

SEQ ID NO: 3358 - RNA, 1431 nt, Artificial Sequence
  derived and/or modified sequence opt5 from RU2__Homo_sapiens__CCDS4550.1
augagcggcuccucugccagaagcucccaccugucucagcccguggucaagagcguucucguguaccggaacggggacccuuucuaugcuggacgcagaguggucauccaugagaaaaagguguccucuuuugaaguuuuccugaaagaggugaccggcgggguccaagccccguuuggagcggugcggaauauuuacacaccccgcacgggccacagaauccggaaacuugaucagauucagagcgggggaaacuauguugcuggcggccaggaagccuucaaaaagcugaauuaccucgacaucggggagauuaagaaacgcccuauggaaguggucaacaccgaggugaagcccgugauccauuccagaaucaaugucagcgcccgguuucgcaaaccucugcaagagcccugcacaauuuuccuuaucgcuaacggagaucugauuaauccugccucuagacuccugaucccgcggaagacccugaaccagugggaccacguucuccagauggugacagaaaagauuacccugcgcuccggcgcugugcauagacuuuauacacuggaggggaagcucgucgaaagcggagccgagcuggagaauggccaguuuuacguggcgguugggcgggauaaguucaaaaagcugcccuauucugaacuucucuuugacaaauccaccaugcgcagaccuuucggacaaaaggccagcucucugcccccuaucgugggcucccggaaaagcaagggcuccgggaacgauagacacucuaaaagcacggucggauccagcgacaauucuagcccccagccgcugaagcgcaagggcaaaaaggaggaugugaacuccgaaaaacucaccaagcugaaacagaauguuaaacuuaagaacucucaggagacaauuccuaauagcgacgaagggaucuuuaaggcuggagccgagcgguccgagaccagaggcgcugccgaagugcaagaggaugaagacacacaggucgaggugcccgucgaucagcgcccugcggaaaucguggacgaggaggaagacggggagaaggccaacaaagaugcugaacaaaaggaggacuucucuggaaugaacggcgaucuggaagaggagggcgggcgggaagccaccgacgcucccgagcagguugaagagauucucgaucacagcgagcagcaggccagacccgcccgcgugaauggaggcacggacgaagagaacggggaggaacugcaacaggucaauaacgaacuucagcuggugcucgauaaagagcggaagucccagggagcuggcagcgggcaagacgaggcggauguugacccucagagaccgccccgcccugaagugaagaucacaucucccgaggaaaaugagaacaaucagcagaacaaagauuacgccgcugucgccuga

SEQ ID NO: 3359 - protein, 453 aa, Artificial Sequence
  RUNX1__Homo_sapiens__Q01196
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 3360 - RNA, 1362 nt, Artificial Sequence
  RUNX1__Homo_sapiens__BAA07903
augcguauccccguagaugccagcacgagccgccgcuucacgccgccuuccaccgcgcugagcccaggcaagaugagcgaggcguugccgcugggcgccccggacgccggcgcugcccuggccggcaagcugaggagcggcgaccgcagcaugguggaggugcuggccgaccacccgggcgagcuggugcgcaccgacagccccaacuuccucugcuccgugcugccuacgcacuggcgcugcaacaagacccugcccaucgcuuucaaggugguggcccuaggggauguuccagauggcacucuggucacugugauggcuggcaaugaugaaaacuacucggcugagcugagaaaugcuaccgcagccaugaagaaccagguugcaagauuuaaugaccucagguuugucggucgaaguggaagagggaaaagcuucacucugaccaucacugucuucacaaacccaccgcaagucgccaccuaccacagagccaucaaaaucacaguggaugggccccgagaaccucgaagacaucggcagaaacuagaugaucagaccaagcccgggagcuuguccuuuuccgagcggcucagugaacuggagcagcugcggcgcacagccaugagggucagcccacaccacccagcccccacgcccaacccucgugccucccugaaccacuccacugccuuuaacccucagccucagagucagaugcaggauacaaggcagauccaaccauccccaccgugguccuacgaucaguccuaccaauaccugggauccauugccucuccuucugugcacccagcaacgcccauuucaccuggacgugccagcggcaugacaacccucucugcagaacuuuccagucgacucucaacggcacccgaccugacagcguucagcgacccgcgccaguuccccgcgcugcccuccaucuccgacccccgcaugcacuauccaggcgccuucaccuacuccccgacgccggucaccucgggcaucggcaucggcaugucggccaugggcucggccacgcgcuaccacaccuaccugccgccgcccuaccccggcucgucgcaagcgcagggaggcccguuccaagccagcucgcccuccuaccaccuguacuacggcgccucggccggcuccuaccaguucuccauggugggcggcgagcgcucgccgccgcgcauccugccgcccugcaccaacgccuccaccggcuccgcgcugcucaaccccagccucccgaaccagagcgacgugguggaggccgagggcagccacagcaacucccccaccaacauggcgcccuccgcgcgccuggaggaggccguguggaggcccuacuga

SEQ ID NO: 3361 - RNA, 1362 nt, Artificial Sequence
  derived and/or modified sequence opt1 from RUNX1__Homo_sapiens__BAA07903
augcgcauccccguggacgccagcaccucccggcgcuucaccccgcccagcacggcccugucccccggcaagaugagcgaggcgcucccccugggggccccggacgccggcgccgcccuggcggggaagcuccgguccggcgaccgcagcauggucgaggugcuggccgaccaccccggggagcuggugcggaccgacucccccaacuuccucugcagcguccugcccacccacuggcgcugcaacaagacccugccgaucgccuucaaggugguggcccucggcgacguccccgacggcacgcuggugaccgugauggcggggaacgacgagaacuacuccgccgagcugcggaacgccaccgccgccaugaagaaccaggucgcgcgcuucaacgaccuccgguucgugggccgcagcgggcggggcaaguccuucacccugacgaucaccguguucaccaacccgccccaggucgccaccuaccaccgcgccaucaagaucacgguggacgggccccgggagccccgccggcaccgccagaagcuggacgaccagaccaagcccggcagccucuccuucagcgagcggcuguccgagcuggagcagcuccgccggaccgccaugcgcgugagcccccaccacccggcccccacccccaacccccgggcgucccugaaccacagcacggccuucaacccgcagccccagucccagaugcaggacacccgccagauccagcccagcccgcccuggagcuacgaccaguccuaccaguaccugggcagcaucgccucccccagcguccaccccgccacccccaucuccccggggcgcgccagcggcaugaccacgcucuccgcggagcugagcucccggcugagcaccgcccccgaccucaccgccuucuccgacccccgccaguucccggcccugcccagcaucuccgacccccggaugcacuaccccggggccuucaccuacagcccgacgcccgugaccuccggcaucggcaucgggaugagcgcgaugggcuccgccacccgcuaccacaccuaccugcccccgcccuaccccgggagcucccaggcccagggcgggcccuuccaggccagcagccccuccuaccaccucuacuacggcgcgagcgccggcuccuaccaguucagcauggucgggggcgagcgguccccgccccgcauccugccgcccugcacgaacgccagcaccggguccgcccugcucaaccccagccugcccaaccaguccgacgugguggaggccgagggcagccacuccaacagccccaccaacauggcgcccuccgcccggcuggaggaggccguguggcgcccguacuga

SEQ ID NO: 3362 - RNA, 1362 nt, Artificial Sequence
  derived and/or modified sequence opt2 from RUNX1__Homo_sapiens__BAA07903
augcgcauccccgucgacgccuccaccucccgccgcuucaccccccccuccaccgcccucucccccggcaagauguccgaggcccucccccucggcgcccccgacgccggcgccgcccucgccggcaagcuccgcuccggcgaccgcuccauggucgagguccucgccgaccaccccggcgagcucguccgcaccgacucccccaacuuccucugcuccguccuccccacccacuggcgcugcaacaagacccuccccaucgccuucaaggucgucgcccucggcgacguccccgacggcacccucgucaccgucauggccggcaacgacgagaacuacuccgccgagcuccgcaacgccaccgccgccaugaagaaccaggucgcccgcuucaacgaccuccgcuucgucggccgcuccggccgcggcaaguccuucacccucaccaucaccgucuucaccaaccccccccaggucgccaccuaccaccgcgccaucaagaucaccgucgacggcccccgcgagccccgccgccaccgccagaagcucgacgaccagaccaagcccggcucccucuccuucuccgagcgccucuccgagcucgagcagcuccgccgcaccgccaugcgcgucuccccccaccaccccgcccccacccccaacccccgcgccucccucaaccacuccaccgccuucaacccccagccccagucccagaugcaggacacccgccagauccagcccuccccccccugguccuacgaccaguccuaccaguaccucggcuccaucgccucccccuccguccaccccgccacccccaucucccccggccgcgccuccggcaugaccacccucuccgccgagcucuccucccgccucuccaccgcccccgaccucaccgccuucuccgacccccgccaguuccccgcccuccccuccaucuccgacccccgcaugcacuaccccggcgccuucaccuacucccccacccccgucaccuccggcaucggcaucggcauguccgccaugggcuccgccacccgcuaccacaccuaccuccccccccccuaccccggcuccucccaggcccagggcggccccuuccaggccuccucccccuccuaccaccucuacuacggcgccuccgccggcuccuaccaguucuccauggucggcggcgagcgcucccccccccgcauccucccccccugcaccaacgccuccaccggcuccgcccuccucaaccccucccuccccaaccaguccgacgucgucgaggccgagggcucccacuccaacucccccaccaacauggcccccuccgcccgccucgaggaggccgucuggcgccccuacuga

SEQ ID NO: 3363 - RNA, 1362 nt, Artificial Sequence
  derived and/or modified sequence opt3 from RUNX1__Homo_sapiens__BAA07903
augagaauccccguggacgccagcaccuccaggcgguucacaccuccaucuacugcucugucaccgggcaagaugagugaggcacucccccuuggggccccugaugcgggagcugcccuggcagguaaauugcgcagcggcgaccgauccauggucgaaguuuuagccgaucacccaggggagcuggugcguacggacucucccaacuuucuaugcucgguacucccuacccauuggagauguaauaagacacugccaauugcuuucaaaguggucgcacuuggagaugugcccgacggcacucugguuaccgugauggccgguaacgaugaaaauuacucagcugaguugaggaacgccacagcggcaaugaagaaucaggucgcccgguuuaacgaccuccgcuucguggggagaagcggaaggggcaaaaguuuuacccugacuauaacaguauucaccaauccuccacaaguugcuacguaucaccgggccaucaagauuacuguggauggcccgcgcgaaccccgaagacauaggcagaagcuggacgaucagaccaaaccugggucccucucuuuuagcgagcgguuauccgagcuggaacagcuucgucgcacagcaaugagagucucaccacaccaucccgcuccuacuccaaaccccagggccaguuugaaucacagcaccgcguucaacccgcaaccucagucucagaugcaggacacacggcaaauccagcccuccccaccuuggucauacgaucagagcuaucaguaccugggaaguauugccucucccuccgugcacccagcaacccccaucagcccuggucgagcuucgggcaugacgacucuaucugccgagcucuccucacgccugaguacagcuccagaccuuaccgccuuuagcgacccgagacaauuccccgcacugccuuccauaucugauccaaggaugcauuaucccggggccuuuacuuacagcccuacaccagugaccucaggaaucggcauugguaugagugcuaugggguccgcgacgcgguaucacaccuacuugcccccgccuuacccaggaagcucucaggcacagggcggccccuuccaagccucaaguccuagcuaucaucucuacuauggggcuuccgccggaucuuaccaguuuucgauggucgguggcgaacgcagcccacccagaauccugccucccugcacaaaugcauccacugggucagccuuacugaacccaagucucccgaaucagucugacguuguggaggcugagggaagccacuccaacucaccuaccaauauggcccccagcgcaaggcuugaagaggcgguauggcguccauauuga

SEQ ID NO: 3364 - RNA, 1362 nt, Artificial Sequence
  derived and/or modified sequence opt4 from RUNX1__Homo_sapiens__BAA07903
augagaauccccguggacgccagcaccagcagaagauucaccccccccagcaccgcccugagccccggcaagaugagcgaggcccugccccugggcgcccccgacgccggcgccgcccuggccggcaagcugagaagcggcgacagaagcaugguggaggugcuggccgaccaccccggcgagcuggugagaaccgacagccccaacuuccugugcagcgugcugcccacccacuggagaugcaacaagacccugcccaucgccuucaaggugguggcccugggcgacgugcccgacggcacccuggugaccgugauggccggcaacgacgagaacuacagcgccgagcugagaaacgccaccgccgccaugaagaaccagguggccagauucaacgaccugagauucgugggcagaagcggcagaggcaagagcuucacccugaccaucaccguguucaccaaccccccccagguggccaccuaccacagagccaucaagaucaccguggacggccccagagagcccagaagacacagacagaagcuggacgaccagaccaagcccggcagccugagcuucagcgagagacugagcgagcuggagcagcugagaagaaccgccaugagagugagcccccaccaccccgcccccacccccaaccccagagccagccugaaccacagcaccgccuucaacccccagccccagagccagaugcaggacaccagacagauccagcccagcccccccuggagcuacgaccagagcuaccaguaccugggcagcaucgccagccccagcgugcaccccgccacccccaucagccccggcagagccagcggcaugaccacccugagcgccgagcugagcagcagacugagcaccgcccccgaccugaccgccuucagcgaccccagacaguuccccgcccugcccagcaucagcgaccccagaaugcacuaccccggcgccuucaccuacagccccacccccgugaccagcggcaucggcaucggcaugagcgccaugggcagcgccaccagauaccacaccuaccugcccccccccuaccccggcagcagccaggcccagggcggccccuuccaggccagcagccccagcuaccaccuguacuacggcgccagcgccggcagcuaccaguucagcauggugggcggcgagagaagcccccccagaauccugccccccugcaccaacgccagcaccggcagcgcccugcugaaccccagccugcccaaccagagcgacgugguggaggccgagggcagccacagcaacagccccaccaacauggcccccagcgccagacuggaggaggccguguggagacccuacuga

SEQ ID NO: 3365 - RNA, 1362 nt, Artificial Sequence
  derived and/or modified sequence opt5 from RUNX1__Homo_sapiens__BAA07903
augagaauccccguggacgccagcaccucccggcgcuucacaccuccgucuacggcucugagccccggcaagauguccgaggcccucccucugggggcgcccgaugcuggagccgcccuugcuggcaaacugagaucuggggaccggagcauggucgaaguucucgccgaucacccuggagagcuggugcgcaccgacucccccaacuuucuuugcucugugcugccuacacauuggagauguaauaagacccucccgauugcuuucaaagucguggcccugggcgauguucccgacgggacacuggugaccgucauggcgggaaacgaugaaaauuacagcgccgagcuccggaacgcuacagccgcuaugaagaaucagguggcccgcuuuaacgaccugagauucguuggccgguccggccgcgggaaaucuuuuacccuuacgaucaccguguucacaaauccuccccaagucgcgaccuaucacagagccauuaagaucacaguggauggaccucgggaaccccgcagacaucggcagaagcuggacgaucagaccaaaccgggcagccucuccuuuagcgagcgccugucugagcuugaacagcugagacggacggcuaugagaguguccccucaccaucccgccccuacacccaacccccgcgcuagccucaaucacucuaccgccuucaacccucaaccgcagucccagaugcaggacacacggcaaauucagcccagcccucccugguccuacgaucagucuuaucaguaccuggggagcaucgccuccccuagcguccaccccgcuaccccgaucucuccugggagagcguccggcaugaccacacugagcgccgagcucucuagccgccuguccacggcucccgaccuuaccgccuuuucugacccucggcaauuccccgcccugccuagcauuuccgaucccagaaugcauuauccgggggcuuuuacauacagcccuacccccguuacaucuggaaucggcauuggcauguccgccauggggagcgcgacccgcuaucacacguaccugcccccuccguaccccggaucuucccaggcucagggcgggccuuuccaagccagcucccccucuuaucaucucuacuauggagccagcgcuggcuccuaccaguuuucuauggugggaggagaacggagcccucccagaauccuuccucccugcacaaaugccuccaccggcagcgcucugcucaacccgucucugccuaaucaguccgacguggucgaggccgagggcagccacucuaacucccccaccaauauggcgccuagcgcccgccuggaagaggcuguguggcggcccuauuga

SEQ ID NO: 3366 - protein, 359 aa, Artificial Sequence [sequence omitted]

SEQ ID NO: 3367 - RNA, 1080 nt, Artificial Sequence
  S-100__Homo_sapiens__ACI46041
augccgcuggagcuggagcugugucccgggcgcugggugggcgggcaacacccgugcuucaucauugccgagaucggccagaaccaccagggcgaccuggacguagccaagcgcaugauccgcauggccaaggaguguggggcugauugugccaaguuccagaagagugagcuagaauucaaguuuaaucggaaagccuuggagaggccauacaccucgaagcauuccugggggaagacguacggggagcacaaacgacaucuggaguucagccaugaccaguacagggagcugcagagguacgccgaggagguugggaucuucuucacugccucuggcauggaugagauggcaguugaauuccugcaugaacugaauguuccauuuuucaaaguuggaucuggagacacuaauaauuuuccuuaucuggaaaagacagccaaaaaaggucgcccaauggugaucuccagugggaugcagucaauggacaccaugaagcaaguuuaucagaucgugaagccccucaaccccaacuucugcuucuugcaguguaccagcgcauacccgcuccagccugaggacgucaaccugcgggucaucucggaauaucagaagcucuuuccugacauucccauaggguauucugggcaugaaacaggcauagcgauaucuguggccgcaguggcucugggggccaagguguuggaacgucacauaacuuuggacaagaccuggaaggggagugaccacucggccucgcuggagccuggagaacuggccgagcuggugcggucagugcgucuuguggagcgugcccugggcuccccaaccaagcagcugcugcccugugagauggccugcaaugagaagcugggcaagucugugguggccaaagugaaaauuccggaaggcaccauucuaacaauggacaugcucaccgugaaggugggugagcccaaagccuauccuccugaagacaucuuuaaucuagugggcaagaagguccuggucacuguugaagaggaugacaccaucauggaagaauugguagauaaucauggcaaaaaaaucaagucuuaa

SEQ ID NO: 3368 - RNA, 1080 nt, Artificial Sequence
  derived and/or modified sequence opt1 from S-100__Homo_sapiens__ACI46041
augccccuggagcucgagcugugccccggccgcugggucgggggccagcaccccugcuucaucaucgccgagaucgggcagaaccaccagggcgaccuggacguggccaagcggaugauccgcauggcgaaggagugcggggccgacugcgccaaguuccagaaguccgagcucgaguucaaguucaaccggaaggcccuggagcgccccuacaccagcaagcacagcuggggcaagaccuacggcgagcacaagcggcaccuggaguucucccacgaccaguaccgcgagcuccagcgguacgccgaggagguggggaucuucuucacggcgagcggcauggacgagauggccguggaguuccugcacgagcugaacguccccuucuucaaggugggguccggcgacaccaacaacuucccguaccucgagaagaccgccaagaaggggcgccccauggugaucagcuccggcaugcagagcauggacaccaugaagcaggucuaccagaucgugaagccccugaaccccaacuucugcuuccugcagugcacguccgccuacccgcuccagcccgaggacgugaaccugcgggucaucagcgaguaccagaagcuguuccccgacauccccaucggcuacuccgggcacgagaccggcaucgcgaucagcguggccgccguggcccucggggccaagguccuggagcgccacaucacccuggacaagaccuggaagggcuccgaccacagcgcgucccucgagccgggcgagcuggccgagcuggugcggagcgugcgccucgucgagcgggcccuggggucccccacgaagcagcugcuccccugcgagauggccugcaacgagaagcugggcaagagcgugguggccaaggucaagauccccgaggggaccauccugaccauggacaugcucaccgugaaggugggcgagccgaaggcguacccgcccgaggacaucuucaaccuggucgggaagaaggugcuggugacggucgaggaggacgacaccaucauggaggagcucguggacaaccacggcaagaagaucaaguccuga

SEQ ID NO: 3369 - RNA, 1080 nt, Artificial Sequence
  derived and/or modified sequence opt2 from S-100__Homo_sapiens__ACI46041
augccccucgagcucgagcucugccccggccgcugggucggcggccagcaccccugcuucaucaucgccgagaucggccagaaccaccagggcgaccucgacgucgccaagcgcaugauccgcauggccaaggagugcggcgccgacugcgccaaguuccagaaguccgagcucgaguucaaguucaaccgcaaggcccucgagcgccccuacaccuccaagcacuccuggggcaagaccuacggcgagcacaagcgccaccucgaguucucccacgaccaguaccgcgagcuccagcgcuacgccgaggaggucggcaucuucuucaccgccuccggcauggacgagauggccgucgaguuccuccacgagcucaacguccccuucuucaaggucggcuccggcgacaccaacaacuuccccuaccucgagaagaccgccaagaagggccgccccauggucaucuccuccggcaugcaguccauggacaccaugaagcaggucuaccagaucgucaagccccucaaccccaacuucugcuuccuccagugcaccuccgccuacccccuccagcccgaggacgucaaccuccgcgucaucuccgaguaccagaagcucuuccccgacauccccaucggcuacuccggccacgagaccggcaucgccaucuccgucgccgccgucgcccucggcgccaagguccucgagcgccacaucacccucgacaagaccuggaagggcuccgaccacuccgccucccucgagcccggcgagcucgccgagcucguccgcuccguccgccucgucgagcgcgcccucggcucccccaccaagcagcuccuccccugcgagauggccugcaacgagaagcucggcaaguccgucgucgccaaggucaagauccccgagggcaccauccucaccauggacaugcucaccgucaaggucggcgagcccaaggccuacccccccgaggacaucuucaaccucgucggcaagaagguccucgucaccgucgaggaggacgacaccaucauggaggagcucgucgacaaccacggcaagaagaucaaguccuga

SEQ ID NO: 3370 - RNA, 1080 nt, Artificial Sequence
  derived and/or modified sequence opt3 from S-100__Homo_sapiens__ACI46041
augccccuggagcucgaacuuugcccuggcagaugggucgggggacagcacccauguuucaucauugccgagauaggucaaaaccaucagggcgaccuggauguggcuaagaggaugauccggauggcaaaagaaugcggggccgacugugcgaaguuucagaaaagcgaguuggaauuuaaguuuaaucgcaaggcuuuagagcgaccguacaccuccaagcacucuuggggaaagacauauggcgagcauaaacgucaccuggaguucucacaugaucaguacagagagcuacaaagguaugccgaagagguugguauuuucuucacugcaagugggauggacgagauggccguggaauuucuccacgagcugaacguacccuucuuuaaggugggaagcggcgauacgaauaacuucccuuaccuugagaaaaccgcuaagaaaggccggccaauggucaucuccucugggaugcagucgauggacacaaugaaacagguguaucagauuguuaagccccugaauccuaacuuuugcuucuugcaauguacuucagcauacccacuccagcccgaagaugugaaucugcgcgucaucagcgaauaucagaaacuguuuccugacauaccaaucggauacaguggucacgagaccggcauugccaucuccguggcugccguagcgcucggggcaaagguuuuagagagacauauuacacuggauaaaaccuggaagggaucugaccacagcgccucccuugaaccgggcgaguuggcugaacuggugaggucaguccggcuaguggagcgcgcccucgguagucccacuaaacagcugcuuccuugcgaaauggcauguaacgagaagcuggggaaaagcguggucgcuaagguuaagaucccagagggaacaauauugaccauggauaugcucacggugaaaguaggcgaacccaaggccuacccuccagaggacauuuucaaucuggugggcaaaaaggucuuagugacuguugaagaggaugacaccaucauggaagaacugguggacaaccaugggaaaaagauuaagucuuga

SEQ ID NO: 3371 - RNA, 1080 nt, Artificial Sequence
  derived and/or modified sequence opt4 from S-100__Homo_sapiens__ACI46041
augccccuggagcuggagcugugccccggcagaugggugggcggccagcaccccugcuucaucaucgccgagaucggccagaaccaccagggcgaccuggacguggccaagagaaugaucagaauggccaaggagugcggcgccgacugcgccaaguuccagaagagcgagcuggaguucaaguucaacagaaaggcccuggagagacccuacaccagcaagcacagcuggggcaagaccuacggcgagcacaagagacaccuggaguucagccacgaccaguacagagagcugcagagauacgccgaggaggugggcaucuucuucaccgccagcggcauggacgagauggccguggaguuccugcacgagcugaacgugcccuucuucaaggugggcagcggcgacaccaacaacuuccccuaccuggagaagaccgccaagaagggcagacccauggugaucagcagcggcaugcagagcauggacaccaugaagcagguguaccagaucgugaagccccugaaccccaacuucugcuuccugcagugcaccagcgccuacccccugcagcccgaggacgugaaccugagagugaucagcgaguaccagaagcuguuccccgacauccccaucggcuacagcggccacgagaccggcaucgccaucagcguggccgccguggcccugggcgccaaggugcuggagagacacaucacccuggacaagaccuggaagggcagcgaccacagcgccagccuggagcccggcgagcuggccgagcuggugagaagcgugagacugguggagagagcccugggcagccccaccaagcagcugcugcccugcgagauggccugcaacgagaagcugggcaagagcgugguggccaaggugaagauccccgagggcaccauccugaccauggacaugcugaccgugaaggugggcgagcccaaggccuacccccccgaggacaucuucaaccuggugggcaagaaggugcuggugaccguggaggaggacgacaccaucauggaggagcugguggacaaccacggcaagaagaucaagagcuga

SEQ ID NO: 3372 - RNA, 1080 nt, Artificial Sequence
  derived and/or modified sequence opt5 from S-100__Homo_sapiens__ACI46041
augccccuggagcucgaacugugcccuggcagaugggugggaggacagcacccguguuucaucauugccgagaucggccaaaaccaucagggggaccuugaugucgcuaagcggaugauucgcauggccaaagaaugcggagcggacugugcuaaguuucagaaaagcgagcuggaguucaaguuuaauagaaaagcccucgagcggcccuacaccuccaagcacucuuggggcaagacauauggggagcauaaacgccaccuggaguucagccaugaucaguacagagaacuucaacgguaugccgaagagguuggaaucuuuuucacggcuuccggcauggacgagauggccguggaauuucugcacgagcucaacgugccuuucuuuaaggucggcucuggggauaccaauaacuuccccuaccuggagaaaacagcuaagaaaggacgcccuauggugauuagcuccggcaugcagucuauggacaccaugaagcagguuuaucagaucgugaagccccugaauccuaacuuuugcuuccuccaauguacaagcgccuacccgcugcagcccgaagaugucaaucuuagagugaucuccgaauaucagaaacuguuuccugacauucccaucggguacagcggacacgagaccggcauugcgaucucuguugccgcuguggcccucggggcuaagguccuggagcggcauauuacacuugauaaaaccuggaagggauccgaccacagcgccucucuggaaccuggcgagcucgcggaacuggugcgcuccgugagacuggucgagcgggcccucggcagccccacgaaacagcugcuuccgugcgaaauggcuuguaacgagaagcuggggaaaucuguuguggccaaggugaagaucccugagggaaccauucucacaauggauaugcugaccgucaaagugggcgaacccaaggcuuacccucccgaggacaucuucaaucuuguugggaaaaaggugcuggucacaguggaagaggaugacaccaucauggaagaacucguugacaaccaugggaaaaagauuaaguccuga

SEQ ID NO: 3373 - protein, 904 aa, Artificial Sequence
  SAGE__Homo_sapiens__Q9NXZ1
MQASPLQTSQPTPPEELHAAAYVFTNDGQQMRSDEVNLVATGHQSKKKHSRKSKRHSSSKRRKSMSSWLDKQEDAAVTHSICEERINNGQPVADNVLSTAPPWPDATIAHNIREERMENGQSRTDKVLSTAPPQLVHMAAAGIPSMSTRDLHSTVTHNIREERMENGQPQPDNVLSTGPTGLINMAATPIPAMSARDLYATVTHNVCEQKMENVQPAPDNVLLTLRPRRINMTDTGISPMSTRDPYATITYNVPEEKMEKGQPQPDNILSTASTGLINVAGAGTPAISTNGLYSTVPHNVCEEKMENDQPQPNNVLSTVQPVIIYLTATGIPGMNTRDQYATITHNVCEERVVNNQPLPSNALSTVLPGLAYLATADMPAMSTRDQHATIIHNLREEKKDNSQPTPDNVLSAVTPELINLAGAGIPPMSTRDQYATVNHHVHEARMENGQRKQDNVLSNVLSGLINMAGASIPAMSSRDLYATITHSVREEKMESGKPQTDKVISNDAPQLGHMAAGGIPSMSTKDLYATVTQNVHEERMENNQPQPSYDLSTVLPGLTYLTVAGIPAMSTRDQYATVTHNVHEEKIKNGQAASDNVFSTVPPAFINMAATGVSSMSTRDQYAAVTHNIREEKINNSQPAPGNILSTAPPWLRHMAAAGISSTITRDLYVTATHSVHEEKMTNGQQAPDNSLSTVPPGCINLSGAGISCRSTRDLYATVIHDIQEEEMENDQTPPDGFLSNSDSPELINMTGHCMPPNALDSFSHDFTSLSKDELLYKPDSNEFAVGTKNYSVSAGDPPVTVMSLVETVPNTPQISPAMAKKINDDIKYQLMKEVRRFGQNYERIFILLEEVQGSMKVKRQFVEFTIKEAARFKKVVLIQQLEKALKEIDSHCHLRKVKHMRKR

SEQ ID NO: 3374 - RNA, 2715 nt, Artificial Sequence
  SAGE__Homo_sapiens__CCDS14652.1
augcaggcuucuccacuucaaacgagucaaccaacuccaccugaagaacuucaugcugcugccuauguguuuacaaaugaugggcagcaaaugaggagugaugaaguaaaucugguugcaacagggcaucaaagcaaaaagaaacauuccagaaaauccaagagacacucuucaucuaagagaaggaagaguauguccucgugguuagacaaacaggaagaugcugcagucacucacagcauuugugaagagaggauaaauaacggccaaccaguagcugauaaugucuugucaacugcuccaccauggccugaugcuaccaucgcucacaauauccgugaagagaggauggaaaauggccaaucucgaacugacaaagucuugucaacugcuccaccacagcuuguucauauggcugcagcugguauuccauccaugaguaccagggaucugcauucuaccgucacucacaauauccgugaagagagaauggaaaauggccaaccccaaccugauaacgucuugucaacuggucccacagggcuuauuaauauggcagcaacuccuauuccagccaugagugccagagaucucuaugcuacagucacucacaaugucugugaacagaagauggaaaauguccaaccagcaccugauaacguguuguugacucuucgaccacggcguauuaauaugacagacacugguauuucacccaugaguaccagggauccauaugcuaccaucacuuacaaugucccugaggagaagauggaaaagggccaaccccaaccugauaacaucuugucaacugcuucaacagggcuuauuaauguggcaggagcugguacuccagccaucagcaccaauggccuguauuccaccgucccucacaaugucugugaagagaagauggaaaaugaccaaccgcaaccuaauaacguauugucaacuguucaaccagugauuauuuauuugacagcaacugguauuccgggcaugaauaccagggaucaguaugcuaccaucacucacaaugucugugaagagagagugguaaauaaccaaccacuaccuaguaacgccuugucaacuguucuaccagggcuugcuuauuuggcaacagcugauaugccagccaugaguaccagggaucagcaugcuaccaucauucacaaucugcgugaagagaagaaagauaacagccaaccaaccccugauaacgucuugucagcuguuacaccagagcuuauuaacuuggcaggagcugguauuccacccaugaguaccagggaucaguaugcuaccgucaaucaccauguccaugaagcaaggauggaaaauggccaacgaaaacaggauaacgucuugucaaauguucuauccgggcuuauuaauauggcaggagcuaguauuccagcaaugaguuccagggaucuguaugcuaccauuacucacaguguucgugaagagaagauggaaaguggcaaaccccaaacugauaaggucauaucaaaugaugcaccacagcuuggucauauggcugcaggugguauuccauccaugaguaccaaggaucuguaugcuaccgucacucaaaauguccaugaagagaggauggaaaauaaccaaccacaaccuaguuaugacuugucaacuguucuaccaggacuuacuuauuugacaguagcugguauuccggccaugaguaccagggaucaguaugcuaccgucacucacaauguccaugaagagaagauuaaaaauggccaagcagcauccgauaaugucuucucgacuguuccaccagcauuuauuaauauggcagcaacugguguuucauccaugaguaccagggaucaguaugcugcagucacucacaacauccgugaagagaagauaaauaacagccaaccagcaccugguaacaucuugucaacugcuccuccauggcuucgucauauggcagcagcuggaauuucauccacgauuaccagggaucuguaugucaccgccacucacaguguccaugaggagaagaugacaaauggccaacaggcaccugauaacuccuugucaacgguuccaccugguuguauuaaucugucaggagcugguauuucaugcagaaguaccagggaucuguaugcuacugucauucacgauauccaggaggaggagauggaaaaugaucaaaccccuccugauggcuuccugucaaauucugauucaccagagcugauaaauaugacaggacauuguaugccacccaaugcauuggauucuuucucucacgacuucacaagucucagcaaagaugagcugcuuuacaaaccugauaguaaugaauuugcgguaggcaccaaaaacuacagugucucugcaggugacccaccaguuacaguaaugucuuugguggaaacugugccaaauacaccacaaauaucuccugccauggcaaagaaaauuaaugaugauauaaaauaucaauuaaugaaagaaguucgaagguuugggcaaaauuaugaaagaauuuucauuuugcuugaagagguacaaggaucuaugaaagucaagagacaauuuguugaauuuaccaucaaggaagcagcaagguuuaaaaaaguugucuuaauucagcaacucgagaaggcgcuuaaagaaauagauucccacugccaucucagaaaaguuaagcacaugagaaaaagauaa

SEQ ID NO: 3375 - RNA, 2715 nt, Artificial Sequence
  derived and/or modified sequence opt1 from SAGE__Homo_sapiens__CCDS14652.1
augcaggccagcccccugcagaccucccagcccaccccgcccgaggagcugcacgccgcggccuacguguucaccaacgacggccagcagaugcgcagcgacgaggucaaccugguggccaccgggcaccaguccaagaagaagcacagccggaaguccaagcgccacagcuccagcaagcggcgcaaguccaugagcuccuggcuggacaagcaggaggacgccgccgugacccacagcaucugcgaggagcggaucaacaacggccagcccgucgcggacaacgugcucuccaccgccccgcccuggcccgacgccacgaucgcccacaacauccgcgaggagcggauggagaacgggcagagccgcaccgacaaggugcuguccaccgcgcccccgcagcugguccacauggccgccgccggcauccccagcauguccacccgggaccuccacagcacggugacccacaacauccgcgaggagcggauggagaacgggcagccccagcccgacaacgugcuguccaccggcccgaccggccugaucaacauggccgcgacgcccauccccgccaugagcgcccgcgaccucuacgccaccgucacccacaacgugugcgagcagaagauggagaacgugcagcccgccccggacaacguccugcugacccuccggccccgccggaucaacaugacggacaccgggaucagccccauguccacccgcgaccccuacgcgaccaucacguacaacgugccggaggagaagauggagaagggccagccccagcccgacaacauccugagcaccgccuccaccgggcugaucaacguggccggcgccgggacccccgccaucagcacgaacggccucuacuccaccgucccgcacaacgugugcgaggagaagauggagaacgaccagccccagcccaacaacgugcugagcaccguccagcccgugaucaucuaccugaccgcgacgggcauccccgggaugaacacccgggaccaguacgccaccaucacccacaacgugugcgaggagcgcgucgugaacaaccagccccuccccuccaacgcccugagcacggugcugccgggccucgccuaccuggccaccgcggacaugcccgccauguccacccgggaccagcacgccaccaucauccacaaccugcgcgaggagaagaaggacaacagccagcccacgcccgacaacguccucuccgccgugaccccggagcugaucaaccuggcgggggccggcaucccgcccaugagcacccgggaccaguacgccaccgucaaccaccacgugcacgaggcccgcauggagaacggccagcgcaagcaggacaacgugcucuccaacguccugagcgggcugaucaacauggccggcgcguccauccccgccaugagcucccgggaccucuacgccaccaucacgcacagcgugcgcgaggagaagauggaguccgggaagccccagaccgacaaggugaucagcaacgacgcgccccagcugggccacauggccgccgggggcauccccagcauguccaccaaggaccuguacgccaccgucacgcagaacgugcacgaggagcggauggagaacaaccagccccagccgagcuacgaccucuccaccgugcugcccggccugaccuaccucaccgucgccgggauccccgccaugagcacgcgcgaccaguacgccaccgugacccacaacgugcacgaggagaagaucaagaacggccaggcggccuccgacaacgucuucagcaccgugcccccggccuucaucaacauggccgcgacggggguguccagcauguccacccgggaccaguacgccgccgucacccacaacauccgcgaggagaagaucaacaacagccagcccgcccccggcaacauccuguccaccgcgccgcccuggcugcggcacauggccgccgccgggaucagcuccacgaucacccgcgaccucuacgugaccgccacccacagcgugcacgaggagaagaugacgaacggccagcaggcccccgacaacucccugagcaccgucccgcccggcugcaucaaccuguccggggcgggcaucagcugccggagcacccgcgaccucuacgccaccgugauccacgacauccaggaggaggagauggagaacgaccagacgccgcccgacggguuccuguccaacagcgacucccccgagcugaucaacaugaccggccacugcaugccgcccaacgcccucgacagcuucucccacgacuucaccagccuguccaaggacgagcugcucuacaagcccgacagcaacgaguucgccguggggaccaagaacuacuccgucagcgccggcgacccgcccgugacggugaugucccuggucgagaccgugcccaacacgccccagaucagccccgcgauggccaagaagaucaacgacgacaucaaguaccagcugaugaaggaggugcggcgcuucggccagaacuacgagcggaucuucauccugcucgaggagguccagggguccaugaaggugaagcgccaguucguggaguucaccaucaaggaggccgcccgguucaagaaggucgugcugauccagcagcuggagaaggcgcucaaggagaucgacagccacugccaccuccgcaaggugaagcacaugcggaagcgcuga

SEQ ID NO: 3376 - RNA, 2715 nt, Artificial Sequence
  derived and/or modified sequence opt2 from SAGE__Homo_sapiens__CCDS14652.1
augcaggccuccccccuccagaccucccagcccaccccccccgaggagcuccacgccgccgccuacgucuucaccaacgacggccagcagaugcgcuccgacgaggucaaccucgucgccaccggccaccaguccaagaagaagcacucccgcaaguccaagcgccacuccuccuccaagcgccgcaaguccauguccuccuggcucgacaagcaggaggacgccgccgucacccacuccaucugcgaggagcgcaucaacaacggccagcccgucgccgacaacguccucuccaccgccccccccuggcccgacgccaccaucgcccacaacauccgcgaggagcgcauggagaacggccagucccgcaccgacaagguccucuccaccgcccccccccagcucguccacauggccgccgccggcauccccuccauguccacccgcgaccuccacuccaccgucacccacaacauccgcgaggagcgcauggagaacggccagccccagcccgacaacguccucuccaccggccccaccggccucaucaacauggccgccacccccauccccgccauguccgcccgcgaccucuacgccaccgucacccacaacgucugcgagcagaagauggagaacguccagcccgcccccgacaacguccuccucacccuccgcccccgccgcaucaacaugaccgacaccggcaucucccccauguccacccgcgaccccuacgccaccaucaccuacaacguccccgaggagaagauggagaagggccagccccagcccgacaacauccucuccaccgccuccaccggccucaucaacgucgccggcgccggcacccccgccaucuccaccaacggccucuacuccaccgucccccacaacgucugcgaggagaagauggagaacgaccagccccagcccaacaacguccucuccaccguccagcccgucaucaucuaccucaccgccaccggcauccccggcaugaacacccgcgaccaguacgccaccaucacccacaacgucugcgaggagcgcgucgucaacaaccagccccuccccuccaacgcccucuccaccguccuccccggccucgccuaccucgccaccgccgacaugcccgccauguccacccgcgaccagcacgccaccaucauccacaaccuccgcgaggagaagaaggacaacucccagcccacccccgacaacguccucuccgccgucacccccgagcucaucaaccucgccggcgccggcaucccccccauguccacccgcgaccaguacgccaccgucaaccaccacguccacgaggcccgcauggagaacggccagcgcaagcaggacaacguccucuccaacguccucuccggccucaucaacauggccggcgccuccauccccgccauguccucccgcgaccucuacgccaccaucacccacuccguccgcgaggagaagauggaguccggcaagccccagaccgacaaggucaucuccaacgacgccccccagcucggccacauggccgccggcggcauccccuccauguccaccaaggaccucuacgccaccgucacccagaacguccacgaggagcgcauggagaacaaccagccccagcccuccuacgaccucuccaccguccuccccggccucaccuaccucaccgucgccggcauccccgccauguccacccgcgaccaguacgccaccgucacccacaacguccacgaggagaagaucaagaacggccaggccgccuccgacaacgucuucuccaccgucccccccgccuucaucaacauggccgccaccggcgucuccuccauguccacccgcgaccaguacgccgccgucacccacaacauccgcgaggagaagaucaacaacucccagcccgcccccggcaacauccucuccaccgccccccccuggcuccgccacauggccgccgccggcaucuccuccaccaucacccgcgaccucuacgucaccgccacccacuccguccacgaggagaagaugaccaacggccagcaggcccccgacaacucccucuccaccgucccccccggcugcaucaaccucuccggcgccggcaucuccugccgcuccacccgcgaccucuacgccaccgucauccacgacauccaggaggaggagauggagaacgaccagaccccccccgacggcuuccucuccaacuccgacucccccgagcucaucaacaugaccggccacugcaugccccccaacgcccucgacuccuucucccacgacuucaccucccucuccaaggacgagcuccucuacaagcccgacuccaacgaguucgccgucggcaccaagaacuacuccgucuccgccggcgacccccccgucaccgucaugucccucgucgagaccguccccaacaccccccagaucucccccgccauggccaagaagaucaacgacgacaucaaguaccagcucaugaaggagguccgccgcuucggccagaacuacgagcgcaucuucauccuccucgaggagguccagggcuccaugaaggucaagcgccaguucgucgaguucaccaucaaggaggccgcccgcuucaagaaggucguccucauccagcagcucgagaaggcccucaaggagaucgacucccacugccaccuccgcaaggucaagcacaugcgcaagcgcuga

SEQ ID NO: 3377 - RNA, 2715 nt, Artificial Sequence
  derived and/or modified sequence opt3 from SAGE__Homo_sapiens__CCDS14652.1
augcaggccagcccccugcaaaccucccagccuacaccaccggaggaacuccacgcugcagccuacguguucacuaacgacggccagcagaugagaucugaugaggucaaucuuguugcgacggggcaucaaucaaagaaaaagcacaguaggaaaagcaagcggcauuccucuucgaaacgccgaaagucaaugagcaguuggcuggacaagcaggaagaugcugccgugacccacuccaucugcgaggaacguauuaacaauggacagcccguagcagacaacguguugucuacagccccuccauggcccgaugcuacuauagcacauaauaucagagaggagaggauggaaaacggucagagccggaccgacaaagucuuauccacagccccuccacaacuggugcacauggcugccgcgggcauucccucaaugaguacccgcgaucuacacagcacuguuacacauaauaucagagaggaaaggauggagaacgggcagccucagccagacaaugugcucucuaccggaccgacgggccugauuaacauggcagccacucccaucccugcuauguccgcccgggaucuuuaugcaaccgucacacacaaugugugugagcagaagauggaaaacguacaaccagcucccgacaauguucuguugacucuccgcccucgaagaauaaacaugaccgauacagguaucucaccaaugagcaccagggaccccuacgccacgauuacuuauaaugugccggaggagaaaauggagaaggggcagccucagcccgauaacauccugaguacagcgucuaccggacugauuaacgucgccggcgcaggcacuccagcuaucuccacaaaugggcucuacagcaccgugccucauaacgugugcgaagagaaaauggagaaugaccaaccccagccaaacaaugucuuaucgacgguucagcccgugauaauuuaucugaccgccacaggaaucccugguaugaacacucgggaccaguacgcuaccauuacacacaauguaugugaagaacguguggucaacaaucaaccacuuccgucuaacgccuuguccacugugcugcccggccuagcauaucucgccaccgcugauaugccugcgaugucaacacgcgaccagcacgcaaccaucauccauaaucugagagaagagaagaaggauaacagucagccaacucccgacaauguucuuagcgccgugacgccugaacugauuaacuuggcuggggccggaauaccacccauguccacaagggaucaguacgcaaccgucaaucaccaugugcacgaggcccggauggagaacggccaacgaaaacaggacaacguacucucuaauguucugagcgguuuaaucaacauggcuggggccucaauuccggcaaugaguucccgcgaucuguacgcgacuaucacccauagcgugagagaagagaagauggaaucuggaaaaccucagacagacaaggucauaucaaaugaugcuccacagcucggccacauggccgcaggcgggauucccaguaugagcaccaaagaccuuuaugccacugugacacaaaacguccacgaggaaaggauggagaauaaccagccucagcccuccuacgaucugucuacgguguugccaggacuaaccuaucugacuguugcugguaucccugccaugucgacacgggaccaguacgcaaccgugacacauaauguacacgaggaaaagaucaaaaacggccaagcugccagcgacaaugucuuuuccacugugcccccagcguucauuaacauggccgcuaccgggguuucaaguaugucuacgcgcgaucaguaugcagccgugacccauaauaucagagaggaaaagauuaacaauagccagccggcuccuggaaacauacucuccacagcacccccauggcugaggcacauggccgcggccggcaucucaagcacuauuacccgugaccuuuacgucacagcuacucacucugugcaugaggagaagaugaccaauggucaacaggcccccgauaacucccugaguacgguaccuccagggugcaucaacuugagcggcgcaggaaucucuugucgguccacacgagaccucuaugcuaccgugauucacgauauacaggaagaggaaauggagaaugaccagacucccccugauggcuuucugucaaacagugacagcccggaauuaaucaauaugacagggcauugcaugccacccaacgcccuggauucguucucccacgacuuuaccucucuaagcaaagaugagcuccuguacaagccugacucaaaugaguucgcaguuggaacuaaaaacuacagugucuccgccggugauccacccgugaccgugaugucucuugucgaaacaguuccuaauacgccgcaaauuagccccgcuauggcgaagaaaaucaacgacgacauuaaguaucaguugaugaaggaggugagaagguuuggccagaauuacgaacgcaucuucauacugcucgaggaagugcagggguccaugaaaguaaagcggcaauuugucgaguucaccaucaaagaggccgcaagauuuaagaaagugguucugauucagcagcuugaaaaggcucugaaggagaucgauucacauugucacuugaggaaagugaagcacaugcgcaaacgauga

SEQ ID NO: 3378 - RNA, 2715 nt, Artificial Sequence
  derived and/or modified sequence opt4 from SAGE__Homo_sapiens__CCDS14652.1
augcaggccagcccccugcagaccagccagcccaccccccccgaggagcugcacgccgccgccuacguguucaccaacgacggccagcagaugagaagcgacgaggugaaccugguggccaccggccaccagagcaagaagaagcacagcagaaagagcaagagacacagcagcagcaagagaagaaagagcaugagcagcuggcuggacaagcaggaggacgccgccgugacccacagcaucugcgaggagagaaucaacaacggccagcccguggccgacaacgugcugagcaccgccccccccuggcccgacgccaccaucgcccacaacaucagagaggagagaauggagaacggccagagcagaaccgacaaggugcugagcaccgcccccccccagcuggugcacauggccgccgccggcauccccagcaugagcaccagagaccugcacagcaccgugacccacaacaucagagaggagagaauggagaacggccagccccagcccgacaacgugcugagcaccggccccaccggccugaucaacauggccgccacccccauccccgccaugagcgccagagaccuguacgccaccgugacccacaacgugugcgagcagaagauggagaacgugcagcccgcccccgacaacgugcugcugacccugagacccagaagaaucaacaugaccgacaccggcaucagccccaugagcaccagagaccccuacgccaccaucaccuacaacgugcccgaggagaagauggagaagggccagccccagcccgacaacauccugagcaccgccagcaccggccugaucaacguggccggcgccggcacccccgccaucagcaccaacggccuguacagcaccgugccccacaacgugugcgaggagaagauggagaacgaccagccccagcccaacaacgugcugagcaccgugcagcccgugaucaucuaccugaccgccaccggcauccccggcaugaacaccagagaccaguacgccaccaucacccacaacgugugcgaggagagaguggugaacaaccagccccugcccagcaacgcccugagcaccgugcugcccggccuggccuaccuggccaccgccgacaugcccgccaugagcaccagagaccagcacgccaccaucauccacaaccugagagaggagaagaaggacaacagccagcccacccccgacaacgugcugagcgccgugacccccgagcugaucaaccuggccggcgccggcaucccccccaugagcaccagagaccaguacgccaccgugaaccaccacgugcacgaggccagaauggagaacggccagagaaagcaggacaacgugcugagcaacgugcugagcggccugaucaacauggccggcgccagcauccccgccaugagcagcagagaccuguacgccaccaucacccacagcgugagagaggagaagauggagagcggcaagccccagaccgacaaggugaucagcaacgacgccccccagcugggccacauggccgccggcggcauccccagcaugagcaccaaggaccuguacgccaccgugacccagaacgugcacgaggagagaauggagaacaaccagccccagcccagcuacgaccugagcaccgugcugcccggccugaccuaccugaccguggccggcauccccgccaugagcaccagagaccaguacgccaccgugacccacaacgugcacgaggagaagaucaagaacggccaggccgccagcgacaacguguucagcaccgugccccccgccuucaucaacauggccgccaccggcgugagcagcaugagcaccagagaccaguacgccgccgugacccacaacaucagagaggagaagaucaacaacagccagcccgcccccggcaacauccugagcaccgccccccccuggcugagacacauggccgccgccggcaucagcagcaccaucaccagagaccuguacgugaccgccacccacagcgugcacgaggagaagaugaccaacggccagcaggcccccgacaacagccugagcaccgugccccccggcugcaucaaccugagcggcgccggcaucagcugcagaagcaccagagaccuguacgccaccgugauccacgacauccaggaggaggagauggagaacgaccagaccccccccgacggcuuccugagcaacagcgacagccccgagcugaucaacaugaccggccacugcaugccccccaacgcccuggacagcuucagccacgacuucaccagccugagcaaggacgagcugcuguacaagcccgacagcaacgaguucgccgugggcaccaagaacuacagcgugagcgccggcgacccccccgugaccgugaugagccugguggagaccgugcccaacaccccccagaucagccccgccauggccaagaagaucaacgacgacaucaaguaccagcugaugaaggaggugagaagauucggccagaacuacgagagaaucuucauccugcuggaggaggugcagggcagcaugaaggugaagagacaguucguggaguucaccaucaaggaggccgccagauucaagaagguggugcugauccagcagcuggagaaggcccugaaggagaucgacagccacugccaccugagaaaggugaagcacaugagaaagagauga

SEQ ID NO: 3379 - RNA, 2715 nt, Artificial Sequence
  derived and/or modified sequence opt5 from SAGE__Homo_sapiens__CCDS14652.1
augcaggccagcccccugcaaaccucccagccuacaccgcccgaggaacuccacgcugccgcguacguguucacgaacgacggccagcagaugagaucugaugaggucaaucugguugcuaccgggcaccaaagcaagaaaaagcacucccggaaaucuaagcgccauagcuccucuaaaagacggaaaagcauguccagcuggcuugacaagcaggaagaugccgccgugacacacucuaucugcgaggaacgcauuaacaauggacagccuguggcugacaacguccuguccaccgcucccccuuggcccgaugccacaaucgcccauaauauuagagaggagcggauggaaaacggccagagccgcaccgacaaagugcucucuacagcgccuccgcaacugguucacauggccgcugccgggauccccuccaugagcaccagagaucuucacucuacggugacccauaauauucgggaggaacgcauggagaacggacagccucagcccgacaauguccuguccacaggcccuaccgggcucaucaacauggcugccacacccaucccggcgaugagcgccagagaucuguaugcuaccgugacgcacaauguuugugagcagaagauggaaaacgugcaaccugcccccgacaauguccugcucacacugcggccucgcagaauuaacaugaccgauacaggaaucucccccaugucuacccgggaccccuacgcuaccauuacauauaaugugccugaggaaaagauggagaagggccagccgcagcccgauaacauccuuagcacggccuccaccggccugauuaacguggccggggcuggaaccccugcgaucagcaccaauggccucuacucuacagucccccauaacguuugcgaagagaaaauggagaaugaccaaccucagcccaacaaugugcuguccaccgugcagccggucauuaucuaucuuacggccacagggaucccuggaaugaacacccgcgaccaguacgcuaccauuacacacaaugugugugaagagagaguugugaacaaucaaccccugccuagcaacgcccucucuaccguccugcccggccuggccuaucucgcuacagccgauaugccugcgaugagcacgcgggaccagcacgcuaccaucauucauaaucugagagaagagaagaaggauaacucccagcccacaccggacaaugugcuuucugccguuaccccugaacugaucaaccucgccggggcuggcauuccucccaugagcacacgcgaucaguacgccaccgugaaucaccauguccacgaggcucggauggagaacggacaaagaaaacaggacaacgugcuguccaauguccuuagcggccugaucaacauggccggggcgucuauccccgccauguccagccgcgaucucuacgcuacgauuacccauucugugcgggaagagaagauggaauccggaaaaccgcagacagacaagguuaucagcaaugaugcuccccagcugggccacauggccgccgggggcauuccuuccaugucuaccaaagaccuguaugcgacagugacccaaaacguccacgaggaaagaauggagaauaaccagccccagccuagcuacgaucucuccacggugcugcccggacuuacauaucugaccguugccgggaucccugcuaugucuacacgcgaccaguacgccaccgugacccauaauguccacgaggaaaagauuaaaaacggacaagcugccagcgacaauguguuuuccacagugcccccggccuucaucaacauggcugcgacgggcguuagcucuauguccacccgggaucaguaugccgcugucacacauaauaucagagaggaaaagauuaacaauagccagccugcccccggcaacauccucucuaccgccccucccuggcugcgccacauggcugccgcggggauuuccagcacaaucacccgggaccuuuacgugacggcuacacacucugugcaugaggagaagaugaccaauggacaacaggccccggauaacagccuguccaccgucccucccggcugcauuaaccucagcggggccggaaucucuuguagauccacacgcgaccuguaugcuaccgugauucacgauauccaggaagaggaaauggagaaugaccagacaccucccgauggcuuucugagcaacuccgacucucccgaacucaucaauaugacggggcauugcaugccuccgaacgcccuggauagcuucucccacgacuuuaccucucuuagcaaagaugagcugcucuacaagcccgacuccaaugaguucgcgguuggcaccaaaaacuacucugugagcgcuggagauccucccgucacagugaugucccugguugaaacagugccuaauacaccccaaauuagcccugccauggccaagaaaaucaacgacgacauuaaguaucagcugaugaaggagguccggagauuuggccagaauuacgaacggaucuucauucuucucgaggaagugcaggggucuaugaaaguuaagcgccaauuuguggaguucacgaucaaagaggcugccagauuuaagaaagucgugcugauccagcagcuggaaaaggcucucaaggagauugauucccauugucaucugcggaaagugaagcacaugagaaaacgcuga

SEQ ID NO: 3380 - protein, 800 aa, Artificial Sequence
  SART-_1__Homo_sapiens__O43290
MGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKLRAKLGLKPLEVNAIKKEAGTKEEPVTADVINPMALRQREELREKLAAAKEKRLLNQKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 3381 - RNA, 2403 nt, Artificial Sequence
  SART-_1__Homo_sapiens__AAH01058
auggggucguccaagaagcaucgcggagagaaggaggcggccgggacgacggcggcggccggcaccgggggugccaccgagcagccgccgcggcaccgggaacacaaaaaacacaagcaccggaguggcggcaguggcgguagcgguggcgaacgacggaagcggagccgggaacgugggggcgagcgcgggagcgggcggcgcggggccgaagcugaggcccggagcagcacgcacgggcgggagcgcagccaggcagagcccuccgagcggcgcgugaagcgggagaagcgcgaugacggcuacgaggccgcugccagcuccaaaacuagcucaggcgaugccuccucacucagcaucgaggagacuaacaaacuccgggcaaaguuggggcugaaacccuuggagguuaaugccaucaagaaggaggcgggcaccaaggaggagcccgugacagcugaugucaucaacccuauggccuugcgacagcgagaggagcugcgggagaagcuggcagcugccaaggagaagcgccugcugaaccaaaagcuggggaagauaaagacccuaggagaggaugaccccuggcuggacgacacugcagccuggaucgagaggagccggcagcugcagaaggagaaggaccuggcagagaagagggccaaguuacuggaggagauggaccaagaguuuggugucagcacucugguggaggaggaguucgggcagaggcggcaggaccuguacagugcccgggaccugcagggccucaccguggagcaugccauugauuccuuccgagaaggggagacaaugauucuuacccucaaggacaaaggcgugcugcaggaggaggaggacgugcuggugaacgugaaccugguggauaaggagcgggcagagaaaaauguggagcugcggaagaagaagccugacuaccugcccuaugccgaggacgagagcguggacgaccuggcgcagcaaaaaccucgcucuauccuguccaaguaugacgaagagcuugaaggggagcggccacauuccuuccgcuuggagcagggcggcacggcugauggccugcgggagcgggagcuggaggagauccgggccaagcugcggcugcaggcucagucccugagcacaguggggccccggcuggccuccgaauaccucacgccugaggagauggugaccuuuaaaaagaccaagcggagggugaagaaaauccgcaagaaggagaaggagguaguagugcgggcagaugacuugcugccucucggggaccagacucaggauggggacuuugguuccagacugcggggacggggucgccgccgaguguccgaaguggaggaggagaaggagccugugccucagccccugccgucggacgacacccgaguggagaacauggacaucagugaugaggaggaagguggagcuccaccgccgggguccccgcaggugcuggaggaggacgaggcggagcuggagcugcagaagcagcuggagaagggacgccggcugcgacaguuacagcagcuacagcagcugcgagacaguggcgagaaggugguggagauugugaagaagcuggagucucgccagcggggcugggaggaggaugaggaucccgagcggaagggggccaucguguucaacgccacguccgaguucugccgcaccuugggggagauccccaccuacgggcuggcuggcaaucgcgaggagcaggaggagcucauggacuuugaacgggaugaggagcgcucagccaacgguggcuccgaaucugacggggaggagaacaucggcuggagcacggugaaccuggacgaggagaagcagcagcaggauuucucugcuuccuccaccaccauccuggacgaggaaccgaucgugaauagggggcuggcagcugcccugcuccugugucagaacaaagggcugcuggagaccacagugcagaagguggcccgggugaaggcccccaacaagucgcugcccucagccguguacugcaucgaggauaagauggccaucgaugacaaguacagccggagggaggaauaccgaggcuucacacaggacuucaaggagaaggacggcuacaaacccgacguuaagaucgaauacguggaugagacgggccggaaacucacacccaaggaggcuuuccggcagcugucgcaccgcuuccauggcaagggcucaggcaagaugaagacagagcggcggaugaagaagcuggacgaggaggcgcuccugaagaagaugagcuccagcgacacgccccugggcaccguggcccugcuccaggagaagcagaaggcucagaagacccccuacaucgugcucagcggcagcggcaagagcaugaacgcgaacaccaucaccaaguga

SEQ ID NO: 3382 - RNA, 2403 nt, Artificial Sequence
  derived and/or modified sequence opt1 from SART-_1__Homo_sapiens__AAH01058
augggcagcuccaagaagcaccgcggggagaaggaggccgccggcaccaccgcggccgccgggacgggcggggccaccgagcagcccccgcggcaccgcgagcacaagaagcacaagcaccggagcggcggcuccgggggcagcgggggcgagcgccggaagcgcucccgggagcgcgggggcgagcggggcagcgggcgccggggcgccgaggcggaggcccgcuccagcacccacgggcgggagcgcucccaggccgagcccagcgagcggcgcgugaagcgggagaagcgcgacgacggcuacgaggccgcggccuccagcaagaccuccagcggcgacgccuccagccuguccaucgaggagacgaacaagcuccgggccaagcuggggcugaagccccucgaggucaacgccaucaagaaggaggcgggcaccaaggaggagcccgugaccgccgacgugaucaacccgauggcccugcgccagcgggaggagcugcgcgagaagcucgccgccgcgaaggagaagcgccugcugaaccagaagcucgggaagaucaagacccugggcgaggacgaccccuggcuggacgacacggccgccuggaucgagcggagccgccagcuccagaaggagaaggaccuggccgagaagcgggccaagcugcucgaggagauggaccaggaguucggggucuccacccugguggaggaggaguucggccagcgccggcaggaccuguacagcgcgcgcgaccuccagggccugaccguggagcacgccaucgacagcuuccgggagggggagaccaugauccugacgcucaaggacaagggcguccugcaggaggaggaggacgugcuggugaacgucaaccucguggacaaggagcgcgccgagaagaacguggagcugcggaagaagaagcccgacuaccugcccuacgccgaggacgaguccgucgacgaccucgcccagcagaagccgcgcagcauccuguccaaguacgacgaggagcuggagggggagcggccccacagcuuccgccucgagcagggcgggaccgcggacggccugcgggagcgcgagcuggaggagauccgggccaagcuccgccugcaggcccagucccugagcaccgugggcccccggcucgccuccgaguaccugacccccgaggagauggugacguucaagaagaccaagcgccgggucaagaagauccgcaagaaggagaaggagguggugguccgcgcggacgaccugcucccgcugggggaccagacccaggacggcgacuucgggagccggcugcgcggccgggggcgccggcgcguguccgagguggaggaggagaaggagcccgucccccagccccucccgagcgacgacacccggguggagaacauggacaucuccgacgaggaggagggcggcgccccgccgcccgggagcccccaggugcuggaggaggacgaggccgagcuggagcuccagaagcagcuggagaagggccgccggcugcgccagcuccagcagcugcagcagcugcgggacuccggggagaaggucguggagaucgucaagaagcuggagagccgccagcggggcugggaggaggacgaggaccccgagcgcaagggcgccaucguguucaacgccacguccgaguucugccggacccucggggagauccccaccuacggccuggcggggaaccgcgaggagcaggaggagcugauggacuucgagcgggacgaggagcgcagcgccaacggcggguccgagagcgacggcgaggagaacaucggcugguccaccgugaaccucgacgaggagaagcagcagcaggacuucagcgccagcuccacgaccauccuggacgaggagcccaucgucaaccgggggcuggccgccgcgcuccugcugugccagaacaagggccuccuggagaccaccgugcagaagguggcccgcgucaaggcccccaacaagagccugcccuccgccguguacugcaucgaggacaagauggccaucgacgacaaguacagccggcgcgaggaguaccgcggguucacgcaggacuucaaggagaaggacggcuacaagcccgacgugaagaucgaguacgucgacgagaccgggcggaagcucacccccaaggaggcguuccgccagcugucccaccgguuccacggcaagggcagcgggaagaugaagaccgagcgccggaugaagaagcuggacgaggaggcccuccugaagaagauguccagcuccgacacgccgcugggcaccguggcccuccugcaggagaagcagaaggcccagaagacccccuacaucgugcugagcggguccggcaagagcaugaacgcgaacaccaucacgaaguga

SEQ ID NO: 3383 - RNA, 2403 nt, Artificial Sequence
  derived and/or modified sequence opt2 from SART-_1__Homo_sapiens__AAH01058
augggcuccuccaagaagcaccgcggcgagaaggaggccgccggcaccaccgccgccgccggcaccggcggcgccaccgagcagcccccccgccaccgcgagcacaagaagcacaagcaccgcuccggcggcuccggcggcuccggcggcgagcgccgcaagcgcucccgcgagcgcggcggcgagcgcggcuccggccgccgcggcgccgaggccgaggcccgcuccuccacccacggccgcgagcgcucccaggccgagcccuccgagcgccgcgucaagcgcgagaagcgcgacgacggcuacgaggccgccgccuccuccaagaccuccuccggcgacgccuccucccucuccaucgaggagaccaacaagcuccgcgccaagcucggccucaagccccucgaggucaacgccaucaagaaggaggccggcaccaaggaggagcccgucaccgccgacgucaucaaccccauggcccuccgccagcgcgaggagcuccgcgagaagcucgccgccgccaaggagaagcgccuccucaaccagaagcucggcaagaucaagacccucggcgaggacgaccccuggcucgacgacaccgccgccuggaucgagcgcucccgccagcuccagaaggagaaggaccucgccgagaagcgcgccaagcuccucgaggagauggaccaggaguucggcgucuccacccucgucgaggaggaguucggccagcgccgccaggaccucuacuccgcccgcgaccuccagggccucaccgucgagcacgccaucgacuccuuccgcgagggcgagaccaugauccucacccucaaggacaagggcguccuccaggaggaggaggacguccucgucaacgucaaccucgucgacaaggagcgcgccgagaagaacgucgagcuccgcaagaagaagcccgacuaccuccccuacgccgaggacgaguccgucgacgaccucgcccagcagaagccccgcuccauccucuccaaguacgacgaggagcucgagggcgagcgcccccacuccuuccgccucgagcagggcggcaccgccgacggccuccgcgagcgcgagcucgaggagauccgcgccaagcuccgccuccaggcccagucccucuccaccgucggcccccgccucgccuccgaguaccucacccccgaggagauggucaccuucaagaagaccaagcgccgcgucaagaagauccgcaagaaggagaaggaggucgucguccgcgccgacgaccuccucccccucggcgaccagacccaggacggcgacuucggcucccgccuccgcggccgcggccgccgccgcgucuccgaggucgaggaggagaaggagcccgucccccagccccuccccuccgacgacacccgcgucgagaacauggacaucuccgacgaggaggagggcggcgcccccccccccggcuccccccagguccucgaggaggacgaggccgagcucgagcuccagaagcagcucgagaagggccgccgccuccgccagcuccagcagcuccagcagcuccgcgacuccggcgagaaggucgucgagaucgucaagaagcucgagucccgccagcgcggcugggaggaggacgaggaccccgagcgcaagggcgccaucgucuucaacgccaccuccgaguucugccgcacccucggcgagauccccaccuacggccucgccggcaaccgcgaggagcaggaggagcucauggacuucgagcgcgacgaggagcgcuccgccaacggcggcuccgaguccgacggcgaggagaacaucggcugguccaccgucaaccucgacgaggagaagcagcagcaggacuucuccgccuccuccaccaccauccucgacgaggagcccaucgucaaccgcggccucgccgccgcccuccuccucugccagaacaagggccuccucgagaccaccguccagaaggucgcccgcgucaaggcccccaacaagucccuccccuccgccgucuacugcaucgaggacaagauggccaucgacgacaaguacucccgccgcgaggaguaccgcggcuucacccaggacuucaaggagaaggacggcuacaagcccgacgucaagaucgaguacgucgacgagaccggccgcaagcucacccccaaggaggccuuccgccagcucucccaccgcuuccacggcaagggcuccggcaagaugaagaccgagcgccgcaugaagaagcucgacgaggaggcccuccucaagaagauguccuccuccgacaccccccucggcaccgucgcccuccuccaggagaagcagaaggcccagaagacccccuacaucguccucuccggcuccggcaaguccaugaacgccaacaccaucaccaaguga

SEQ ID NO: 3384 - RNA, 2403 nt, Artificial Sequence
  derived and/or modified sequence opt3 from SART-_1__Homo_sapiens__AAH01058
augggcagcuccaagaaacacagaggggagaaggaagccgcuggaaccacagcagccgcggguacuggcggggcuacggagcagcccccuaggcaucgggaacacaaaaagcauaaacaccgcucuggaggcucaggugggaguggaggcgagcgacguaagagaagcagggaacggggcggggagcgcggauccgguagaaggggcgccgaggcagaagcccggucuucgacccaugggcgcgagcgaucacaagcugaaccaagcgagagaagggugaagcgggagaaacgugacgauggauacgaagcagccgcuaguuccaagacaucuagcggcgacgccuccucacugaguaucgaggaaacuaacaaacuccgcgcgaaacuuggucugaaaccguuggaggucaaugcaauuaagaaggaagccgggaccaaagaggagcccguuacagcugaugugauaaacccuauggccuuaagacagagggaagaacugcgggaaaagcuagcagcugccaaagagaagcgacuccugaaucagaaacuuggaaagaucaaaacccugggcgaagacgauccaugguuggacgauacugcggccuggauugagcgcagcagacagcuccaaaaggagaaggaccuggcagaaaagagggcuaagcugcucgaggaaauggaucaggaguucggcguaucuacauuaguggaagaggaguuugggcagcggcgccaggaccuguauuccgccagagaucuucaaggauugaccgucgaacacgcuaucgacucauucagggagggugaaacgaugauucugacucuaaaagauaagggcgugcuccaggaggaggaagacguucuggugaacgucaaucuuguggacaaagagcgugccgaaaagaacguagagcugcggaagaaaaagcccgauuacuugccuuaugcagaagacgagagcguugaugaccucgcccagcagaaaccacgaaguauccugucuaaguacgaugaggaauuagagggggaaagaccccacuccuuuaggcuggagcaaggaggcaccgcugacggucuccgcgaacgggagcuugaggaaauaagagcgaaacugagguugcaggcacagagccuaucgacaguggggccucgccuggccucugaguaucucacuccagaagagauggucaccuucaagaagacaaaacgacgggugaagaaaauccguaagaaagaaaaggagguggucguuagagcugaugaccugcuuccgcugggcgaucaaacccaggacggagauuuuggcuccagguugcgcgggcggggaagaaggcgagugucagagguagaagaggaaaaggagcccgugccucagccacuccccagugacgacacgcgcgucgagaauauggauauuagcgacgaagaggaagguggcgccccuccacccggguccccucaggugcuggaggaagaugaggcagaguuagaacugcaaaaacagcuagagaagggacggagacucaggcagcugcagcaacuucagcaguugcgugacucuggcgaaaaaguuguggagaucgucaagaaacuggaaagccgccagcgggguugggaggaggaugaagacccggagagaaagggggccauuguguucaacgcuacuucagaauuuugcaggacacucggcgagauccccaccuacggacuggccggcaaucgagaagaacaagaggaacuuauggauuucgagcgggacgaggagcgcagugcaaacgggggauccgagagcgauggugaagagaauauaggcuggucuacuguaaaccuggacgaagagaaacagcagcaggauuuuucagcgaguagcacaaccauuuuggacgaggagccaaucguuaauagagggcucgcugccgcacuguuacugugucaaaacaagggacuacucgagacgaccgugcagaaggucgccagggugaaagcuccuaauaagucccugcccucugccgucuauugcauugaagauaaaauggcaaucgacgacaaguacucgcggcgagaggaauacagaggcuucacacaggauuuuaaagagaaggacgguuauaagccagaugugaaaaucgaauacguugacgagacugggcgcaaacuuacccccaaggaggcuuucaggcaauugagccaucguuuucacggcaagggauccggcaaaaugaagacagaacggagaaugaagaaacuggaugaggaagcccuccugaagaaaaugucaaguucugacacuccuuuagggaccguggcgcugcuucaggagaagcagaaagcccagaagacaccauauauuguauugagcggauccggcaagucaaugaacgcuaacaccauaacuaaauga

SEQ ID NO: 3385 - RNA, 2403 nt, Artificial Sequence
  derived and/or modified sequence opt4 from SART-_1__Homo_sapiens__AAH01058
augggcagcagcaagaagcacagaggcgagaaggaggccgccggcaccaccgccgccgccggcaccggcggcgccaccgagcagccccccagacacagagagcacaagaagcacaagcacagaagcggcggcagcggcggcagcggcggcgagagaagaaagagaagcagagagagaggcggcgagagaggcagcggcagaagaggcgccgaggccgaggccagaagcagcacccacggcagagagagaagccaggccgagcccagcgagagaagagugaagagagagaagagagacgacggcuacgaggccgccgccagcagcaagaccagcagcggcgacgccagcagccugagcaucgaggagaccaacaagcugagagccaagcugggccugaagccccuggaggugaacgccaucaagaaggaggccggcaccaaggaggagcccgugaccgccgacgugaucaaccccauggcccugagacagagagaggagcugagagagaagcuggccgccgccaaggagaagagacugcugaaccagaagcugggcaagaucaagacccugggcgaggacgaccccuggcuggacgacaccgccgccuggaucgagagaagcagacagcugcagaaggagaaggaccuggccgagaagagagccaagcugcuggaggagauggaccaggaguucggcgugagcacccugguggaggaggaguucggccagagaagacaggaccuguacagcgccagagaccugcagggccugaccguggagcacgccaucgacagcuucagagagggcgagaccaugauccugacccugaaggacaagggcgugcugcaggaggaggaggacgugcuggugaacgugaaccugguggacaaggagagagccgagaagaacguggagcugagaaagaagaagcccgacuaccugcccuacgccgaggacgagagcguggacgaccuggcccagcagaagcccagaagcauccugagcaaguacgacgaggagcuggagggcgagagaccccacagcuucagacuggagcagggcggcaccgccgacggccugagagagagagagcuggaggagaucagagccaagcugagacugcaggcccagagccugagcaccgugggccccagacuggccagcgaguaccugacccccgaggagauggugaccuucaagaagaccaagagaagagugaagaagaucagaaagaaggagaaggaggugguggugagagccgacgaccugcugccccugggcgaccagacccaggacggcgacuucggcagcagacugagaggcagaggcagaagaagagugagcgagguggaggaggagaaggagcccgugccccagccccugcccagcgacgacaccagaguggagaacauggacaucagcgacgaggaggagggcggcgcccccccccccggcagcccccaggugcuggaggaggacgaggccgagcuggagcugcagaagcagcuggagaagggcagaagacugagacagcugcagcagcugcagcagcugagagacagcggcgagaaggugguggagaucgugaagaagcuggagagcagacagagaggcugggaggaggacgaggaccccgagagaaagggcgccaucguguucaacgccaccagcgaguucugcagaacccugggcgagauccccaccuacggccuggccggcaacagagaggagcaggaggagcugauggacuucgagagagacgaggagagaagcgccaacggcggcagcgagagcgacggcgaggagaacaucggcuggagcaccgugaaccuggacgaggagaagcagcagcaggacuucagcgccagcagcaccaccauccuggacgaggagcccaucgugaacagaggccuggccgccgcccugcugcugugccagaacaagggccugcuggagaccaccgugcagaagguggccagagugaaggcccccaacaagagccugcccagcgccguguacugcaucgaggacaagauggccaucgacgacaaguacagcagaagagaggaguacagaggcuucacccaggacuucaaggagaaggacggcuacaagcccgacgugaagaucgaguacguggacgagaccggcagaaagcugacccccaaggaggccuucagacagcugagccacagauuccacggcaagggcagcggcaagaugaagaccgagagaagaaugaagaagcuggacgaggaggcccugcugaagaagaugagcagcagcgacaccccccugggcaccguggcccugcugcaggagaagcagaaggcccagaagacccccuacaucgugcugagcggcagcggcaagagcaugaacgccaacaccaucaccaaguga

SEQ ID NO: 3386 - RNA, 2403 nt, Artificial Sequence
  derived and/or modified sequence opt5 from SART-_1__Homo_sapiens__AAH01058
augggcagcuccaagaaacacagaggggagaaggaagccgcuggaaccacagccgcggcuggcaccgggggagccacggagcagcccccucggcaucgcgaacacaaaaagcauaaacacagaucuggcgggagcggaggcuccggcggggagcggcgcaagagaucucgggaacgcggaggcgagagagggagcggacggcgcggcgccgaggcugaagccagauccucuacacaugggcgggagcgcagccaagcugaaccguccgagagacgggugaagcgcgagaaaagagacgauggauacgaagccgcggccagcucuaagaccuccagcggcgacgcuucuucccugagcaucgaggaaacaaacaaacuccgggccaagcugggccuuaaaccccuggaggucaaugcuauuaagaaggaagccgggaccaaagaggagccuguuacagcggaugugaucaaccccauggcccucagacagcgcgaagaacugcgggaaaaacuugcugccgcuaaagagaagagacugcucaaucagaaacugggaaagauuaaaacccugggcgaagacgauccuuggcucgacgauacggccgccuggaucgagcgcucucggcagcugcaaaaggagaaggaccuugcugaaaagagagcgaagcugcucgaggaaauggaucaggaguucgggguguccacccuggucgaagaggaguuuggacagcgccggcaggaccuuuauagcgccagagaucugcaaggccucacaguggaacacgcuauugacuccuuccgcgagggggaaaccaugauccugacacugaaagauaagggaguucuccaggaggaggaagacgugcuggucaacgugaaucuuguugacaaagagcgggccgaaaagaacguggagcugagaaagaaaaagcccgauuaccucccuuaugccgaagacgagucugucgaugaccuggcucagcagaaaccgcgcagcauccuuuccaaguacgaugaggaacuggagggcgaacggccccacagcuuuagacucgagcaaggcgggaccgccgacggacugcgggaacgcgagcuggaggaaauuagagcgaaacuccggcugcaggcucagucucuuuccacggugggcccuagacuggccagcgaguaucucacacccgaagagauggugaccuucaagaagacaaaacgccgggucaagaaaaucagaaagaaagaaaaggagguuguggugcgcgccgaugaccugcuuccucugggggaucaaacccaggacggagauuuuggcucuagacuccgggggcgcggcagacggcgcgucagcgagguggaagaggaaaaggagcccguuccgcagccucugcccuccgacgacaccagaguggagaauauggauauuucugacgaagaggaaggaggcgcuccuccucccgggagcccccagguccuggaggaagaugaggccgagcucgaacugcaaaaacagcuugagaagggacggcgccugagacagcuccagcaacugcagcagcugcgggacuccggcgaaaaagugguugagaucgugaagaaacuugaaagccgccagagagggugggaggaggaugaagacccggagcggaagggagcuauugucuucaacgccacaucugaauuuugcagaacgcucggcgagauccccaccuacgggcuggcgggcaaucgcgaggagcaagaggaacugauggauuucgagcgggacgaagagagauccgccaacggaggcagcgagucugauggggaagagaauauuggaugguccacagugaaccucgacgaagagaaacagcagcaggauuuuagcgcuuccucuaccacaauccuggacgaggaaccuaucgucaaucgcggccuugccgcugcccugcuccugugucaaaacaaggggcugcuugagaccacggugcagaagguugcgcgggugaaagcccccaauaagagccucccuuccgcugucuauugcauugaagauaaaauggccaucgacgacaaguacucuagacgcgaggaauaccggggauucacacaggauuuuaaagagaaggacggcuauaagcccgaugugaaaauugaauacguugacgagaccgggagaaagcugaccccgaaagaggcuuuccgccaacugagccaucgguuucacggcaagggauccggcaaaaugaagacagaaagacggaugaagaaacucgaugaggaagcccugcuuaagaaaaugucuagcuccgacaccccucuggggacaguggcccuccugcaggagaagcagaaagcucagaagacgcccuauaucguccugagcggaucuggcaaguccaugaacgcgaacaccauuacaaaauga

SEQ ID NO: 3387 - protein, 958 aa, Artificial Sequence [sequence omitted]

SEQ ID NO: 3388 - RNA, 2877 nt, Artificial Sequence
  SART-2__Homo_sapiens__AAF00087
augaggacucacacacggggggcucccaguguguuuuucauauauuugcuuugcuuugugucagccuacaucaccgacgagaacccagaaguuaugauucccuucaccaaugccaacuacgacagccaucccaugcuguacuucuccagggcagaaguggcggagcugcagcucagggcugccagcucgcacgagcacauugcagcccgccucacggaggcugugcacacgaugcuguccagccccuuggaauaccucccucccugggaucccaaggacuacagugcccgcuggaaugaaauuuuuggaaacaacuugggugccuuggcaauguucugugugcuguauccugagaacauugaagcccgagacauggccaaagacuacauggagaggauggcagcgcagccuaguugguuggugaaagaugcuccuugggaugaggucccgcuugcucacucccugguugguuuugccacugcuuaugacuucuuguacaacuaccugagcaagacacaacaggagaaguuucuugaagugauugccaaugccucaggguauauguaugaaacuucauacaggagaggauggggauuucaauaccugcacaaucaucagcccaccaacuguauggcuuugcucacgggaagccuaguccugaugaaucaaggauaucuucaagaagccuacuuauggaccaaacaaguucugaccaucauggagaaaucucuggucuugcucagggaggugacggauggcucccucuaugaaggaguugcguauggcagcuacaccacuagaucacucuuccaauacauguuucucguccagaggcacuucaacaucaaccacuuuggccauccguggcuuaaacaacacuuugcauuuauguauagaaccauccugccaggguuucaaaggacuguggcuauugcggacucaaauuacaacugguuuuaugguccagaaagccaauuaguguuccuugauaaauuugucaugcguaauggcagugguaacuggcuagcugaccaaaucagaaggaaccgugugguggaagguccaggaacaccauccaaagggcagcgcuggugcacucugcacacagaauuucucugguaugauggcagcuugaaaucgguuccuccuccagacuuuggcaccccuacacugcauuauuuugaagacuggggugucgugacuuauggaagugcacuaccugcagaaaucaauagaucuuuccuuuccuucaagucuggaaaacuggggggacgugcaauauaugacauuguccacagaaacaaauacaaagauuggaucaaaggauggagaaauuuuaaugcagggcaugaacauccugaucaaaacucauuuacuuuugcucccaauggugugccuuucauuacugaggcucuguacgggccaaaguacaccuucuucaacaauguuuugauguuuuccccagcugugucaaagagcugcuuuucucccugggugggucaggucacagaagacugcucaucaaaauggucuaaauacaagcaugaccuggcagcuaguugucaggggagggugguugcagcagaggagaaaaauggggugguuuucauccgaggagaaggugugggagcuuauaacccccagcucaaccugaagaauguucagaggaaucucauccuccuacauccacagcugcuucuccuuguagaccaaauacaccugggagaggagagucccuuggagacagcagcgagcuucuuccauaauguggauguuccuuuugaggagacugugguagaugguguccauggggcuuucaucaggcagagagauggucucuauaaaauguacuggauggacgauacuggcuacagcgagaaagcaaccuuugccucagugacauauccucggggcuaucccuacaacgggacaaacuaugugaaugucaccaugcaccuccgaagucccaucaccagggcagcuuaccucuucauagggccaucuauagauguucagagcuucacuguccacggagacucucagcaacuggauguguucauagccaccagcaaacaugccuacgccacauaccuguggacaggugaggccacaggacagucugccuuugcacaggucauugcugaucgucacaaaauucuguuugaccggaauucagccaucaagagcagcauugucccugaggugaaggacuaugcugcuauuguggaacagaacuugcagcauuuuaaaccaguguuucagcugcuggagaagcagauacugucccgaguccggaacacagcuagcuuuaggaagacugcugaacgccugcugagauuuucagauaagagacagacugaggaggccauugacaggauuuuugccauaucacagcaacagcagcagcaaagcaagucaaagaaaaaccgaagggcaggcaaacgcuauaaauuuguggaugcugucccugauauuuuugcacagauugaagucaaugagaaaaagauuagacagaaagcucagauuuuggcacagaaagaacuacccauagaugaagaugaagaaaugaaagaccuuuuagauuuugcagauguaacauacgagaaacauaaaaaugggggcuugauuaaaggccgguuuggacaggcacggauggugacaacuacacacagcagggccccaucacugucugcuuccuauaccagguuguuccugauucugaacauugcuauuuucuuugucauguuggcaaugcaacugacuuauuuccagagggcccagagccuacauggccaaagaugucuuuaugcaguucuucucauagauagcuguauuuuauuaugguuguacucuucuuguucccaaucacaguguuag

SEQ ID NO: 3389 - RNA, 2877 nt, Artificial Sequence
  derived and/or modified sequence opt1 from SART-2__Homo_sapiens__AAF00087
augcgcacccacacccggggcgcccccagcguguucuucaucuaccugcucugcuucgucuccgccuacaucacggacgagaacccggaggugaugauccccuucaccaacgcgaacuacgacagccaccccaugcuguacuucucccgcgccgagguggccgagcugcagcuccgggccgccagcucccacgagcacaucgcggcccgccugaccgaggccguccacaccaugcugagcagcccccucgaguaccugccgcccugggaccccaaggacuacuccgcccgguggaacgagaucuucgggaacaaccugggcgcgcucgccauguucugcgugcuguaccccgagaacaucgaggcccgcgacauggccaaggacuacauggagcggauggccgcgcagccguccuggcuggugaaggacgcccccugggacgaggucccccucgcccacagccuggugggguucgccacggccuacgacuuccuguacaacuaccucuccaagacccagcaggagaaguuccuggaggugaucgcgaacgccagcggcuacauguacgagaccuccuaccgccggggguggggcuuccaguaccugcacaaccaccagcccaccaacugcauggcccuccugacgggcagccugguccucaugaaccagggguaccugcaggaggccuaccuguggaccaagcagguccucaccaucauggagaagucccuggugcugcuccgcgaggugaccgacggcagccuguacgaggggguggccuacggcuccuacacgacccggagccuguuccaguacauguuccucgugcagcgccacuucaacaucaaccacuucgggcacccguggcugaagcagcacuucgcguucauguaccggaccauccugcccggcuuccagcgcaccgucgccaucgccgacuccaacuacaacugguucuacggccccgagagccagcucguguuccuggacaaguucgugaugcggaacgggagcggcaacuggcuggccgaccagauccgccggaaccgcgucguggaggggcccggcacgccguccaagggccagcgguggugcacccuccacaccgaguuccugugguacgacgggagccugaaguccgugcccccgcccgacuucggcacccccacgcuccacuacuucgaggacuggggcgucgugaccuacgggagcgcccugcccgcggagaucaaccgcuccuuccugagcuucaaguccgggaagcucggcggccgggccaucuacgacaucgugcaccgcaacaaguacaaggacuggaucaagggguggcgcaacuucaacgccggccacgagcaccccgaccagaacagcuucaccuucgcccccaacggggucccguucaucaccgaggcgcuguacggccccaaguacacguucuucaacaacgugcugauguucucccccgccgucagcaaguccugcuucagccccugggugggccaggugaccgaggacugcuccagcaagugguccaaguacaagcacgaccucgccgccagcugccaggggcgggucguggccgcggaggagaagaacggcguggucuucauccgcggggagggcgugggggccuacaacccgcagcugaaccugaagaacgugcagcggaaccucauccugcugcacccccagcugcuccugcuggucgaccagauccaccucggcgaggagagcccccuggagaccgccgccuccuucuuccacaacguggacgugccguucgaggagaccgucguggacggggugcacggcgccuucauccgccagcgggacggccuguacaagauguacuggauggacgacacgggguacuccgagaaggcgaccuucgccagcgucaccuacccccgcggcuaccccuacaacgggaccaacuacgugaacgugacgaugcaccuccggagccccaucacccgcgccgccuaccuguucaucggcccguccaucgacguccagagcuucaccgugcacggcgacucccagcagcuggacguguucaucgccaccagcaagcacgcguacgccacguaccucuggaccggggaggccaccggccaguccgccuucgcgcaggucaucgccgaccggcacaagauccuguucgaccgcaacagcgccaucaaguccagcaucgugcccgaggugaaggacuacgccgccaucgucgagcagaaccugcagcacuucaagcccguguuccagcuccuggagaagcagauccugucccgggugcgcaacaccgcgagcuuccggaagaccgccgagcgccuccugcgguucuccgacaagcgccagacggaggaggccaucgaccggaucuucgccaucagccagcagcagcagcagcaguccaagagcaagaagaaccgccgggccgggaagcgcuacaaguucgucgacgcggugcccgacaucuucgcccagaucgaggugaacgagaagaagauccgccagaaggcccagauccuggcccagaaggagcucccgaucgacgaggacgaggagaugaaggaccugcuggacuucgccgacgucaccuacgagaagcacaagaacggcgggcucaucaagggccgguucggccaggcgcgcauggugaccaccacgcacucccgggcccccagccuguccgccagcuacacccgccuguuccucauccugaacaucgccaucuucuucgugaugcuggcgaugcagcucaccuacuuccagcgggcccagagccugcacgggcagcgcugccuguacgccguccuccugaucgacuccugcauccugcucuggcuguacagcuccugcagccagucccagugcuga

SEQ ID NO: 3390 - RNA, 2877 nt, Artificial Sequence
  derived and/or modified sequence opt2 from SART-2__Homo_sapiens__AAF00087
augcgcacccacacccgcggcgcccccuccgucuucuucaucuaccuccucugcuucgucuccgccuacaucaccgacgagaaccccgaggucaugauccccuucaccaacgccaacuacgacucccaccccaugcucuacuucucccgcgccgaggucgccgagcuccagcuccgcgccgccuccucccacgagcacaucgccgcccgccucaccgaggccguccacaccaugcucuccuccccccucgaguaccucccccccugggaccccaaggacuacuccgcccgcuggaacgagaucuucggcaacaaccucggcgcccucgccauguucugcguccucuaccccgagaacaucgaggcccgcgacauggccaaggacuacauggagcgcauggccgcccagcccuccuggcucgucaaggacgcccccugggacgaggucccccucgcccacucccucgucggcuucgccaccgccuacgacuuccucuacaacuaccucuccaagacccagcaggagaaguuccucgaggucaucgccaacgccuccggcuacauguacgagaccuccuaccgccgcggcuggggcuuccaguaccuccacaaccaccagcccaccaacugcauggcccuccucaccggcucccucguccucaugaaccagggcuaccuccaggaggccuaccucuggaccaagcagguccucaccaucauggagaagucccucguccuccuccgcgaggucaccgacggcucccucuacgagggcgucgccuacggcuccuacaccacccgcucccucuuccaguacauguuccucguccagcgccacuucaacaucaaccacuucggccaccccuggcucaagcagcacuucgccuucauguaccgcaccauccuccccggcuuccagcgcaccgucgccaucgccgacuccaacuacaacugguucuacggccccgagucccagcucgucuuccucgacaaguucgucaugcgcaacggcuccggcaacuggcucgccgaccagauccgccgcaaccgcgucgucgagggccccggcacccccuccaagggccagcgcuggugcacccuccacaccgaguuccucugguacgacggcucccucaaguccguccccccccccgacuucggcacccccacccuccacuacuucgaggacuggggcgucgucaccuacggcuccgcccuccccgccgagaucaaccgcuccuuccucuccuucaaguccggcaagcucggcggccgcgccaucuacgacaucguccaccgcaacaaguacaaggacuggaucaagggcuggcgcaacuucaacgccggccacgagcaccccgaccagaacuccuucaccuucgcccccaacggcguccccuucaucaccgaggcccucuacggccccaaguacaccuucuucaacaacguccucauguucucccccgccgucuccaaguccugcuucucccccugggucggccaggucaccgaggacugcuccuccaagugguccaaguacaagcacgaccucgccgccuccugccagggccgcgucgucgccgccgaggagaagaacggcgucgucuucauccgcggcgagggcgucggcgccuacaacccccagcucaaccucaagaacguccagcgcaaccucauccuccuccacccccagcuccuccuccucgucgaccagauccaccucggcgaggaguccccccucgagaccgccgccuccuucuuccacaacgucgacguccccuucgaggagaccgucgucgacggcguccacggcgccuucauccgccagcgcgacggccucuacaagauguacuggauggacgacaccggcuacuccgagaaggccaccuucgccuccgucaccuacccccgcggcuaccccuacaacggcaccaacuacgucaacgucaccaugcaccuccgcucccccaucacccgcgccgccuaccucuucaucggccccuccaucgacguccaguccuucaccguccacggcgacucccagcagcucgacgucuucaucgccaccuccaagcacgccuacgccaccuaccucuggaccggcgaggccaccggccaguccgccuucgcccaggucaucgccgaccgccacaagauccucuucgaccgcaacuccgccaucaaguccuccaucguccccgaggucaaggacuacgccgccaucgucgagcagaaccuccagcacuucaagcccgucuuccagcuccucgagaagcagauccucucccgcguccgcaacaccgccuccuuccgcaagaccgccgagcgccuccuccgcuucuccgacaagcgccagaccgaggaggccaucgaccgcaucuucgccaucucccagcagcagcagcagcaguccaaguccaagaagaaccgccgcgccggcaagcgcuacaaguucgucgacgccguccccgacaucuucgcccagaucgaggucaacgagaagaagauccgccagaaggcccagauccucgcccagaaggagcuccccaucgacgaggacgaggagaugaaggaccuccucgacuucgccgacgucaccuacgagaagcacaagaacggcggccucaucaagggccgcuucggccaggcccgcauggucaccaccacccacucccgcgcccccucccucuccgccuccuacacccgccucuuccucauccucaacaucgccaucuucuucgucaugcucgccaugcagcucaccuacuuccagcgcgcccagucccuccacggccagcgcugccucuacgccguccuccucaucgacuccugcauccuccucuggcucuacuccuccugcucccagucccagugcuga

SEQ ID NO: 3391 - RNA, 2877 nt, Artificial Sequence
  derived and/or modified sequence opt3 from SART-2__Homo_sapiens__AAF00087
augagaacccacacaaggggcgcccccagcguguucuuuaucuaccugcucugcuucgucuccgcuuauauuacugacgagaacccugaaguuaugauaccauuuacgaaugcaaacuacgauucucauccgaugcuuuauuucucacgggccgagguggcggaacugcaguugcgcgcugccaguagccacgagcauaucgcagcccgauuaaccgaagcuguacacacaaugcuguccucuccccuagaguaccucccuccaugggaccccaaggauuauucggcacguuggaaugagauuuuugggaacaaucugggagcccuugcuauguucugugugcuguacccugaaaacaucgaggccagagacauggcgaaagauuauauggaaaggauggcagcccaaccaucaugguuggucaaggacgcucccugggaugaggugccucucgcccauagccugguugguuuugcaacugcuuacgacuuccuguacaauuaucucaguaaaacccagcaggagaaguuuuuagaagugauugccaacgcguccggcuacauguaugagacaucuuaccggcgcggguggggauuccaguaucugcacaaucaccaaccaaccaacugcauggcccuuuugacuggcagccugguccuaaugaaucaggguuaccuccaggaagcauaucuguggacaaaacaggugcuuaccaucauggagaagucccugguauugcucagagaaguuacggaugggucacuguacgagggaguggcuuacggcaguuauacuaccaggagcuuauuucaauacauguuccugguccagcggcauuuuaacauaaaucacuucggccauccguggcucaagcagcacuucgccuuuauguaucgcacaauccuucccggguuccagcgaacuguggcuauugccgacucuaacuacaauugguuuuauggaccugagucccaacugguguucuuggauaaauuugucaugagaaacgguucaggcaacuggcuagcagaccagaucaggcggaaucguguuguggaagggccaggaacccccagcaagggccagcgcugguguacacugcacaccgaguuccucugguacgaugguagucugaaaucuguaccuccacccgacuuugggacgccgacucuucauuauuucgaagacuggggaguggucacauacggcuccgcccugccugcugagauuaacagaucguuuuugagcuucaagucuggcaaacucgggggaagggcgaucuacgauauagugcaccggaauaaguauaaggacuggauuaaagguuggcgaaacuuuaaugcaggccaugaacaccccgaucaaaacuccuucaccuuugccccaaaugggguuccuuucaucacugaggcucuguacggacccaaguauacauucuuuaacaauguguuaauguucucaccagccgucaguaaaagcugcuuuucccccugggugggccagguaaccgaggacuguucuagcaaguggucaaaauacaagcaugaucuggcagccaguugccagggucgcguuguggcugccgaagagaaaaacggggucguguucauuagaggcgaaggagucggcgcauauaauccucagcuaaaccucaagaaugugcaaaggaaccugauccuuuugcacccacagcugcuccugcuuguugaccagauccaccugggggaggaauccccguuggagacggcggcuagcuuuuuccauaauguggauguacccuuugaggaaaccgucguggacggaguucacggugccuucauucggcagcgcgauggccucuacaagauguauuggauggacgauacaggguacucugagaaagcaacuuuugccucagugaccuacccuagaggauauccauacaacggcacaaacuaugucaaugugacuaugcaucugaggagucccauaacccgugcugccuacuuauucaucgguccuagcauugacguacaauccuuuacagugcacggggacucucagcagcuggauguuuucaucgcaaccucgaagcacgcuuaugccacuuaccuauggacgggcgaagcgacaggacagagcgccuuugcucaagucauagcagaccggcauaaaauucucuucgaucgaaacuccgccaucaagucaaguaucgugccagaggugaaagacuaugcugccauugucgagcagaaucugcagcacuucaagcccguuuuucagcuuuuggaaaagcaaauccugucuagagugaggaacaccgcgagcuuccgcaaaacugcagagcggcuccugagauuuuccgauaagaggcagaccgaagaggccauugaccgcauauucgcuaucucacagcaacagcagcagcaaagcaaaucuaagaaaaaucgacgggccggcaagcguuacaaguuuguggaugcaguaccggacauuuucgcucagaucgaagucaacgagaaaaagaucagacagaaagcccagauuuuagcacaaaaggagcugccuauagaugaagacgaggaaaugaaagaucuuuuggacuuugccgaugugacauacgagaagcauaagaaugggggacucaucaaagguagguucggccaggcucgcaugguuaccacuacacacucccgggcgccaagucugagcgccucuuauacgagacuauuucugauucucaacaucgcaauuuucuuugugaugcuggcuaugcagcuuaccuacuuccagagggcccaauccuugcaugggcagcgaugucuguaugccgucuuacucaucgacucaugcauacugcuuuggcuguacaguagcuguucgcagucccaaugcuga

SEQ ID NO: 3392 - RNA, 2877 nt, Artificial Sequence
  derived and/or modified sequence opt4 from SART-2__Homo_sapiens__AAF00087
augagaacccacaccagaggcgcccccagcguguucuucaucuaccugcugugcuucgugagcgccuacaucaccgacgagaaccccgaggugaugauccccuucaccaacgccaacuacgacagccaccccaugcuguacuucagcagagccgagguggccgagcugcagcugagagccgccagcagccacgagcacaucgccgccagacugaccgaggccgugcacaccaugcugagcagcccccuggaguaccugccccccugggaccccaaggacuacagcgccagauggaacgagaucuucggcaacaaccugggcgcccuggccauguucugcgugcuguaccccgagaacaucgaggccagagacauggccaaggacuacauggagagaauggccgcccagcccagcuggcuggugaaggacgcccccugggacgaggugccccuggcccacagccuggugggcuucgccaccgccuacgacuuccuguacaacuaccugagcaagacccagcaggagaaguuccuggaggugaucgccaacgccagcggcuacauguacgagaccagcuacagaagaggcuggggcuuccaguaccugcacaaccaccagcccaccaacugcauggcccugcugaccggcagccuggugcugaugaaccagggcuaccugcaggaggccuaccuguggaccaagcaggugcugaccaucauggagaagagccuggugcugcugagagaggugaccgacggcagccuguacgagggcguggccuacggcagcuacaccaccagaagccuguuccaguacauguuccuggugcagagacacuucaacaucaaccacuucggccaccccuggcugaagcagcacuucgccuucauguacagaaccauccugcccggcuuccagagaaccguggccaucgccgacagcaacuacaacugguucuacggccccgagagccagcugguguuccuggacaaguucgugaugagaaacggcagcggcaacuggcuggccgaccagaucagaagaaacagagugguggagggccccggcacccccagcaagggccagagauggugcacccugcacaccgaguuccugugguacgacggcagccugaagagcgugcccccccccgacuucggcacccccacccugcacuacuucgaggacuggggcguggugaccuacggcagcgcccugcccgccgagaucaacagaagcuuccugagcuucaagagcggcaagcugggcggcagagccaucuacgacaucgugcacagaaacaaguacaaggacuggaucaagggcuggagaaacuucaacgccggccacgagcaccccgaccagaacagcuucaccuucgcccccaacggcgugcccuucaucaccgaggcccuguacggccccaaguacaccuucuucaacaacgugcugauguucagccccgccgugagcaagagcugcuucagccccugggugggccaggugaccgaggacugcagcagcaaguggagcaaguacaagcacgaccuggccgccagcugccagggcagagugguggccgccgaggagaagaacggcgugguguucaucagaggcgagggcgugggcgccuacaacccccagcugaaccugaagaacgugcagagaaaccugauccugcugcacccccagcugcugcugcugguggaccagauccaccugggcgaggagagcccccuggagaccgccgccagcuucuuccacaacguggacgugcccuucgaggagaccgugguggacggcgugcacggcgccuucaucagacagagagacggccuguacaagauguacuggauggacgacaccggcuacagcgagaaggccaccuucgccagcgugaccuaccccagaggcuaccccuacaacggcaccaacuacgugaacgugaccaugcaccugagaagccccaucaccagagccgccuaccuguucaucggccccagcaucgacgugcagagcuucaccgugcacggcgacagccagcagcuggacguguucaucgccaccagcaagcacgccuacgccaccuaccuguggaccggcgaggccaccggccagagcgccuucgcccaggugaucgccgacagacacaagauccuguucgacagaaacagcgccaucaagagcagcaucgugcccgaggugaaggacuacgccgccaucguggagcagaaccugcagcacuucaagcccguguuccagcugcuggagaagcagauccugagcagagugagaaacaccgccagcuucagaaagaccgccgagagacugcugagauucagcgacaagagacagaccgaggaggccaucgacagaaucuucgccaucagccagcagcagcagcagcagagcaagagcaagaagaacagaagagccggcaagagauacaaguucguggacgccgugcccgacaucuucgcccagaucgaggugaacgagaagaagaucagacagaaggcccagauccuggcccagaaggagcugcccaucgacgaggacgaggagaugaaggaccugcuggacuucgccgacgugaccuacgagaagcacaagaacggcggccugaucaagggcagauucggccaggccagaauggugaccaccacccacagcagagcccccagccugagcgccagcuacaccagacuguuccugauccugaacaucgccaucuucuucgugaugcuggccaugcagcugaccuacuuccagagagcccagagccugcacggccagagaugccuguacgccgugcugcugaucgacagcugcauccugcuguggcuguacagcagcugcagccagagccagugcuga

SEQ ID NO: 3393 - RNA, 2877 nt, Artificial Sequence
  derived and/or modified sequence opt5 from SART-2__Homo_sapiens__AAF00087
augagaacccacacacggggcgcccccagcguguucuuuaucuaccugcucugcuucgucuccgcuuauauuacggacgagaacccugaaguuaugaucccguuuaccaaugccaacuacgauucucaucccaugcuguauuucagccgcgcggagguggcugaacuucagcugagagccgccuccucucacgagcauauugcugcccggcucacagaagcugugcacaccaugcugagcuccccucuugaguaccugcccccuugggaccccaaggauuauucugcccgcuggaaugagaucuuugggaacaaucucggagcgcuggccauguucuguguccuguacccugaaaacauugaggcuagagacauggccaaagauuauauggaacggauggcugcccaaccgagcuggcucgugaaggacgcgcccugggaugagguuccucuggcccauucccuugugggcuuugcuacagccuacgacuuccuguacaauuaucucagcaaaacccagcaggagaaguuucuggaagucaucgcuaacgccucuggguacauguaugagacauccuaccgcagaggauggggcuuccaguaucuucacaaucaccaacccaccaacugcauggcccugcucacggggagccuggugcugaugaaucagggauaccuccaggaggcuuaucuguggaccaaacagguucuuacaaucauggaaaagucucuggugcuccugcgggaagucaccgauggcucccuuuacgagggcguggcguacgggagcuauacaacccgcucucuguuucaauacauguuccucgugcagagacauuuuaacauuaaucacuucggacauccuuggcugaagcagcacuucgccuuuauguaucggacgauccugcccggcuuccagcgcacagucgcuauugccgacuccaacuacaauugguuuuaugggccggagagccaacucguuuuccuggauaaauuugugaugagaaacggauccggcaacuggcuugccgaccagauccggcgcaauagaguggucgaagggccuggaacccccucuaagggccagcggugguguacacugcacaccgaguuccucugguacgauggcagccugaaauccgugccuccucccgacuuugggacccccacacuucauuauuucgaagacuggggaguugugacguacggcagcgcucugccggccgagauuaacagaucuuuucucuccuucaagagcgggaaacugggaggccgcgcgaucuacgauauuguccaccggaauaaguauaaggacuggaucaaaggguggagaaacuuuaaugcuggacaugaacaccccgaucaaaacucuuucaccuuugccccuaauggcgugcccuucaucacagaggcccuguacggcccuaaguauaccuucuuuaacaauguucucauguucagccccgcuguguccaaaucuugcuuuagcccgugggucggacaggugacagaggacuguuccagcaaguggucuaaauacaagcaugaucuggccgcuuccugccaggggcgcgucguggccgcggaagagaaaaacggcguuguguucauuagaggggaaggagucggcgccuauaauccucagcuuaaccugaagaaugugcaacggaaccucauccugcugcacccccagcuucuccugcugguugaccagauucaccucggggaggaaagcccucuggagaccgcugccagcuuuuuccauaauguggauguccccuuugaggaaacggugguggacggcguucacggagcuuucauccgccagcgggauggccuuuacaagauguauuggauggacgauacaggguacuccgagaaagccaccuuugcgagcgucaccuacccuagaggauaucccuacaacggcacaaacuaugugaaugugaccaugcaucugcgcuccccgauuacacgggccgcuuaccucuucaucgggccuucuaucgacguccaaucuuuuacggugcacggagacucccagcagcuggauguuuucauugccaccucuaagcacgcuuaugccacauaccuguggaccggcgaagccacagggcagagcgcuuuugcgcaagugaucgccgacagacauaaaauucuuuucgaucgcaacuccgcuaucaagagcucuauuguccccgaggugaaagacuaugccgccaucguugagcagaaucuccagcacuucaagcccguguuucagcugcuggaaaagcaaauccucucccgggucagaaacaccgcuagcuuccggaaaacggccgagcgccugcuuagauuuucugauaagcggcagaccgaagaggcgauugacagaaucuucgcuauuucccagcaacagcagcagcaaagcaaaucuaagaaaaaucgccgggccggcaagagauacaaguuuguggaugccguuccugacaucuucgcucagauugaagugaacgagaaaaagauccgccagaaagcccagauucuggcgcaaaaggagcucccgaucgaugaagacgaggaaaugaaagaucugcuggacuuugcugaugucacauacgagaagcauaagaauggaggccuuaucaaagggagauucggacaggcccggauggugaccacaacccacagccgcgcccccucccucagcgcuucuuauacgagacuguuucugauucucaacaucgccauuuucuuugugaugcuggcuaugcagcuuacauacuuccagcgggcccaaucccugcauggccagcgcugucucuaugcgguccugcugaucgacagcugcauucuucucuggcuguacuccucuuguagccagucccaaugcuga

SEQ ID NO: 3394 - protein, 963 aa, Artificial Sequence
  SART-3__Homo_sapiens__Q15020
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 3395 - RNA, 2892 nt, Artificial Sequence
  SART-3__Homo_sapiens__AAH93784
auggcgacugcggccgaaaccucggcuucagaacccgaggcugaguccaaggcugggcccaaggcugacggagaggaggaugagguuaaggcggcuaggacaaggagaaagguguuaucgcgggcuguggccgcugcgacauacaagaccauggggccagcgugggaucagcaggaggaaggcgugagcgagagcgauggggaugaguacgccauggcuuccuccgcggagagcucccccggggaguacgagugggaauaugacgaagaggaggagaaaaaccagcuggagauugagagacuggaggagcaguugucuaucaacgucuaugacuacaacugccauguggacuugaucagacugcucaggcuggaaggggagcuuaccaaggugaggauggcccgccagaagaugagugaaaucuuucccuugacugaagagcucuggcuggaguggcugcaugacgagaucagcauggcccaggauggccuggacagagagcacguguaugaccucuuugagaaagccgugaaggauuacauuuguccuaacauuuggcuagaguauggccaguacucaguuggugggauuggucagaaagguggccuugagaaaguucgcuccguguuugaaagggcucucucgucuguugguuuacauaugaccaaaggacucgcccucugggaggcuuaccgagaguuugaaagugcgauuguggaagcugcucggcuugagaaaguccacagucuuuuccggcgacaguuggcgaucccacucuaugauauggaggccacauuugcagaguaugaagaauggucagaagacccaauaccagagucaguaauucagaacuauaacaaagcacuacagcagcuggagaaauauaaacccuaugaagaagcacuguugcaggcagaggcaccaaggcuggcagaauaucaagcauauaucgauuuugagaugaaaauuggcgauccugcucgcauucaguugaucuuugagcgcgcccuggucgagaacugccuugucccagacuuauggauccguuacagucaguaccuagaucgacaacugaaaguaaaggauuugguuuuaucuguacauaaccgcgcuauuagaaacugccccuggacaguugccuuauggagucgguaccucuuggccauggagagacauggaguugaucaucaaguaauuucuguaaccuucgagaaagcuuugaaugccggcuucauccaggccacugauuauguggagauuuggcaggcauaccuugauuaccugaggagaaggguugauuucaaacaagacuccaguaaagagcuggaggaguugagggccgccuuuacucgugccuuggaguaucugaagcaggagguggaagagcguuucaaugagaguggugauccaagcugcgugauuaugcagaacugggcuaggauugaggcucgacugugcaauaacaugcagaaagcucgggaacucugggauagcaucaugaccagaggaaaugccaaguacgccaacauguggcuagaguauuacaaccuggaaagagcucauggugacacccagcacugccggaaggcucugcaccgggccguccagugcaccagugacuacccagagcacgucugcgaaguguuacucaccauggagaggacagaagguucuuuagaagauugggauauagcuguucagaaaacugaaacccgauuagcucgugucaaugagcagagaaugaaggcugcagagaaggaagcagcccuugugcagcaagaagaagaaaaggcugaacaacggaaaagagcucgggcugagaagaaagcguuaaaaaagaagaaaaagaucagaggcccagagaagcgcggagcagaugaggacgaugagaaagaguggggcgaugaugaagaagagcagccuuccaaacgcagaagggucgagaacagcaucccugcagcuggagaaacacaaaauguagaaguagcagcagggcccgcugggaaaugugcugccguagauguggagcccccuucgaagcagaaggagaaggcagccucccugaagagggacaugcccaaggugcugcacgacagcagcaaggacagcaucaccgucuuugucagcaaccugcccuacagcaugcaggagccggacacgaagcucaggccacucuucgaggccuguggggaggugguccagauccgacccaucuucagcaaccguggggauuuccgagguuacugcuacguggaguuuaaagaagagaaaucagcccuucaggcacuggagauggaccggaaaaguguagaagggaggccaauguuuguuucccccuguguggauaagagcaaaaaccccgauuuuaagguguucagguacagcacuucccuagagaaacacaagcuguucaucucaggccugccuuucuccuguacuaaagaggaacuagaagaaaucuguaaggcucauggcaccgugaaggaccucaggcuggucaccaaccgggcuggcaaaccaaagggccuggccuacguggaguaugaaaaugaaucccaggcgucgcaggcugugaugaagauggacggcaugacuaucaaagagaacaucaucaaaguggcaaucagcaacccuccucagaggaaaguuccagagaagccagagaccaggaaggcaccagguggccccaugcuuuugccgcagacauacggagcgagggggaagggaaggacgcagcugucucuacugccucgugcccugcagcgcccaagugcugcagcuccucaggcugagaacggcccugccgcggcuccugcaguugccgccccagcagccaccgaggcacccaagauguccaaugccgauuuugccaagcuguuucugagaaaguga

SEQ ID NO: 3396 - RNA, 2892 nt, Artificial Sequence
  derived and/or modified sequence opt1 from SART-3__Homo_sapiens__AAH93784
auggccaccgccgcggagaccagcgccuccgagcccgaggccgagagcaaggccggcccgaaggccgacggggaggaggacgaggugaaggcggcccgcacgcggcgcaagguccugucccgggccguggccgcggccaccuacaagaccaugggccccgccugggaccagcaggaggagggggugagcgaguccgacggcgacgaguacgccauggccagcuccgcggagagcucccccggggaguacgagugggaguacgacgaggaggaggagaagaaccagcucgagaucgagcgccuggaggagcagcugagcaucaacgucuacgacuacaacugccacguggaccucauccggcugcugcgccucgagggcgagcugaccaaggugcggauggcccgccagaagauguccgagaucuucccccugacggaggagcucuggcuggaguggcugcacgacgagaucagcauggcccaggacggccucgaccgggagcacgucuacgaccuguucgagaaggccgugaaggacuacaucugcccgaacaucuggcuggaguacgggcaguacuccgugggcgggaucggccagaagggcgggcucgagaagguccgcagcguguucgagcgggcccuguccagcgugggccugcacaugaccaaggggcucgcgcugugggaggccuaccgcgaguucgaguccgccaucgucgaggccgcccggcuggagaaggugcacagccucuuccgccggcagcuggcgaucccccuguacgacauggaggccaccuucgccgaguacgaggagugguccgaggaccccauccccgagagcgugauccagaacuacaacaaggcccuccagcagcuggagaaguacaagccguacgaggaggcccugcuccaggcggaggcgccccgccuggccgaguaccaggccuacaucgacuucgagaugaagaucggcgaccccgcccggauccagcugaucuucgagcgcgcccucgucgagaacugccuggugcccgaccuguggauccgguacagccaguaccucgaccgccagcugaaggugaaggaccugguccucuccgugcacaaccgggccauccgcaacugcccguggaccguggcccuguggagccgcuaccugcucgccauggagcggcacggggucgaccaccaggugaucuccgugacguucgagaaggcgcugaacgccggcuucauccaggccaccgacuacgucgagaucuggcaggccuaccuggacuaccuccgccggcgcguggacuucaagcaggacagcuccaaggagcuggaggagcugcgggccgcguucacccgcgcccucgaguaccugaagcaggaggucgaggagcgguucaacgagagcggcgaccccuccugcgugaucaugcagaacugggcccgcaucgaggcccggcugugcaacaacaugcagaaggcccgcgagcucugggacagcaucaugacccgggggaacgcgaaguacgccaacauguggcuggaguacuacaaccuggagcgcgcccacggcgacacgcagcacugccggaaggcccugcaccgcgcggugcagugcaccuccgacuaccccgagcacgucugcgaggugcuccugaccauggagcggaccgaggggagccuggaggacugggacaucgccgugcagaagacggagacccgccucgcccgggucaacgagcagcgcaugaaggccgccgagaaggaggcggcccuggugcagcaggaggaggagaaggccgagcagcggaagcgcgcccgcgccgagaagaaggcgcugaagaagaagaagaagauccggggccccgagaagcgcggggccgacgaggacgacgagaaggaguggggcgacgacgaggaggagcagccguccaagcggcgccggguggagaacagcauccccgccgccggcgagacccagaacgucgagguggccgcggggcccgccggcaagugcgccgccguggacgucgagcccccguccaagcagaaggagaaggcggccagccucaagcgcgacaugcccaaggugcugcacgacuccagcaaggacuccaucaccguguucgucagcaaccugcccuacuccaugcaggagcccgacacgaagcuccggccgcuguucgaggccugcggggagguggugcagauccgccccaucuucagcaaccggggcgacuuccgcggguacugcuacgucgaguucaaggaggagaaguccgcccugcaggcccucgagauggaccgcaagagcguggagggccggcccauguucgugagccccugcgucgacaaguccaagaacccggacuucaagguguuccgguacagcaccucccuggagaagcacaagcuguucaucagcggccuccccuucuccugcaccaaggaggagcuggaggagaucugcaaggcgcacgggaccgugaaggaccugcgccucgucacgaaccgggccggcaagcccaaggggcuggccuacguggaguacgagaacgagagccaggccucccaggccgugaugaagauggacggcaugaccaucaaggagaacaucaucaaggucgcgaucagcaacccgccccagcgcaaggugcccgagaagcccgagacccggaaggcccccgggggcccgaugcugcucccccagaccuacggcgcccgcgggaagggccggacgcagcugucccugcucccccgcgcccugcagcggccgagcgccgcggcgccccaggccgagaacgggcccgccgccgcccccgccguggccgccccggcggccaccgaggcccccaagauguccaacgccgacuucgccaagcuguuccuccgcaaguga

SEQ ID NO: 3397 - RNA, 2892 nt, Artificial Sequence
  derived and/or modified sequence opt2 from SART-3__Homo_sapiens__AAH93784
auggccaccgccgccgagaccuccgccuccgagcccgaggccgaguccaaggccggccccaaggccgacggcgaggaggacgaggucaaggccgcccgcacccgccgcaagguccucucccgcgccgucgccgccgccaccuacaagaccaugggccccgccugggaccagcaggaggagggcgucuccgaguccgacggcgacgaguacgccauggccuccuccgccgaguccucccccggcgaguacgagugggaguacgacgaggaggaggagaagaaccagcucgagaucgagcgccucgaggagcagcucuccaucaacgucuacgacuacaacugccacgucgaccucauccgccuccuccgccucgagggcgagcucaccaagguccgcauggcccgccagaagauguccgagaucuucccccucaccgaggagcucuggcucgaguggcuccacgacgagaucuccauggcccaggacggccucgaccgcgagcacgucuacgaccucuucgagaaggccgucaaggacuacaucugccccaacaucuggcucgaguacggccaguacuccgucggcggcaucggccagaagggcggccucgagaagguccgcuccgucuucgagcgcgcccucuccuccgucggccuccacaugaccaagggccucgcccucugggaggccuaccgcgaguucgaguccgccaucgucgaggccgcccgccucgagaagguccacucccucuuccgccgccagcucgccaucccccucuacgacauggaggccaccuucgccgaguacgaggagugguccgaggaccccauccccgaguccgucauccagaacuacaacaaggcccuccagcagcucgagaaguacaagcccuacgaggaggcccuccuccaggccgaggccccccgccucgccgaguaccaggccuacaucgacuucgagaugaagaucggcgaccccgcccgcauccagcucaucuucgagcgcgcccucgucgagaacugccucguccccgaccucuggauccgcuacucccaguaccucgaccgccagcucaaggucaaggaccucguccucuccguccacaaccgcgccauccgcaacugccccuggaccgucgcccucuggucccgcuaccuccucgccauggagcgccacggcgucgaccaccaggucaucuccgucaccuucgagaaggcccucaacgccggcuucauccaggccaccgacuacgucgagaucuggcaggccuaccucgacuaccuccgccgccgcgucgacuucaagcaggacuccuccaaggagcucgaggagcuccgcgccgccuucacccgcgcccucgaguaccucaagcaggaggucgaggagcgcuucaacgaguccggcgaccccuccugcgucaucaugcagaacugggcccgcaucgaggcccgccucugcaacaacaugcagaaggcccgcgagcucugggacuccaucaugacccgcggcaacgccaaguacgccaacauguggcucgaguacuacaaccucgagcgcgcccacggcgacacccagcacugccgcaaggcccuccaccgcgccguccagugcaccuccgacuaccccgagcacgucugcgagguccuccucaccauggagcgcaccgagggcucccucgaggacugggacaucgccguccagaagaccgagacccgccucgcccgcgucaacgagcagcgcaugaaggccgccgagaaggaggccgcccucguccagcaggaggaggagaaggccgagcagcgcaagcgcgcccgcgccgagaagaaggcccucaagaagaagaagaagauccgcggccccgagaagcgcggcgccgacgaggacgacgagaaggaguggggcgacgacgaggaggagcagcccuccaagcgccgccgcgucgagaacuccauccccgccgccggcgagacccagaacgucgaggucgccgccggccccgccggcaagugcgccgccgucgacgucgagccccccuccaagcagaaggagaaggccgccucccucaagcgcgacaugcccaagguccuccacgacuccuccaaggacuccaucaccgucuucgucuccaaccuccccuacuccaugcaggagcccgacaccaagcuccgcccccucuucgaggccugcggcgaggucguccagauccgccccaucuucuccaaccgcggcgacuuccgcggcuacugcuacgucgaguucaaggaggagaaguccgcccuccaggcccucgagauggaccgcaaguccgucgagggccgccccauguucgucucccccugcgucgacaaguccaagaaccccgacuucaaggucuuccgcuacuccaccucccucgagaagcacaagcucuucaucuccggccuccccuucuccugcaccaaggaggagcucgaggagaucugcaaggcccacggcaccgucaaggaccuccgccucgucaccaaccgcgccggcaagcccaagggccucgccuacgucgaguacgagaacgagucccaggccucccaggccgucaugaagauggacggcaugaccaucaaggagaacaucaucaaggucgccaucuccaaccccccccagcgcaagguccccgagaagcccgagacccgcaaggcccccggcggccccaugcuccucccccagaccuacggcgcccgcggcaagggccgcacccagcucucccuccucccccgcgcccuccagcgccccuccgccgccgccccccaggccgagaacggccccgccgccgcccccgccgucgccgcccccgccgccaccgaggcccccaagauguccaacgccgacuucgccaagcucuuccuccgcaaguga

SEQ ID NO: 3398 - RNA, 2892 nt, Artificial Sequence
  derived and/or modified sequence opt3 from SART-3__Homo_sapiens__AAH93784
auggccaccgcugcagagacaagcgccuccgaacccgaggcggaaucuaaggcuggcccuaaagccgacggggaggaagaugaggugaaggcagccagaacuaggcggaaaguccugucacgcgcuguugcagccgcuacguacaagaccaugggaccagccugggaccagcaagaggaaggugugagugagagcgauggcgacgaauaugcgauggcauccucugccgagucgucaccgggggaguacgaaugggaguaugaugaagaggaagagaaaaaccagcucgagaucgaacgacuugaggaacagcugagcauuaauguauacgacuauaacugccacguggauuugauacguuuacugagacuagagggagaacucacaaaggucaggauggcucggcagaagaugagugagaucuucccccugacugaggaacuuuggcuggagugguugcaugacgaaauuuccauggcccaagauggccucgaccgcgagcacguguacgaucuguuugaaaaagcaguuaaggacuauaucuguccuaauauuuggcuggaguacggucaguacucugucgggggaaucggccagaaaggcgggcucgagaaggugagaagcguguucgaaagggcuuuauccucaguaggacugcauaugaccaaaggucuugccuugugggaggcguaucgggaauuugagagugccauaguugaggcagcucgccuggaaaaggugcacagccuauuccgaagacagcucgccaucccacuguacgauauggaggcuacauuugccgaauaugaggaauggucugaggaccccauuccugaguccgucauccaaaacuacaauaaggcacuucagcagcuggaaaaauauaagccauacgaggaagccuugcuccaggcugaggcgcccaggcuggcagaauaucaagccuacauugacuucgagaugaaaaucggcgauccugcucggauacaguuaauuuuugagcgugcccugguggaaaacugccucgugccagaccuuuggauccgcuacucacaguaucuggauagacaauugaaggucaaagaccuaguucugagcgugcauaauagggcaauucggaacuguccguggaccguagcccucuggagucgauaccugcuugcuauggagcgccacgggguggaucaccaggucaucucugugacuuucgaaaaggcccugaaugcaggauuuauccaggcgacagacuauguugagauuuggcaggcuuacuuggauuaucucagaaggcggguggacuucaaacaagauuccagcaaggaacuggaggaguuacgcgccgcauuuaccagagcccuggaauaccuaaagcaggaggucgaagagagguucaacgagucgggcgaccccucuugcgugauaaugcagaauugggcucguaucgaagcccggcucuguaacaauaugcagaaagcacgagagcugugggauuccauuaugacgagagguaacgcuaaguaugccaauauguggcuugaauacuacaacuuggagagggcgcauggggacacucaacacugccgcaaagcccugcaucgggcuguacaguguaccucagacuauccugaacacguuugcgaggugcuccugacaauggagagaacugaaggaagucuugaggauugggacaucgcaguccagaagaccgaaacaaggcuggcccgcgugaacgagcagcgaaugaaagcugccgaaaaggaggcagcguugguccaacaggaggaagagaaggccgaacagcggaaacgugcuagagccgagaagaaagcacucaagaaaaagaagaaaauaaggggcccagaaaagcgcggcgcugaugaggacgaugagaaagaauggggagacgaugaggaagaacagcccagcaagcggagaaggguggaaaauuccauuccugccgcaggggaaacccaaaacguugagguggccgcugguccagcgggcaaaugugccgcaguagacgucgaacccccgucuaagcagaaggagaaagcugccagccugaagcgagauaugccuaaaguguuacacgacucaaguaaggauuccaucacgguuuuugugagcaaucugcccuacucuaugcaggaaccagacacuaaacuacgcccucucuucgaggccugcggggaggucgugcaaauccggcccauuuucucaaacagaggagauuuuaggggcuauuguuacguagaguucaaggaggagaaaagugcucugcaggcacuugagauggaccguaagagcguggaaggucgcccaauguuuguuucccccugcgucgacaagucuaaaaauccugauuucaagguguuucgguauucgaccagcuuggagaaacauaagcuguucaucuccgggcucccauuuucaugcacaaaagaggaacuggaggaaauuuguaaggcccacggcacugugaaggacuuaagacuggucacaaacagggcgggaaaaccgaagggccuugcuuacguugaguaugaaaaugagagucaggccucucaggcagugaugaaaauggaugggaugaccauaaaggagaacaucauuaaaguggccaucagcaaucccccucaacgaaagguaccagaaaagcccgagacgcggaaagcuccuggagguccaauguugcucccccagaccuacggcgcacgcgggaagggaagaacacagcugucccuacugccgagggcccuccagcggccuucagcggcugccccacaagcagaaaacggccccgccgcugccccugcagucgcugcccccgcggccacugaggcaccaaaaaugagcaaugcugacuucgccaagcuguuucuucgaaaauga

SEQ ID NO: 3399 - RNA, 2892 nt, Artificial Sequence
  derived and/or modified sequence opt4 from SART-3__Homo_sapiens__AAH93784
auggccaccgccgccgagaccagcgccagcgagcccgaggccgagagcaaggccggccccaaggccgacggcgaggaggacgaggugaaggccgccagaaccagaagaaaggugcugagcagagccguggccgccgccaccuacaagaccaugggccccgccugggaccagcaggaggagggcgugagcgagagcgacggcgacgaguacgccauggccagcagcgccgagagcagccccggcgaguacgagugggaguacgacgaggaggaggagaagaaccagcuggagaucgagagacuggaggagcagcugagcaucaacguguacgacuacaacugccacguggaccugaucagacugcugagacuggagggcgagcugaccaaggugagaauggccagacagaagaugagcgagaucuucccccugaccgaggagcuguggcuggaguggcugcacgacgagaucagcauggcccaggacggccuggacagagagcacguguacgaccuguucgagaaggccgugaaggacuacaucugccccaacaucuggcuggaguacggccaguacagcgugggcggcaucggccagaagggcggccuggagaaggugagaagcguguucgagagagcccugagcagcgugggccugcacaugaccaagggccuggcccugugggaggccuacagagaguucgagagcgccaucguggaggccgccagacuggagaaggugcacagccuguucagaagacagcuggccaucccccuguacgacauggaggccaccuucgccgaguacgaggaguggagcgaggaccccauccccgagagcgugauccagaacuacaacaaggcccugcagcagcuggagaaguacaagcccuacgaggaggcccugcugcaggccgaggcccccagacuggccgaguaccaggccuacaucgacuucgagaugaagaucggcgaccccgccagaauccagcugaucuucgagagagcccugguggagaacugccuggugcccgaccuguggaucagauacagccaguaccuggacagacagcugaaggugaaggaccuggugcugagcgugcacaacagagccaucagaaacugccccuggaccguggcccuguggagcagauaccugcuggccauggagagacacggcguggaccaccaggugaucagcgugaccuucgagaaggcccugaacgccggcuucauccaggccaccgacuacguggagaucuggcaggccuaccuggacuaccugagaagaagaguggacuucaagcaggacagcagcaaggagcuggaggagcugagagccgccuucaccagagcccuggaguaccugaagcaggagguggaggagagauucaacgagagcggcgaccccagcugcgugaucaugcagaacugggccagaaucgaggccagacugugcaacaacaugcagaaggccagagagcugugggacagcaucaugaccagaggcaacgccaaguacgccaacauguggcuggaguacuacaaccuggagagagcccacggcgacacccagcacugcagaaaggcccugcacagagccgugcagugcaccagcgacuaccccgagcacgugugcgaggugcugcugaccauggagagaaccgagggcagccuggaggacugggacaucgccgugcagaagaccgagaccagacuggccagagugaacgagcagagaaugaaggccgccgagaaggaggccgcccuggugcagcaggaggaggagaaggccgagcagagaaagagagccagagccgagaagaaggcccugaagaagaagaagaagaucagaggccccgagaagagaggcgccgacgaggacgacgagaaggaguggggcgacgacgaggaggagcagcccagcaagagaagaagaguggagaacagcauccccgccgccggcgagacccagaacguggagguggccgccggccccgccggcaagugcgccgccguggacguggagccccccagcaagcagaaggagaaggccgccagccugaagagagacaugcccaaggugcugcacgacagcagcaaggacagcaucaccguguucgugagcaaccugcccuacagcaugcaggagcccgacaccaagcugagaccccuguucgaggccugcggcgagguggugcagaucagacccaucuucagcaacagaggcgacuucagaggcuacugcuacguggaguucaaggaggagaagagcgcccugcaggcccuggagauggacagaaagagcguggagggcagacccauguucgugagccccugcguggacaagagcaagaaccccgacuucaagguguucagauacagcaccagccuggagaagcacaagcuguucaucagcggccugcccuucagcugcaccaaggaggagcuggaggagaucugcaaggcccacggcaccgugaaggaccugagacuggugaccaacagagccggcaagcccaagggccuggccuacguggaguacgagaacgagagccaggccagccaggccgugaugaagauggacggcaugaccaucaaggagaacaucaucaagguggccaucagcaaccccccccagagaaaggugcccgagaagcccgagaccagaaaggcccccggcggccccaugcugcugccccagaccuacggcgccagaggcaagggcagaacccagcugagccugcugcccagagcccugcagagacccagcgccgccgccccccaggccgagaacggccccgccgccgcccccgccguggccgcccccgccgccaccgaggcccccaagaugagcaacgccgacuucgccaagcuguuccugagaaaguga

SEQ ID NO: 3400 - RNA, 2892 nt, Artificial Sequence
  derived and/or modified sequence opt5 from SART-3__Homo_sapiens__AAH93784
auggccaccgcugccgagacaagcgcguccgaacccgaggcugaaucuaaggccggcccuaaagccgacggggaggaagaugaggugaaggcugccagaacgcggcgcaaaguccugagcagagcuguugccgcggccaccuacaagacaaugggaccggcuugggaccagcaagaggaaggcguguccgagucugauggggacgaauaugccauggcuagcuccgccgagucuagccccggagaguacgaaugggaguaugaugaagaggaagagaaaaaccagcucgagaucgaacggcuggaggaacagcuuuccauuaauguguacgacuauaacugccacgucgaucugauccgccuccugagacuugagggcgaacugaccaaggugcggauggcgcgccagaagaugagcgagauuuucccucucacagaggaacuguggcuggaguggcuccaugacgaaaucucuauggcccaagaugggcuggacagagagcacguuuacgaucuuuuugaaaaagcugugaaggacuauauuugucccaauaucuggcuggaguacggacaguacuccgucggcggcaucgggcagaaaggaggccucgagaaggugcggagcguuuucgaacgcgcccugucuuccguggggcuucauaugaccaaaggacuggcucucugggaggccuauagagaauuugagagcgccauugucgaggcugcgcggcuggaaaaggugcacucucuguuccgcagacagcucgccaucccucuguacgauauggaggcuacauuugccgaauaugaggaaugguccgaggaccccauuccugagagcgugauccaaaacuacaauaaggcccuucagcagcuggaaaaauauaagccguacgaggaagcucuccugcaggccgaggcgccccggcuugcugaauaucaagccuacauugacuucgagaugaaaaucggcgauccugcccgcauucagcugaucuuugagagagcucucgucgaaaacugccugguucccgaccuguggauccgguacucccaguaucucgauagacaacugaaggugaaagaccuugugcugucuguccauaaucgcgccauucggaacuguccuuggaccguggcucucuggagcagauaccugcuugccauggagcgccacgggguugaucaccaggugaucuccgucacguucgaaaaggcgcugaaugccggauuuauucaggcuaccgacuauguggagaucuggcaggccuaccucgauuaucugcggagacgcguugacuucaaacaagauagcucuaaggaacuggaggagcuccgggcugccuuuacaagagcgcuggaauaccuuaagcaggagguggaagaacgcuucaacgaguccggcgaccccagcugcgucauuaugcagaauugggcccggaucgaagcuagacuguguaacaauaugcagaaagcccgcgagcucugggauucuaucaugacccggggcaacgcuaaguaugccaauauguggcuggaauacuacaaccuggagagagcccauggggacacacaacacugccggaaagcccuucaucgcgcggugcaguguaccagcgacuauccggaacacgucugcgaggugcuccugacgauggagagaacagaaggaucccuggaggauugggacauugccguucagaagaccgaaacacggcucgcuagagugaacgagcagcgcaugaaagccgccgaaaaggaggcugcccugguccaacaggaggaagagaaggcggaacagcggaaaagagcucgcgccgagaagaaagcccuuaagaaaaagaagaaaaucagaggcccugaaaagcgcggggcugaugaggacgaugagaaagaauggggagacgaugaggaggagcagcccucuaagcggagacggguggagaauagcauuccugccgcgggcgaaacccaaaacguugagguggcugccgggcccgccggaaaaugugcugccgucgacguggaacccccuuccaagcagaaggagaaagcugccagccugaagcgcgauaugccgaaagugcuccacgacucuuccaaggauagcaucaccguuuuugucucuaaucugcccuacuccaugcaggaaccugacacaaaacugagaccccuuuucgaggcgugcggcgagguggugcaaauucggccuaucuucagcaaccgcggcgauuuuagaggguauuguuacgucgaguucaaggaagaaaaauccgcccuccaggcucuggagauggaccggaagucuguggaaggacgccccauguuuguuagcccgugcguggacaaguccaaaaauccugauuucaaggucuuuagauauucuacgagccuggagaaacauaaacucuucaucuccggccugcccuuuagcugcaccaaggaggaacuugaggaaauuuguaaggcccacgggacagugaaggaccugcggcucguuaccaacagagcuggaaaaccuaagggccuggccuacguggaguaugaaaaugagucucaggccucccaggcugucaugaaaauggaugggaugacaaucaaggagaacauuaucaaaguggcgauuagcaaucccccucaacgcaagguucccgaaaagccggagacccggaaagccccuggcggacccaugcugcuuccccagacguacggcgcuagagggaagggacgcacacagcucucucugcugccucgggcccuccagagaccguccgccgcugcuccccaagcggaaaacggcccugcugccgcccccgcuguggccgcgccugcugccaccgaggcccccaaaaugagcaaugcugacuucgccaagcuguuucuucgcaaauga

SEQ ID NO: 3401 - protein, 760 aa, Artificial Sequence
  SEPR__Homo_sapiens__Q12884
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 3402 - RNA, 2283 nt, Artificial Sequence
  SEPR__Homo_sapiens__AAC51668
augaagacuuggguaaaaaucguauuuggaguugccaccucugcugugcuugccuuauuggugaugugcauugucuuacgcccuucaagaguucauaacucugaagaaaauacaaugagagcacucacacugaaggauauuuuaaauggaacauuuucuuauaaaacauuuuuuccaaacuggauuucaggacaagaauaucuucaucaaucugcagauaacaauauaguacuuuauaauauugaaacagggcaaucauauaccauuuugaguaauagaaccaugaaaagugugaaugcuucaaauuacggcuuaucaccugaucggcaauuuguauaucuagaaagugauuauucaaagcuuuggagauacucuuacacagcaacauauuacaucuaugaccuuagcaauggagaauuuguaagaggaaaugagcuuccucguccaauucaguauuuaugcuggucgccuguugggaguaaauuagcauaugucuaucaaaacaauaucuauuugaaacaaagaccaggagauccaccuuuucaaauaacauuuaauggaagagaaaauaaaauauuuaauggaaucccagacuggguuuaugaagaggaaaugcuugcuacaaaauaugcucucugguggucuccuaauggaaaauuuuuggcauaugcggaauuuaaugauacggauauaccaguuauugccuauuccuauuauggcgaugaacaauauccuagaacaauaaauauuccauacccaaaggcuggagcuaagaaucccguuguucggauauuuauuaucgauaccacuuacccugcguauguagguccccaggaagugccuguuccagcaaugauagccucaagugauuauuauuucaguuggcucacguggguuacugaugaacgaguauguuugcaguggcuaaaaagaguccagaauguuucgguccugucuauaugugacuucagggaagacuggcagacaugggauuguccaaagacccaggagcauauagaagaaagcagaacuggaugggcugguggauucuuuguuucaacaccaguuuucagcuaugaugccauuucguacuacaaaauauuuagugacaaggauggcuacaaacauauucacuauaucaaagacacuguggaaaaugcuauucaaauuacaaguggcaagugggaggccauaaauauauucagaguaacacaggauucacuguuuuauucuagcaaugaauuugaagaauacccuggaagaagaaacaucuacagaauuagcauuggaagcuauccuccaagcaagaaguguguuacuugccaucuaaggaaagaaaggugccaauauuacacagcaaguuucagcgacuacgccaaguacuaugcacuugucugcuacggcccaggcauccccauuuccacccuucaugauggacgcacugaucaagaaauuaaaauccuggaagaaaacaaggaauuggaaaaugcuuugaaaaauauccagcugccuaaagaggaaauuaagaaacuugaaguagaugaaauuacuuuaugguacaagaugauucuuccuccucaauuugacagaucaaagaaguaucccuugcuaauucaaguguaugguggucccugcagucagaguguaaggucuguauuugcuguuaauuggauaucuuaucuugcaaguaaggaagggauggucauugccuugguggauggucgaggaacagcuuuccaaggugacaaacuccucuaugcaguguaucgaaagcuggguguuuaugaaguugaagaccagauuacagcugucagaaaauucauagaaauggguuucauugaugaaaaaagaauagccauauggggcugguccuauggaggauacguuucaucacuggcccuugcaucuggaacuggucuuuucaaaugugguauagcaguggcuccagucuccagcugggaauauuacgcgucugucuacacagagagauucaugggucucccaacaaaggaugauaaucuugagcacuauaagaauucaacugugauggcaagagcagaauauuucagaaauguagacuaucuucucauccacggaacagcagaugauaaugugcacuuucagaacucagcacagauugcuaaagcucugguuaaugcacaaguggauuuccaggcaaugugguacucugaccagaaccacggcuuauccggccuguccacgaaccacuuauacacccacaugacccacuuccuaaagcaguguuucucuuugucagacuaa

SEQ ID NO: 3403 - RNA, 2283 nt, Artificial Sequence
  derived and/or modified sequence opt1 from SEPR__Homo_sapiens__AAC51668
augaagaccugggugaagaucgucuucggcguggccaccagcgccgugcuggcgcuccuggucaugugcaucgugcugcgccccucccgggugcacaacagcgaggagaacacgaugcgcgcccucacccugaaggacauccugaacgggaccuucuccuacaagaccuucuucccgaacuggaucagcggccaggaguaccuccaccaguccgccgacaacaacaucguccuguacaacaucgagacggggcagagcuacaccauccuguccaaccggaccaugaaguccgugaacgccagcaacuacggccucagccccgaccgccaguucguguaccuggaguccgacuacagcaagcuguggcgguacuccuacaccgccacguacuacaucuacgaccucagcaacggggaguucguccgcggcaacgagcugccccggcccauccaguaccugugcugguccccggugggcagcaagcucgcguacguguaccagaacaacaucuaccugaagcagcgccccggggacccgcccuuccagaucaccuucaacggccgggagaacaagaucuucaacgggauccccgacugggucuacgaggaggagaugcuggccaccaaguacgcccucugguggucccccaacggcaaguuccuggccuacgcggaguucaacgacaccgacauccccgugaucgccuacagcuacuacggggacgagcaguacccccgcacgaucaacaucccguaccccaaggccggcgccaagaaccccgugguccggaucuucaucaucgacaccaccuaccccgccuacgugggcccgcaggaggugcccguccccgcgaugaucgccuccagcgacuacuacuucagcuggcugaccugggugacggacgagcgcgugugccuccaguggcugaagcggguccagaacguguccgugcugagcaucugcgacuuccgcgaggacuggcagaccugggacugccccaagacccaggagcacaucgaggagucccggaccgggugggccggcggguucuucgucagcacgccgguguucuccuacgacgccaucagcuacuacaagaucuucuccgacaaggacggcuacaagcacauccacuacaucaaggacaccgucgagaacgccauccagaucaccagcggcaagugggaggcgaucaacaucuuccgcgugacccaggacucccucuucuacagcuccaacgaguucgaggaguaccccgggcggcgcaacaucuaccggaucagcaucggcuccuacccgcccagcaagaagugcgugacgugccaccuccgcaaggagcggugccaguacuacaccgccuccuucagcgacuacgccaaguacuacgcccuggucugcuacgggcccggcauccccaucuccacccugcacgacgggcgcaccgaccaggagaucaagauccuggaggagaacaaggagcuggagaacgcccucaagaacauccagcugcccaaggaggagaucaagaagcuggagguggacgagaucacgcucugguacaagaugauccugcccccgcaguucgaccgcagcaagaaguacccccugcucauccagguguacggcggccccugcucccagagcguccggagcguguucgcggugaacuggaucuccuaccuggccagcaaggaggggauggucaucgcccugguggacggccgcgggaccgccuuccagggcgacaagcuccuguacgccguguaccggaagcugggggucuacgagguggaggaccagaucaccgcggugcgcaaguucaucgagaugggcuucaucgacgagaagcggaucgccaucuggggcugguccuacgggggcuacgucagcucccucgcccuggccagcgggaccggccuguucaagugcgggaucgcgguggccccgguguccagcugggaguacuacgccuccgucuacacggagcgcuucaugggccuccccaccaaggacgacaaccuggagcacuacaagaacagcaccgugauggcccgggccgaguacuuccgcaacguggacuaccugcucauccacggcaccgcggacgacaacguccacuuccagaacuccgcccagaucgccaaggcccuggugaacgcccagguggacuuccaggcgaugugguacagcgaccagaaccacgggcuguccggccugagcacgaaccaccucuacacccacaugacccacuuccugaagcagugcuucucccugagcgacuga

SEQ ID NO: 3404 - RNA, 2283 nt, Artificial Sequence
  derived and/or modified sequence opt2 from SEPR__Homo_sapiens__AAC51668
augaagaccugggucaagaucgucuucggcgucgccaccuccgccguccucgcccuccucgucaugugcaucguccuccgccccucccgcguccacaacuccgaggagaacaccaugcgcgcccucacccucaaggacauccucaacggcaccuucuccuacaagaccuucuuccccaacuggaucuccggccaggaguaccuccaccaguccgccgacaacaacaucguccucuacaacaucgagaccggccaguccuacaccauccucuccaaccgcaccaugaaguccgucaacgccuccaacuacggccucucccccgaccgccaguucgucuaccucgaguccgacuacuccaagcucuggcgcuacuccuacaccgccaccuacuacaucuacgaccucuccaacggcgaguucguccgcggcaacgagcucccccgccccauccaguaccucugcuggucccccgucggcuccaagcucgccuacgucuaccagaacaacaucuaccucaagcagcgccccggcgacccccccuuccagaucaccuucaacggccgcgagaacaagaucuucaacggcauccccgacugggucuacgaggaggagaugcucgccaccaaguacgcccucugguggucccccaacggcaaguuccucgccuacgccgaguucaacgacaccgacauccccgucaucgccuacuccuacuacggcgacgagcaguacccccgcaccaucaacauccccuaccccaaggccggcgccaagaaccccgucguccgcaucuucaucaucgacaccaccuaccccgccuacgucggcccccaggagguccccguccccgccaugaucgccuccuccgacuacuacuucuccuggcucaccugggucaccgacgagcgcgucugccuccaguggcucaagcgcguccagaacgucuccguccucuccaucugcgacuuccgcgaggacuggcagaccugggacugccccaagacccaggagcacaucgaggagucccgcaccggcugggccggcggcuucuucgucuccacccccgucuucuccuacgacgccaucuccuacuacaagaucuucuccgacaaggacggcuacaagcacauccacuacaucaaggacaccgucgagaacgccauccagaucaccuccggcaagugggaggccaucaacaucuuccgcgucacccaggacucccucuucuacuccuccaacgaguucgaggaguaccccggccgccgcaacaucuaccgcaucuccaucggcuccuacccccccuccaagaagugcgucaccugccaccuccgcaaggagcgcugccaguacuacaccgccuccuucuccgacuacgccaaguacuacgcccucgucugcuacggccccggcauccccaucuccacccuccacgacggccgcaccgaccaggagaucaagauccucgaggagaacaaggagcucgagaacgcccucaagaacauccagcuccccaaggaggagaucaagaagcucgaggucgacgagaucacccucugguacaagaugauccuccccccccaguucgaccgcuccaagaaguacccccuccucauccaggucuacggcggccccugcucccaguccguccgcuccgucuucgccgucaacuggaucuccuaccucgccuccaaggagggcauggucaucgcccucgucgacggccgcggcaccgccuuccagggcgacaagcuccucuacgccgucuaccgcaagcucggcgucuacgaggucgaggaccagaucaccgccguccgcaaguucaucgagaugggcuucaucgacgagaagcgcaucgccaucuggggcugguccuacggcggcuacgucuccucccucgcccucgccuccggcaccggccucuucaagugcggcaucgccgucgcccccgucuccuccugggaguacuacgccuccgucuacaccgagcgcuucaugggccuccccaccaaggacgacaaccucgagcacuacaagaacuccaccgucauggcccgcgccgaguacuuccgcaacgucgacuaccuccucauccacggcaccgccgacgacaacguccacuuccagaacuccgcccagaucgccaaggcccucgucaacgcccaggucgacuuccaggccaugugguacuccgaccagaaccacggccucuccggccucuccaccaaccaccucuacacccacaugacccacuuccucaagcagugcuucucccucuccgacuga

SEQ ID NO: 3405 - RNA, 2283 nt, Artificial Sequence
  derived and/or modified sequence opt3 from SEPR__Homo_sapiens__AAC51668
augaagaccugggugaaaaucgucuucggcguugccacaagcgcugugcuggcacuccuuguaaugugcauugugcugagacccuccaggguccacaacucugaggaaaauacuaugcgggccuugacguuaaaggacauacugaacgggaccuuuucauacaaaacauucuuuccuaauuggaucaguggacaggaguaucuacaucaaagcgcggauaacaauauugugcucuacaacaucgaaacuggucaguccuauaccauucugucuaaucgcacaaugaagucgguuaacgcuucaaauuacggccuuagcccagaccgacaguucguguaucuggagagugauuacuccaaauuguggcguuauucuuacaccgccacuuacuauaucuacgaccucagcaacggggaauuugucagaggaaaugagcugccgaggcccauacaguaucuguguugguccccugugggcucaaagcucgcauacguauaucaaaacaauaucuacuuaaagcagcggccaggugaucccccuuuccagauuacauuuaacgggcgcgagaauaaaaucuucaacggcauuccagacuggguuuaugaagaggaaaugcuggccaccaaguacgcucuuugguggagucccaacggaaaauuuuuggcauacgccgaguucaaugauacggacaucccugugauagcuuauagcuacuauggcgaugagcaguacccaagaacuauuaacaucccguaucccaaggccggggcgaaaaauccugucgugaggauuuuuaucaucgacaccacauacccagcauaugugggaccccaagaagucccuguuccagccaugauugcuucuuccgauuacuacuucucauggcugacuugggugaccgacgagcggguaugccuacaguggcucaagcgcgugcagaacgucagcgugcugaguauaugugauuuucgagaagacuggcagacaugggacugccccaagacccaagagcacaucgaagagucuagaacggguugggccggcggguucuucguuuccacuccgguguuuagcuaugaugcaauuucguacuauaaaaucuucucugacaaggauggauacaaacauauacacuauauuaaggacacagucgagaaugcuauccagaucaccuccggcaaaugggaagccauuaacaucuuuagggugacucaggauucacuuuucuacaguagcaaugaguuugaagaguauccuggucggcguaacauuuaccgcauauccaucgggucuuaucccccaagcaagaaauguguaacaugccaucugagaaaggaaaggugucaauacuacaccgcgucauucagugacuaugccaaguacuaugcauugguuugcuacggaccuggcauucccaucuccacgcuccacgauggccggaccgaccaggagaucaaaauucuggaggaaaauaaggaguuagaaaacgcucugaaaaauauacagcucccaaaggaggaaaucaaaaagcuggagguggaugagauuacacuuugguauaagaugaucuugcccccucaguuugaccgaagcaaaaaguacccacuacugauucaagucuacgggggaccguguucucagucagugcgcagugucuucgccgugaacuggaucagcuaucucgcuuccaaagaagguaugguuauagcccugguggauggcagagggacugcauuucagggagacaaacuucuguacgccguauauaggaaguugggcgucuacgagguggaagaccagaucaccgcuguucggaaguucauugagauggguuuuaucgaugagaagcgcauugcgaucuggggguggucuuauggcggauacgugucgagccucgcacuggccuccggcacaggguuauucaaaugcggaauagcugucgcccccgugucaaguugggaauauuacgcaucuguauacacugagagauuuaugggucugccuaccaaggacgauaaucuagaacacuauaaaaacagcacagugauggccagggcugaguacuuccguaauguugacuaucuccugauucauggcaccgccgaugacaacguccacuuccaaaacuccgcacagaucgcgaaggcucuugugaaugcccagguggauuuucaggcaaugugguacucagaccaaaaccauggguugagcggacugucuacuaaucaccucuauacgcacaugacacauuuccugaaacaguguuuuucccuuagugauuga

SEQ ID NO: 3406 - RNA, 2283 nt, Artificial Sequence
  derived and/or modified sequence opt4 from SEPR__Homo_sapiens__AAC51668
augaagaccugggugaagaucguguucggcguggccaccagcgccgugcuggcccugcuggugaugugcaucgugcugagacccagcagagugcacaacagcgaggagaacaccaugagagcccugacccugaaggacauccugaacggcaccuucagcuacaagaccuucuuccccaacuggaucagcggccaggaguaccugcaccagagcgccgacaacaacaucgugcuguacaacaucgagaccggccagagcuacaccauccugagcaacagaaccaugaagagcgugaacgccagcaacuacggccugagccccgacagacaguucguguaccuggagagcgacuacagcaagcuguggagauacagcuacaccgccaccuacuacaucuacgaccugagcaacggcgaguucgugagaggcaacgagcugcccagacccauccaguaccugugcuggagccccgugggcagcaagcuggccuacguguaccagaacaacaucuaccugaagcagagacccggcgacccccccuuccagaucaccuucaacggcagagagaacaagaucuucaacggcauccccgacuggguguacgaggaggagaugcuggccaccaaguacgcccugugguggagccccaacggcaaguuccuggccuacgccgaguucaacgacaccgacauccccgugaucgccuacagcuacuacggcgacgagcaguaccccagaaccaucaacauccccuaccccaaggccggcgccaagaaccccguggugagaaucuucaucaucgacaccaccuaccccgccuacgugggcccccaggaggugcccgugcccgccaugaucgccagcagcgacuacuacuucagcuggcugaccugggugaccgacgagagagugugccugcaguggcugaagagagugcagaacgugagcgugcugagcaucugcgacuucagagaggacuggcagaccugggacugccccaagacccaggagcacaucgaggagagcagaaccggcugggccggcggcuucuucgugagcacccccguguucagcuacgacgccaucagcuacuacaagaucuucagcgacaaggacggcuacaagcacauccacuacaucaaggacaccguggagaacgccauccagaucaccagcggcaagugggaggccaucaacaucuucagagugacccaggacagccuguucuacagcagcaacgaguucgaggaguaccccggcagaagaaacaucuacagaaucagcaucggcagcuacccccccagcaagaagugcgugaccugccaccugagaaaggagagaugccaguacuacaccgccagcuucagcgacuacgccaaguacuacgcccuggugugcuacggccccggcauccccaucagcacccugcacgacggcagaaccgaccaggagaucaagauccuggaggagaacaaggagcuggagaacgcccugaagaacauccagcugcccaaggaggagaucaagaagcuggagguggacgagaucacccugugguacaagaugauccugcccccccaguucgacagaagcaagaaguacccccugcugauccagguguacggcggccccugcagccagagcgugagaagcguguucgccgugaacuggaucagcuaccuggccagcaaggagggcauggugaucgcccugguggacggcagaggcaccgccuuccagggcgacaagcugcuguacgccguguacagaaagcugggcguguacgagguggaggaccagaucaccgccgugagaaaguucaucgagaugggcuucaucgacgagaagagaaucgccaucuggggcuggagcuacggcggcuacgugagcagccuggcccuggccagcggcaccggccuguucaagugcggcaucgccguggcccccgugagcagcugggaguacuacgccagcguguacaccgagagauucaugggccugcccaccaaggacgacaaccuggagcacuacaagaacagcaccgugauggccagagccgaguacuucagaaacguggacuaccugcugauccacggcaccgccgacgacaacgugcacuuccagaacagcgcccagaucgccaaggcccuggugaacgcccagguggacuuccaggccaugugguacagcgaccagaaccacggccugagcggccugagcaccaaccaccuguacacccacaugacccacuuccugaagcagugcuucagccugagcgacuga

SEQ ID NO: 3407 - RNA, 2283 nt, Artificial Sequence
  derived and/or modified sequence opt5 from SEPR__Homo_sapiens__AAC51668
augaagaccugggugaaaaucgucuucggcguugccacaagcgcugugcuggcccuccuggugaugugcauuguccuuagacccucccgggugcacaacucugaggaaaauacgaugcgcgcgcugacccucaaggacauccugaacgggacauuuagcuacaaaaccuucuuuccuaauuggauuuccggacaggaguaucuucaucaaucugcugauaacaauaucguucuguacaacauugaaacaggccagagcuauaccauccucuccaauagaacaaugaagucugugaacgccagcaauuacgggcuguccccggaccggcaguucgucuaucuggagagcgauuacucuaaacucuggcgcuauuccuacaccgccacguacuauaucuacgaccugagcaacggagaauuugugagaggcaaugagcuuccccggccuauucaguaucuguguuggucucccguuggguccaagcucgcuuacguguaucaaaacaauaucuaccugaagcagcgcccuggagaucccccuuuccagauuaccuuuaacggcagagagaauaaaaucuucaacggcauuccggacugggucuaugaagaggaaaugcuugccacaaaguacgcucugugguggagccccaacgggaaauuucucgccuacgcggaguucaaugauaccgacaucccugugauugccuauucuuacuauggagaugagcaguacccccggacaaucaacaucccuuaucccaaggcuggcgccaaaaauccggugguccgcauuuuuaucauugacaccacguacccugcuuauguugggccccaagaagugccugugcccgccaugaucgcguccagcgauuacuacuucuccuggcugacaugggucaccgacgagagagugugccugcaguggcucaagcggguucagaacgugucuguccugagcauuugugauuuucgcgaagacuggcagacaugggacugccccaagacccaagagcacaucgaagaguccagaaccggaugggccggcggguucuucgugagcacaccuguguuuucuuaugaugcuaucuccuacuauaaaauuuucagcgacaaggauggauacaaacauauccacuauauuaaggacacgguugagaaugccauccagauuaccucuggcaaaugggaagcuaucaacaucuuucgggucacacaggauagccuuuucuacuccucuaaugaguuugaagaguauccgggccgcagaaacauuuaccggaucagcauuggguccuaucccccuagcaagaaaugugugaccugccaucugagaaaggaacgcugucaauacuacacagccucuuucuccgacuaugccaaguacuaugcucucgucugcuacggacccggcaucccuauuagcacccugcacgaugggcggacggaccaggagaucaaaauucuugaggaaaauaaggagcuggaaaacgcgcucaaaaauauccagcugcccaaggaggaaaucaaaaagcuggagguggaugagauuacacucugguauaagaugauccugccgccucaguuugacagaucuaaaaaguacccccuucugauucaaguuuacggaggcccuuguucccagagcgugcgcuccgucuucgccgugaacuggaucucuuaucucgcuagcaaagaagggaugguuauugcccugguggauggacggggcaccgccuuucagggcgacaagcuccuguacgcugucuauagaaaacucgggguguacgagguggaagaccagaucaccgccguucgcaaguucaucgagaugggauuuauugaugagaagcggaucgcgauuuggggcugguccuaugggggauacgucucuagccuggcucuggccuccggcacagggcuuuucaaaugcggcaucgccguggcucccgugagcucuugggaauauuacgccuccgucuacaccgagagauuuaugggacugccuacaaaggacgauaaucuugaacacuauaaaaacagcacggugauggcucgcgccgaguacuuccggaauguugacuaucugcucauucauggcaccgcggaugacaacgugcacuuccaaaacucugcccagaucgcuaaggcccuggucaaugcucagguggauuuucaggccaugugguacuccgaccaaaaccaugggcugagcggacuuucuacaaaucaccucuauacccacaugacacauuuccugaaacaguguuuuagccuguccgauuga

SEQ ID NO: 3408 - protein, 333 aa, Artificial Sequence
  SIA7F__Homo_sapiens__Q969X2
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 3409 - RNA, 1002 nt, Artificial Sequence
  SIA7F__Homo_sapiens__AAH06564
auggcuugcucgaggccccccagccagugugaacccacaucccugcccccagggccaccugcaggacgccgacaccuaccccucagcagacgccggagagaaaugaguagcaacaaagagcagcggucagcaguguucgugauccucuuugcccucaucaccauccucauccucuacagcuccaacagugccaaugaggucuuccauuacggcucccugcggggccguagccgccgaccugucaaccucaagaaguggagcaucacugacggcuauguccccauucucggcaacaagacacugcccucucggugccaccagugugugauugucagcagcuccagccaccugcugggcaccaagcugggcccugagaucgagcgggcugaguguacaauccgcaugaaugaugcacccaccacuggcuacucagcugaugugggcaacaagaccaccuaccgcgucguggcccauuccaguguguuccgcgugcugaggaggccccaggaguuugucaaccggaccccugaaaccguguucaucuucugggggcccccgagcaagaugcagaagccccagggcagccucgugcgugugauccagcgagcgggccugguguuccccaacauggaagcauaugccgucucucccggccgcaugcggcaauuugacgaccucuuccggggugagacgggcaaggacagggagaagucucauucgugguugagcacaggcugguuuaccauggugaucgcgguggaguugugugaccacgugcaugucuauggcauggucccccccaacuacugcagccagcggccccgccuccagcgcaugcccuaccacuacuacgagcccaaggggccggacgaaugugucaccuacauccagaaugagcacagucgcaagggcaaccaccaccgcuucaucaccgagaaaagggucuucucaucgugggcccagcuguauggcaucaccuucucccaccccuccuggaccuag

SEQ ID NO: 3410 - RNA, 1002 nt, Artificial Sequence
  derived and/or modified sequence opt1 from SIA7F__Homo_sapiens__AAH06564
auggccugcagccggcccccgucccagugcgagcccaccagccugccgcccggcccgcccgccgggcgccgccaccucccccugucccggcgccggcgcgagaugagcuccaacaaggagcagcggagcgcgguguucgucauccuguucgcccucaucaccauccugauccuguacuccagcaacuccgccaacgagguguuccacuacggcagccuccgcgggcggucccgccggcccgugaaccugaagaaguggagcaucacggacggcuacguccccauccuggggaacaagacccuccccucccgcugccaccagugcgugaucgugagcuccagcucccaccuccugggcaccaagcugggccccgagaucgagcgggccgagugcaccauccgcaugaacgacgcccccacgaccggguacagcgcggacgucggcaacaagaccaccuaccgggugguggcccacuccagcgucuuccgcgugcugcggcgcccgcaggaguucgugaaccggacgcccgagaccgucuucaucuucugggggccgcccagcaagaugcagaagccccagggcucccuggugcgcgugauccagcgggccgggcucgucuuccccaacauggaggccuacgcggugagccccggccgcaugcgccaguucgacgaccuguuccggggcgagaccgggaaggaccgcgagaagucccacagcuggcuguccaccggcugguucacgauggugaucgccgucgagcucugcgaccacgugcacguguacgggauggugcccccgaacuacugcagccagcggccccgccugcagcggaugcccuaccacuacuacgagcccaagggcccggacgagugcgucaccuacauccagaacgagcacucccgcaagggcaaccaccaccgguucaucaccgagaagcgcguguucagcuccugggcccagcuguacgggaucaccuucagccaccccuccuggacguga

SEQ ID NO: 3411 - RNA, 1002 nt, Artificial Sequence
  derived and/or modified sequence opt2 from SIA7F__Homo_sapiens__AAH06564
auggccugcucccgcccccccucccagugcgagcccaccucccucccccccggcccccccgccggccgccgccaccucccccucucccgccgccgccgcgagauguccuccaacaaggagcagcgcuccgccgucuucgucauccucuucgcccucaucaccauccucauccucuacuccuccaacuccgccaacgaggucuuccacuacggcucccuccgcggccgcucccgccgccccgucaaccucaagaagugguccaucaccgacggcuacguccccauccucggcaacaagacccuccccucccgcugccaccagugcgucaucgucuccuccuccucccaccuccucggcaccaagcucggccccgagaucgagcgcgccgagugcaccauccgcaugaacgacgcccccaccaccggcuacuccgccgacgucggcaacaagaccaccuaccgcgucgucgcccacuccuccgucuuccgcguccuccgccgcccccaggaguucgucaaccgcacccccgagaccgucuucaucuucuggggcccccccuccaagaugcagaagccccagggcucccucguccgcgucauccagcgcgccggccucgucuuccccaacauggaggccuacgccgucucccccggccgcaugcgccaguucgacgaccucuuccgcggcgagaccggcaaggaccgcgagaagucccacuccuggcucuccaccggcugguucaccauggucaucgccgucgagcucugcgaccacguccacgucuacggcauggucccccccaacuacugcucccagcgcccccgccuccagcgcaugcccuaccacuacuacgagcccaagggccccgacgagugcgucaccuacauccagaacgagcacucccgcaagggcaaccaccaccgcuucaucaccgagaagcgcgucuucuccuccugggcccagcucuacggcaucaccuucucccaccccuccuggaccuga

SEQ ID NO: 3412 - RNA, 1002 nt, Artificial Sequence
  derived and/or modified sequence opt3 from SIA7F__Homo_sapiens__AAH06564
auggccugcagcagacccccuucccagugugagccaaccucucugccgcccggcccuccagcugggaggcggcaccucccccuuucacgccgacguagagaaaugaguagcaacaaggagcaaagguccgcaguguucgucauccuguuugccuugauuacaauauuaauccuguacucuucaaauucggcgaacgaaguuuuccauuauggaagccuacggggucgcaguagaaggccugugaaucucaaaaagugguccauuacugacggcuacguaccaauccuggggaacaaaacgcuucccucucggugccaccagugugugauugucagcuccucaagucaucuguugggaaccaagcucggcccugagaucgaacgcgcugagugcacaauacgaaugaaugaugccccaacuaccgguuauagcgcagacguggggaacaaaacaaccuacagaguuguggcccacucuuccgucuuuagggugcugcggcguccgcaggaguucguaaaucgcacucccgaaacaguuuuuaucuucuggggaccuccaucaaagaugcagaagccccaaggcagccuggugagagucauucagagggcuggccucguguuuccuaacauggaggcauaugccgugaguccagggcggaugcgacaguucgaugacuuauuucgcggagaaaccgguaaagauagagagaagucucauuccuggcugagcacgggcugguucacuauggucaucgcuguugagcuuugugaccacgugcacguauacgggauggugcccccgaauuauugcucgcagaggccucgguugcaacgcaugcccuaccauuacuaugaaccaaaaggaccugaugagugugucaccuacauucagaacgaacacucuagaaagggcaaucaucacagguuuaucacagagaaacguguguucuccucaugggcccagcuguaugguauaacuuuuagucaccccagcuggaccuga

SEQ ID NO: 3413 - RNA, 1002 nt, Artificial Sequence
  derived and/or modified sequence opt4 from SIA7F__Homo_sapiens__AAH06564
auggccugcagcagaccccccagccagugcgagcccaccagccugccccccggcccccccgccggcagaagacaccugccccugagcagaagaagaagagagaugagcagcaacaaggagcagagaagcgccguguucgugauccuguucgcccugaucaccauccugauccuguacagcagcaacagcgccaacgagguguuccacuacggcagccugagaggcagaagcagaagacccgugaaccugaagaaguggagcaucaccgacggcuacgugcccauccugggcaacaagacccugcccagcagaugccaccagugcgugaucgugagcagcagcagccaccugcugggcaccaagcugggccccgagaucgagagagccgagugcaccaucagaaugaacgacgcccccaccaccggcuacagcgccgacgugggcaacaagaccaccuacagagugguggcccacagcagcguguucagagugcugagaagaccccaggaguucgugaacagaacccccgagaccguguucaucuucuggggcccccccagcaagaugcagaagccccagggcagccuggugagagugauccagagagccggccugguguuccccaacauggaggccuacgccgugagccccggcagaaugagacaguucgacgaccuguucagaggcgagaccggcaaggacagagagaagagccacagcuggcugagcaccggcugguucaccauggugaucgccguggagcugugcgaccacgugcacguguacggcauggugccccccaacuacugcagccagagacccagacugcagagaaugcccuaccacuacuacgagcccaagggccccgacgagugcgugaccuacauccagaacgagcacagcagaaagggcaaccaccacagauucaucaccgagaagagaguguucagcagcugggcccagcuguacggcaucaccuucagccaccccagcuggaccuga

SEQ ID NO: 3414 - RNA, 1002 nt, Artificial Sequence
  derived and/or modified sequence opt5 from SIA7F__Homo_sapiens__AAH06564
auggccugcagcagacccccuucccagugugagccgaccucucugcccccugggcccccugcuggccggcgccaccucccccugagcagacggcgcagagaaauguccucuaacaaggagcaacggagcgccguguucgucauccuuuuugcgcugauuacaauccucauucuguacuccucuaauagcgcuaacgaaguuuuccauuauggaucccuucgcggcagaagccggcgcccugugaaucugaaaaaguggucuaucacggacggguacgugccgauucucggaaacaaaacccugcccuccagaugccaccagugugucaucgugucuagcuccagccaucugcucggcacaaagcuggggccugagaucgaacgggccgagugcaccauucgcaugaaugaugcccccacaaccggauauucugcugacguuggcaacaaaacaaccuacagaguggucgcccacuccagcguguuucggguucuucgcagaccucaggaguucgugaaucggacgcccgaaaccgucuuuaucuucuggggcccgccuuccaagaugcagaagccccaagggucucuggugagagugauucagcgcgcuggacucgucuuuccuaacauggaggccuaugcgguuagccccggccggaugagacaguucgaugaccuguuucgcggggaaacaggaaaagaucgggagaagucccauagcuggcuuucuaccggcugguucacaauggugaucgccguggagcugugugaccacguccacguguacgggaugguucccccuaauuauugcucccagagaccgcgccuccaacggaugcccuaccauuacuaugaaccuaaaggacccgaugagugugugaccuacauucagaacgaacacagcagaaagggcaaucaucaccgcuuuaucacggagaaacgggucuucucuagcugggcucagcuguauggcauuacauuuucccacccuucuuggaccuga

SEQ ID NO: 3415 - protein, 356 aa, Artificial Sequence
  SIA8A__Homo_sapiens__Q92185
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 3416 - RNA, 1071 nt, Artificial Sequence
  SIA8A__Homo_sapiens__AAC37586
augagccccugcgggcgggcccggcgacaaacguccagaggggccauggcuguacuggcguggaaguucccgcggacccggcugcccaugggagccagugcccucugugucgugguccucuguuggcucuacaucuuccccgucuaccggcugcccaacgagaaagagaucgugcagggggugcugcaacagggcacggcguggaggaggaaccagaccgcggccagagcguucaggaaacaaauggaagacugcugcgacccugcccaucucuuugcuaugacuaaaaugaauuccccuauggggaagagcaugugguaugacggggaguuuuuauacucauucaccauugacaauucaacuuacucucucuucccacaggcaaccccauuccagcugccauugaagaaaugcgcgguggugggaaauggugggauucugaagaagaguggcuguggccgucaaauagaugaagcaaauuuugucaugcgaugcaaucucccuccuuugucaagugaauacacuaaggauguuggauccaaaagucaguuagugacagcuaaucccagcauaauucggcaaagguuucagaaccuucugugguccagaaagacauuuguggacaacaugaaaaucuauaaccacaguuacaucuacaugccugccuuuucuaugaagacaggaacagagccaucuuugaggguuuauuauacacugucagauguuggugccaaucaaacagugcuguuugccaaccccaacuuucugcguagcauuggaaaguucuggaaaaguagaggaauccaugccaagcgccuguccacaggacuuuuucuggugagcgcagcucugggucucugugaagagguggccaucuauggcuucuggcccuucucugugaauaugcaugagcagcccaucagccaccacuacuaugacaacgucuuacccuuuucuggcuuccaugccaugcccgaggaauuucuccaacucugguaucuucauaaaaucggugcacugagaaugcagcuggacccaugugaagauaccucacuccagcccacuuccuag

SEQ ID NO: 3417 - RNA, 1071 nt, Artificial Sequence
  derived and/or modified sequence opt1 from SIA8A__Homo_sapiens__AAC37586
augagccccugcggccgcgcccggcgccagaccucccgcggggccauggcggugcuggccuggaaguucccgcggacccggcuccccaugggcgccagcgcccugugcgucguggugcugugcuggcucuacaucuuccccgucuaccgccugcccaacgagaaggagaucgugcagggggugcugcagcagggcacggccuggcggcgcaaccagaccgcggcccgggccuuccgcaagcagauggaggacugcugcgacccggcccaccucuucgcgaugaccaagaugaacucccccaugggcaagagcaugugguacgacggggaguuccuguacuccuucaccaucgacaacagcacguacucccuguucccccaggccacccccuuccagcucccgcugaagaagugcgccgucgugggcaacgggggcauccugaagaaguccgggugcggccggcagaucgacgaggccaacuucgugaugcgcugcaaccucccgccccugagcagcgaguacaccaaggacgucggguccaagagccagcuggugaccgccaaccccuccaucauccggcagcgcuuccagaaccuccuguggagccggaagacguucguggacaacaugaagaucuacaaccacuccuacaucuacaugcccgcguucagcaugaagaccggcaccgagcccucccugcgcgucuacuacacccucagcgacgugggcgccaaccagacggugcuguucgccaaccccaacuuccugcgguccaucgggaaguucuggaagucccgcggcauccacgccaagcggcucagcaccgggcuguuccuggucagcgccgcgcucggccugugcgaggagguggccaucuacggcuucuggcccuucagcgugaacaugcacgagcagccgaucucccaccacuacuacgacaacguccugcccuucagcggguuccacgccaugcccgaggaguuccuccagcugugguaccugcacaagaucggcgcccuccgcaugcagcuggaccccugcgaggacaccucccugcagccgaccagcuga

SEQ ID NO: 3418 - RNA, 1071 nt, Artificial Sequence
  derived and/or modified sequence opt2 from SIA8A__Homo_sapiens__AAC37586
augucccccugcggccgcgcccgccgccagaccucccgcggcgccauggccguccucgccuggaaguucccccgcacccgccuccccaugggcgccuccgcccucugcgucgucguccucugcuggcucuacaucuuccccgucuaccgccuccccaacgagaaggagaucguccagggcguccuccagcagggcaccgccuggcgccgcaaccagaccgccgcccgcgccuuccgcaagcagauggaggacugcugcgaccccgcccaccucuucgccaugaccaagaugaacucccccaugggcaaguccaugugguacgacggcgaguuccucuacuccuucaccaucgacaacuccaccuacucccucuucccccaggccacccccuuccagcucccccucaagaagugcgccgucgucggcaacggcggcauccucaagaaguccggcugcggccgccagaucgacgaggccaacuucgucaugcgcugcaaccuccccccccucuccuccgaguacaccaaggacgucggcuccaagucccagcucgucaccgccaaccccuccaucauccgccagcgcuuccagaaccuccucuggucccgcaagaccuucgucgacaacaugaagaucuacaaccacuccuacaucuacaugcccgccuucuccaugaagaccggcaccgagcccucccuccgcgucuacuacacccucuccgacgucggcgccaaccagaccguccucuucgccaaccccaacuuccuccgcuccaucggcaaguucuggaagucccgcggcauccacgccaagcgccucuccaccggccucuuccucgucuccgccgcccucggccucugcgaggaggucgccaucuacggcuucuggcccuucuccgucaacaugcacgagcagcccaucucccaccacuacuacgacaacguccuccccuucuccggcuuccacgccaugcccgaggaguuccuccagcucugguaccuccacaagaucggcgcccuccgcaugcagcucgaccccugcgaggacaccucccuccagcccaccuccuga

SEQ ID NO: 3419 - RNA, 1071 nt, Artificial Sequence
  derived and/or modified sequence opt3 from SIA8A__Homo_sapiens__AAC37586
augagccccugcggcagagccaggcggcagaccucccgcggggcuauggcagugcuggccuggaaguucccucgaacacgucucccaaugggagcgucugcucuuugugucguugugcugugcugguuguacaucuuuccgguauauagauuacccaacgagaaagaaauugugcaagguguccugcagcagggcacugccuggaggcggaaucagacggcagcccgcgcuuucagaaagcaaauggaggacuguugcgauccugcacaccuauuugccaugaccaaaaugaacucaccaauggggaagaguaugugguacgacggagaguuccucuauagcuuuacaauagauaauuccacuuacucucuguucccccaggcuaccccuuuucagcuuccacugaaaaagugugccgugguuggcaacggugggaucuugaagaaaucgggaugcggcaggcagauugacgaagcgaauuucgugaugcgguguaaccugcccccucucucaagcgaauauacaaaggaugucggcaguaaaucccaacuggugaccgcaaauccaucuaucauucgccagcgauuucagaaccucuuauggagcagaaagacuuucguagacaauaugaaaaucuacaaccauuccuauauauacaugccggccuuuucaaugaagacagggaccgagcccagucugaggguuuacuauacgcuuagcgaugugggagcuaaucagacugucuuguucgccaacccuaauuuucugcggucuaucgguaaguucuggaaaucccguggcauucacgcaaagcgccuaucaaccggacucuuccuggugagcgcugcccuugggcugugcgaggaaguggcgaucuacggcuuuuggccauucagugucaacaugcaugagcaacccauuucucaccauuauuacgacaauguuuugccuuuuuccgguuuccacgccaugccagaagaguuucuccagcugugguauuuacacaaaaucggggcacugagaaugcagcucgaucccugugaggacacaagccuucaaccgacuucguga

SEQ ID NO: 3420 - RNA, 1071 nt, Artificial Sequence
  derived and/or modified sequence opt4 from SIA8A__Homo_sapiens__AAC37586
augagccccugcggcagagccagaagacagaccagcagaggcgccauggccgugcuggccuggaaguuccccagaaccagacugcccaugggcgccagcgcccugugcgugguggugcugugcuggcuguacaucuuccccguguacagacugcccaacgagaaggagaucgugcagggcgugcugcagcagggcaccgccuggagaagaaaccagaccgccgccagagccuucagaaagcagauggaggacugcugcgaccccgcccaccuguucgccaugaccaagaugaacagccccaugggcaagagcaugugguacgacggcgaguuccuguacagcuucaccaucgacaacagcaccuacagccuguucccccaggccacccccuuccagcugccccugaagaagugcgccguggugggcaacggcggcauccugaagaagagcggcugcggcagacagaucgacgaggccaacuucgugaugagaugcaaccugcccccccugagcagcgaguacaccaaggacgugggcagcaagagccagcuggugaccgccaaccccagcaucaucagacagagauuccagaaccugcuguggagcagaaagaccuucguggacaacaugaagaucuacaaccacagcuacaucuacaugcccgccuucagcaugaagaccggcaccgagcccagccugagaguguacuacacccugagcgacgugggcgccaaccagaccgugcuguucgccaaccccaacuuccugagaagcaucggcaaguucuggaagagcagaggcauccacgccaagagacugagcaccggccuguuccuggugagcgccgcccugggccugugcgaggagguggccaucuacggcuucuggcccuucagcgugaacaugcacgagcagcccaucagccaccacuacuacgacaacgugcugcccuucagcggcuuccacgccaugcccgaggaguuccugcagcugugguaccugcacaagaucggcgcccugagaaugcagcuggaccccugcgaggacaccagccugcagcccaccagcuga

SEQ ID NO: 3421 - RNA, 1071 nt, Artificial Sequence
  derived and/or modified sequence opt5 from SIA8A__Homo_sapiens__AAC37586
augagccccugcggcagagcccggcgccagaccuccagaggggcuauggccgugcuggcguggaaguucccucggacacgccucccgaugggagcuucugcccugugugucguugugcuuugcuggcuguacaucuuucccguguauagacucccuaacgagaaagaaauuguccaaggcgugcugcagcaggggacggccuggcggcgcaaucagaccgcugccagagcuuuccggaagcaaauggaggacuguugcgaucccgcccaccuuuuugcgaugacaaaaaugaacagcccuaugggaaaguccaugugguacgacggcgaguuccuguauucuuuuaccaucgauaauagcacauacucccucuucccccaggccaccccuuuucagcugccgcugaaaaagugugcuguuguggggaacggaggcauucucaagaaaucuggcugcgggcgccagaucgacgaagccaauuucgucaugagauguaaccugcccccucuuagcuccgaauauacaaaggaugugggaagcaaaucucaacugguuaccgcuaaucccuccauuauccggcagcgcuuucagaaccuccuguggagcagaaagacguucguggacaauaugaaaaucuacaaccauucuuauauuuacaugccugccuuuuccaugaagaccggcacagagcccagccuucgggucuacuauacccugucugaugugggggcgaaucagacaguccucuucgccaacccgaauuuucugcgcuccaucggaaaguucuggaaaagcagaggcauucacgcuaagcggcuguccaccggacucuuccuggugucugccgcucuugggcugugcgaggaaguugccaucuacggcuuuuggccuuucagcgugaacaugcaugagcaacccauuucccaccauuauuacgacaaugugcucccuuuuagcggcuuccacgccaugcccgaagaguuucugcagcuuugguaucugcacaaaaucggggcucucagaaugcagcuggaucccugugaggacacgucucugcaaccuacauccuga

SEQ ID NO: 3422 - protein, 418 aa, Artificial Sequence
  SIAT9__Homo_sapiens__Q9UNP4
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 3423 - RNA, 1257 nt, Artificial Sequence
  SIAT9__Homo_sapiens__BAG50894
augcggacgaaggcggcgggcugcgcggagcggcguccccugcagccgcggaccgaggcagcggcggcaccugccggccgagcaaugccaagugaguacaccuaugugaaacugagaagugauugcucgaggccuucccugcaaugguacacccgagcucaaagcaagaugagaaggcccagcuuguuauuaaaagacauccucaaauguacauugcuuguguuuggaguguggauccuuuauauccucaaguuaaauuauacuacugaagaaugugacaugaaaaaaaugcauuauguggacccugaccauguaaagagagcucagaaauaugcucagcaagucuugcagaaggaaugucgucccaaguuugccaagacaucaauggcgcuguuauuugagcacagguauagcguggacuuacucccuuuugugcagaaggcccccaaagacagugaagcugaguccaaguacgauccuccuuuuggguuccggaaguucuccaguaaaguccagacccucuuggaacucuugccagagcacgaccucccugaacacuugaaagccaagaccugucggcgcugugugguuauuggaagcggaggaauacugcacggauuagaacugggccacacccugaaccaguucgauguugugauaagguuaaacagugcaccaguugagggauauucagaacauguuggaaauaaaacuacuauaaggaugacuuauccagagggcgcaccacugucugaccuugaauauuauuccaaugacuuauuuguugcuguuuuauuuaagaguguugauuucaacuggcuucaagcaaugguaaaaaaggaaacccugccauucuggguacgacucuucuuuuggaagcagguggcagaaaaaaucccacugcagccaaaacauuucaggauuuugaauccaguuaucaucaaagagacugccuuugacauccuucaguacucagagccucagucaagguucuggggccgagauaagaacguccccacaaucggugucauugccguugucuuagccacacaucugugcgaugaagucaguuuggcggguuuuggauaugaccucaaucaacccagaacaccuuugcacuacuucgacagucaaugcauggcugcuaugaacuuucagaccaugcauaaugugacaacggaaaccaaguuccucuuaaagcuggucaaagagggaguggugaaagaucucaguggaggcauugaucgugaauuuuga

SEQ ID NO: 3424 - RNA, 1257 nt, Artificial Sequence
  derived and/or modified sequence opt1 from SIAT9__Homo_sapiens__BAG50894
augcgcaccaaggccgccggcugcgcggagcggcgcccccugcagccgcggaccgaggccgccgccgcccccgcggggcgcgccaugcccagcgaguacacguacgugaagcuccgguccgacugcagccgccccucccugcagugguacacccgggcccagagcaagaugcgccggccgucccugcuccugaaggacauccugaagugcacccuccuggucuucggcguguggauccuguacauccucaagcugaacuacaccacggaggagugcgacaugaagaagaugcacuacguggaccccgaccacgucaagcgcgcccagaaguacgcgcagcagguccugcagaaggagugccggcccaaguucgccaagaccagcauggcccuccuguucgagcaccgcuacuccguggaccugcuccccuucgugcagaaggccccgaaggacagcgaggccgaguccaaguacgacccgcccuucggguuccggaaguucagcuccaaggugcagacccugcuggagcuccugcccgagcacgaccugcccgagcaccucaaggcgaagaccugccgccggugcguggucaucggcagcgggggcauccugcacggccuggagcucgggcacacgcugaaccaguucgacguggugauccgccugaacuccgcccccgucgagggcuacagcgagcacguggggaacaagaccaccauccggaugaccuaccccgagggcgcgccccucuccgaccuggaguacuacagcaacgaccuguucguggccguccucuucaaguccguggacuucaacuggcugcaggccauggugaagaaggagacgcugccguucuggguccgccucuucuucuggaagcaggucgccgagaagaucccccugcagcccaagcacuuccggauccugaaccccgugaucaucaaggagaccgccuucgacauccuccaguacagcgagccgcagucccgcuucugggggcgggacaagaacgugcccaccaucggcgugaucgccgugguccuggccacccaccugugcgacgaggugagccucgccggcuucggguacgaccugaaccagccccgcacgccccugcacuacuucgacagccagugcauggcggccaugaacuuccagaccaugcacaacgucaccaccgagacgaaguuccuccugaagcuggugaaggagggcguggucaaggaccucuccgggggcaucgaccgcgaguucuga

SEQ ID NO: 3425 - RNA, 1257 nt, Artificial Sequence
  derived and/or modified sequence opt2 from SIAT9__Homo_sapiens__BAG50894
augcgcaccaaggccgccggcugcgccgagcgccgcccccuccagccccgcaccgaggccgccgccgcccccgccggccgcgccaugcccuccgaguacaccuacgucaagcuccgcuccgacugcucccgccccucccuccagugguacacccgcgcccaguccaagaugcgccgccccucccuccuccucaaggacauccucaagugcacccuccucgucuucggcgucuggauccucuacauccucaagcucaacuacaccaccgaggagugcgacaugaagaagaugcacuacgucgaccccgaccacgucaagcgcgcccagaaguacgcccagcagguccuccagaaggagugccgccccaaguucgccaagaccuccauggcccuccucuucgagcaccgcuacuccgucgaccuccuccccuucguccagaaggcccccaaggacuccgaggccgaguccaaguacgacccccccuucggcuuccgcaaguucuccuccaagguccagacccuccucgagcuccuccccgagcacgaccuccccgagcaccucaaggccaagaccugccgccgcugcgucgucaucggcuccggcggcauccuccacggccucgagcucggccacacccucaaccaguucgacgucgucauccgccucaacuccgcccccgucgagggcuacuccgagcacgucggcaacaagaccaccauccgcaugaccuaccccgagggcgccccccucuccgaccucgaguacuacuccaacgaccucuucgucgccguccucuucaaguccgucgacuucaacuggcuccaggccauggucaagaaggagacccuccccuucuggguccgccucuucuucuggaagcaggucgccgagaagaucccccuccagcccaagcacuuccgcauccucaaccccgucaucaucaaggagaccgccuucgacauccuccaguacuccgagccccagucccgcuucuggggccgcgacaagaacguccccaccaucggcgucaucgccgucguccucgccacccaccucugcgacgaggucucccucgccggcuucggcuacgaccucaaccagccccgcaccccccuccacuacuucgacucccagugcauggccgccaugaacuuccagaccaugcacaacgucaccaccgagaccaaguuccuccucaagcucgucaaggagggcgucgucaaggaccucuccggcggcaucgaccgcgaguucuga

SEQ ID NO: 3426 - RNA, 1257 nt, Artificial Sequence
  derived and/or modified sequence opt3 from SIAT9__Homo_sapiens__BAG50894
augagaaccaaggccgcuggcugcgcagaaaggcggccccugcagccucgcacagaagccgcggcugccccagcagggcgagccaugccgagcgaguacacuuaugugaaacuccguuccgacuguucuagacccucacuucaaugguacacgagggcucagaguaagaugcggcgcccuagccuguuguuaaaagauauccugaagugcacccuacucgucuucggaguuuggauucuguauauacuuaaacugaacuacacaacugaagagugugacaugaagaagaugcacuauguggauccagaccauguaaaaagagcacagaaguacgcccagcaaguguugcagaaagaaugcaggcccaaguuugcuaaaaccuccauggcccuccuguucgagcaccgguauucugucgaucugcucccuuuugugcagaaggcgccaaaggacucggaggcagaaucaaaauacgaucccccuuucgguuuucgcaaguucagcaguaaaguucagacauuacuggagcuuuugccagaacaugaccugccggagcaccuaaaggccaaaaccugucgaagaugcguggucaucggcuccgggggcauucuccauggacuggagcuuggucacacucugaaucaauuugaugugguaaucagguugaacucugcucccguugaaggguacagcgagcacgugggaaauaagacaaccauucggaugacguauccugaaggcgccccacucuccgaccuggaguacuauucaaacgauuuauucgucgcagugcuguuuaaaaguguggacuucaauuggcuccaggcuauggucaagaaggaaacucuucccuuuuggguucgucuguucuuuuggaaacagguggccgagaagaucccuuugcagccaaaacauuuccgcauacuaaaccccguaaucauuaaggagaccgcguucgauauccugcaauacagcgaaccgcagucuagauuuuggggcagggacaaaaaugugccuacaauuggggucaucgccgugguucucgcaacucaccugugugacgaggugucccuugcuggauucgguuaugaucugaaccagccccggaccccauugcauuacuuugacucacaaugcauggccgcuaugaauuuccagacaaugcacaacgucaccacggaaacuaaguuucuccugaaguuagugaaagagggcguaguuaaggaucugagcgggggaauagaccgagaguucuga

SEQ ID NO: 3427 - RNA, 1257 nt, Artificial Sequence
  derived and/or modified sequence opt4 from SIAT9__Homo_sapiens__BAG50894
augagaaccaaggccgccggcugcgccgagagaagaccccugcagcccagaaccgaggccgccgccgcccccgccggcagagccaugcccagcgaguacaccuacgugaagcugagaagcgacugcagcagacccagccugcagugguacaccagagcccagagcaagaugagaagacccagccugcugcugaaggacauccugaagugcacccugcugguguucggcguguggauccuguacauccugaagcugaacuacaccaccgaggagugcgacaugaagaagaugcacuacguggaccccgaccacgugaagagagcccagaaguacgcccagcaggugcugcagaaggagugcagacccaaguucgccaagaccagcauggcccugcuguucgagcacagauacagcguggaccugcugcccuucgugcagaaggcccccaaggacagcgaggccgagagcaaguacgacccccccuucggcuucagaaaguucagcagcaaggugcagacccugcuggagcugcugcccgagcacgaccugcccgagcaccugaaggccaagaccugcagaagaugcguggugaucggcagcggcggcauccugcacggccuggagcugggccacacccugaaccaguucgacguggugaucagacugaacagcgcccccguggagggcuacagcgagcacgugggcaacaagaccaccaucagaaugaccuaccccgagggcgccccccugagcgaccuggaguacuacagcaacgaccuguucguggccgugcuguucaagagcguggacuucaacuggcugcaggccauggugaagaaggagacccugcccuucugggugagacuguucuucuggaagcagguggccgagaagaucccccugcagcccaagcacuucagaauccugaaccccgugaucaucaaggagaccgccuucgacauccugcaguacagcgagccccagagcagauucuggggcagagacaagaacgugcccaccaucggcgugaucgccguggugcuggccacccaccugugcgacgaggugagccuggccggcuucggcuacgaccugaaccagcccagaaccccccugcacuacuucgacagccagugcauggccgccaugaacuuccagaccaugcacaacgugaccaccgagaccaaguuccugcugaagcuggugaaggagggcguggugaaggaccugagcggcggcaucgacagagaguucuga

SEQ ID NO: 3428 - RNA, 1257 nt, Artificial Sequence
  derived and/or modified sequence opt5 from SIAT9__Homo_sapiens__BAG50894
augagaaccaaggccgcuggcugcgccgaacggcgcccccugcagccuagaacagaagcggcugccgccccggcugggcgggccaugcccagcgaguacacguaugugaaacuccgcuccgacuguucuagaccuagccugcaaugguacacccgggcucaguccaagaugcgcagacccucucuucugcucaaagauauccugaagugcacacuucuggucuucggaguuuggauucucuauauccugaaacugaacuacaccacagaagagugugacaugaagaagaugcacuauguggauccugaccaugugaaacgggcccagaaguacgcgcagcaaguccuccagaaagaaugccgccccaaguuugccaaaaccagcauggcucugcuuuucgagcacagauauuccguggaucugcucccuuuuguucagaaggccccgaaggacucugaggcugaaagcaaauacgaucccccuuucggcuuucggaaguucuccagcaaagugcagacacugcuugagcugcuccccgaacaugaccugccugagcaccugaaggccaaaaccugucgcagaugcgucgugauugggucuggaggcauccuccaugggcuggagcuuggacacacgcugaaucaauuugauguugugauucggcucaacuccgcgcccgucgaaggcuacagcgagcacgugggcaauaagaccacaauccgcaugaccuauccggaaggggccccucugucugaccuugaguacuauuccaacgaucuguucguggcuguccucuuuaaaagcguugacuucaauuggcugcaggccauggugaagaaggaaacacugcccuuuugggugagacucuucuuuuggaaacaggucgcugagaagaucccucugcagcccaaacauuuccggauucuuaaccccgugaucauuaaggagaccgccuucgauauccugcaauacucugaaccucaguccagauuuuggggacgcgacaaaaauguuccgacgauuggcgugaucgccgucgugcucgcuacacaccugugugacgagguuagccuugcgggguucggauaugaucugaaccagccccggaccccucuccauuacuuugacucccaaugcauggccgcuaugaauuuccagacaaugcacaacgugaccaccgaaacaaaguuucugcugaagcucgucaaagagggcguggucaaggaucugucugggggaauugacagagaguucuga

SEQ ID NO: 3429 - protein, 352 aa, Artificial Sequence
  SIRT2/m__Homo_sapiens__A0A024R0G8
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 3430 - RNA, 1059 nt, Artificial Sequence
  SIRT2/m__Homo_sapiens__EAW56837
auggacuuccugcggaacuuauucucccagacgcucagccugggcagccagaaggagcgucugcuggacgagcugaccuuggaagggguggcccgguacaugcagagcgaacgcugucgcagagucaucuguuuggugggagcuggaaucuccacauccgcaggcauccccgacuuucgcucuccauccaccggccucuaugacaaccuagagaaguaccaucuucccuacccagaggccaucuuugagaucagcuauuucaagaaacauccggaacccuucuucgcccucgccaaggaacucuauccugggcaguucaagccaaccaucugucacuacuucaugcgccugcugaaggacaaggggcuacuccugcgcugcuacacgcagaacauagauacccuggagcgaauagccgggcuggaacaggaggacuugguggaggcgcacggcaccuucuacacaucacacugcgucagcgccagcugccggcacgaauacccgcuaagcuggaugaaagagaagaucuucucugaggugacgcccaagugugaagacugucagagccuggugaagccugauaucgucuuuuuuggugagagccucccagcgcguuucuucuccuguaugcagucagacuuccugaagguggaccuccuccuggucauggguaccuccuugcaggugcagcccuuugccucccucaucagcaaggcaccccucuccaccccucgccugcucaucaacaaggagaaagcuggccagucggacccuuuccuggggaugauuaugggccucggaggaggcauggacuuugacuccaagaaggccuacagggacguggccuggcugggugaaugcgaccagggcugccuggcccuugcugagcuccuuggauggaagaaggagcuggaggaccuuguccggagggagcacgccagcauagaugcccagucgggggcggggguccccaaccccagcacuucagcuucccccaagaaguccccgccaccugccaaggacgaggccaggacaacagagagggagaaaccccaguga

SEQ ID NO: 3431 - RNA, 1059 nt, Artificial Sequence
  derived and/or modified sequence opt1 from SIRT2/m__Homo_sapiens__EAW56837
auggacuuccugcgcaaccucuucagccagacccugagccugggcagccagaaggagcggcuccuggacgagcugacccucgaggggguggcccgcuacaugcaguccgagcggugccgccgggucaucugccuggugggcgccgggaucagcacguccgcgggcauccccgacuuccgcagccccuccaccgggcuguacgacaaccucgagaaguaccaccuccccuaccccgaggccaucuucgagaucagcuacuucaagaagcaccccgagccguucuucgcccuggccaaggagcuguaccccggccaguucaagcccaccaucugccacuacuucaugcggcugcugaaggacaagggccuccugcugcgcugcuacacccagaacaucgacacgcucgagcggaucgccgggcuggagcaggaggaccugguggaggcgcacggcaccuucuacaccucccacugcgucagcgccuccugccgccacgaguacccccucagcuggaugaaggagaagaucuucuccgaggugaccccgaagugcgaggacugccagagccuggugaagcccgacaucgucuucuucggggagucccugcccgcccgguucuucagcugcaugcaguccgacuuccucaagguggaccugcugcucgugaugggcacgagccugcagguccagcccuucgccucccugaucagcaaggcgccgcucagcacgccccgccugcugaucaacaaggagaaggccgggcaguccgaccccuuccucggcaugaucaugggccucgggggcgggauggacuucgacagcaagaaggccuaccgggacguggccuggcugggcgagugcgaccagggcugccuggcccuggcggagcugcucggguggaagaaggagcuggaggaccuggugcgccgggagcacgccuccaucgacgcccagagcggcgccgggguccccaacccguccaccagcgccucccccaagaaguccccgccgcccgcgaaggacgaggcccgcaccaccgagcgggagaagccccaguga

SEQ ID NO: 3432 - RNA, 1059 nt, Artificial Sequence
  derived and/or modified sequence opt2 from SIRT2/m__Homo_sapiens__EAW56837
auggacuuccuccgcaaccucuucucccagacccucucccucggcucccagaaggagcgccuccucgacgagcucacccucgagggcgucgcccgcuacaugcaguccgagcgcugccgccgcgucaucugccucgucggcgccggcaucuccaccuccgccggcauccccgacuuccgcucccccuccaccggccucuacgacaaccucgagaaguaccaccuccccuaccccgaggccaucuucgagaucuccuacuucaagaagcaccccgagcccuucuucgcccucgccaaggagcucuaccccggccaguucaagcccaccaucugccacuacuucaugcgccuccucaaggacaagggccuccuccuccgcugcuacacccagaacaucgacacccucgagcgcaucgccggccucgagcaggaggaccucgucgaggcccacggcaccuucuacaccucccacugcgucuccgccuccugccgccacgaguacccccucuccuggaugaaggagaagaucuucuccgaggucacccccaagugcgaggacugccagucccucgucaagcccgacaucgucuucuucggcgagucccuccccgcccgcuucuucuccugcaugcaguccgacuuccucaaggucgaccuccuccucgucaugggcaccucccuccagguccagcccuucgccucccucaucuccaaggccccccucuccaccccccgccuccucaucaacaaggagaaggccggccaguccgaccccuuccucggcaugaucaugggccucggcggcggcauggacuucgacuccaagaaggccuaccgcgacgucgccuggcucggcgagugcgaccagggcugccucgcccucgccgagcuccucggcuggaagaaggagcucgaggaccucguccgccgcgagcacgccuccaucgacgcccaguccggcgccggcguccccaaccccuccaccuccgccucccccaagaagucccccccccccgccaaggacgaggcccgcaccaccgagcgcgagaagccccaguga

SEQ ID NO: 3433 - RNA, 1059 nt, Artificial Sequence
  derived and/or modified sequence opt3 from SIRT2/m__Homo_sapiens__EAW56837
auggacuuccugagaaaccucuuuagccagacccuuucccugggcucucaaaaggagagguuguuagaugaacugacacuagaggggguggcccgguacaugcagucagaacgcugccgacgugucaucugucucguuggagcugguauuaguacuagcgcaggcauacccgacuucagauccccuucuacggggcuguaugauaaucuugagaaauaccaucugccauauccggaagccaucuuugagauuucguacuucaagaaacaccccgagccauuuuucgcguuggcuaaggaacucuauccuggacaguuuaaacccaccaucugccacuacuucaugaggcugcugaaggacaagggccucuuacugcgguguuauacacagaacauugauacucuugagcgcaucgccgguuuggaacaagaggaccugguggaggcacaugggaccuuuuacacaucacacugcguaagcgccaguuguagacaugaauacccucuauccuggaugaaagagaagauauucucugaagugaccccaaaaugcgaggauugucagagccucgucaagcccgacaucguguuuuucggagaaucccugccugcuagguuuuucucaugcaugcagagugauuuccuuaaaguugaccuguugcucgugaugggcacuagccugcagguccaaccauuugcaucuuuaauuuccaaggccccgcugucaacaccccggcuccuuaucaauaaggagaaagcuggccagagcgauccuuuccuggggaugauuaugggauuggguggcgggauggacuuugauaguaagaaagccuaucgcgacguggcguggcuaggagagugugaccagggcugccuggcacucgccgaacugcuugguuggaagaaagagcuggaagauuugguacgaagagagcacgcuucuaucgacgcccaguccggggcaggaguuccaaaccccagcaccucggcuucuccuaagaaauccccacccccggccaaggaugaagcgaggacgacugagcgggagaagccucaauga

SEQ ID NO: 3434 - RNA, 1059 nt, Artificial Sequence
  derived and/or modified sequence opt4 from SIRT2/m__Homo_sapiens__EAW56837
auggacuuccugagaaaccuguucagccagacccugagccugggcagccagaaggagagacugcuggacgagcugacccuggagggcguggccagauacaugcagagcgagagaugcagaagagugaucugccuggugggcgccggcaucagcaccagcgccggcauccccgacuucagaagccccagcaccggccuguacgacaaccuggagaaguaccaccugcccuaccccgaggccaucuucgagaucagcuacuucaagaagcaccccgagcccuucuucgcccuggccaaggagcuguaccccggccaguucaagcccaccaucugccacuacuucaugagacugcugaaggacaagggccugcugcugagaugcuacacccagaacaucgacacccuggagagaaucgccggccuggagcaggaggaccugguggaggcccacggcaccuucuacaccagccacugcgugagcgccagcugcagacacgaguacccccugagcuggaugaaggagaagaucuucagcgaggugacccccaagugcgaggacugccagagccuggugaagcccgacaucguguucuucggcgagagccugcccgccagauucuucagcugcaugcagagcgacuuccugaagguggaccugcugcuggugaugggcaccagccugcaggugcagcccuucgccagccugaucagcaaggccccccugagcacccccagacugcugaucaacaaggagaaggccggccagagcgaccccuuccugggcaugaucaugggccugggcggcggcauggacuucgacagcaagaaggccuacagagacguggccuggcugggcgagugcgaccagggcugccuggcccuggccgagcugcugggcuggaagaaggagcuggaggaccuggugagaagagagcacgccagcaucgacgcccagagcggcgccggcgugcccaaccccagcaccagcgccagccccaagaagagccccccccccgccaaggacgaggccagaaccaccgagagagagaagccccaguga

SEQ ID NO: 3435 - RNA, 1059 nt, Artificial Sequence
  derived and/or modified sequence opt5 from SIRT2/m__Homo_sapiens__EAW56837
auggacuuccugagaaaccucuuuagccagacccugucccuuggcucucaaaaggagcggcugcucgaugaacugacacuugaggggguggcccgcuacaugcagagcgaaagaugccggcgcgucaucugucugguuggagcuggcauuuccacgucugccgggauccccgacuucagaagcccuuccaccggacucuaugauaaucuggagaaauaccaucugccguaucccgaagcgauuuuugagaucucuuacuucaagaaacacccugagcccuuuuucgcucucgccaaggaacuguauccuggccaguuuaaacccacaauuugccacuacuucaugcggcuucugaaggacaaggggcuccugcuucgcuguuauacccagaacaucgauacacuggagagaaucgccggacucgaacaagaggaccugguggaggcucauggcaccuuuuacacaagccacugcguguccgccagcugucggcaugaauacccucugucuuggaugaaagagaagauuuucuccgaagucaccccgaaaugcgaggauugucagagccucgugaagcccgacaucguguuuuucggcgaaucucugccugcucgcuuuuucuccugcaugcagagcgauuuccuuaaaguugaccugcuccuggucauggggacgucucuucaggugcaacccuuugccucccugauuagcaaggcgccucucuccacccccagacugcugaucaauaaggagaaagccggacagucugauccguuccucggcaugauuauggggcugggaggcgggauggacuuugauagcaagaaagccuaucgggacguugcuuggcuuggagagugugaccagggcugccuggcucucgccgaacugcuuggcuggaagaaagagcuggaagaucucgugcgcagagagcacgcguccaucgacgcccagagcggggcuggagucccuaaccccucuacauccgccagcccuaagaaaucucccccucccgcuaaggaugaagcccggaccacagagcgcgagaagccgcaauga

SEQ ID NO: 3436 - protein, 389 aa, Artificial Sequence
  SIRT2/m__Homo_sapiens__Q8IXJ6
MAEPDPSHPLETQAGKVQEAQDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 3437 - RNA, 1170 nt, Artificial Sequence
  SIRT2/m__Homo_sapiens__AAD40850
auggcagagccagaccccucucacccucuggagacccaggcagggaaggugcaggaggcucaggacucagauucagacucugagggaggagccgcugguggagaagcagacauggacuuccugcggaacuuauucucccagacgcucagccugggcagccagaaggagcgucugcuggacgagcugaccuuggaagggguggcccgguacaugcagagcgaacgcugucgcagagucaucuguuuggugggagcuggaaucuccacauccgcaggcauccccgacuuucgcucuccauccaccggccucuaugacaaccuagagaaguaccaucuucccuacccagaggccaucuuugagaucagcuauuucaagaaacauccggaacccuucuucgcccucgccaaggaacucuauccugggcaguucaagccaaccaucugucacuacuucaugcgccugcugaaggacaaggggcuacuccugcgcugcuacacgcagaacauagauacccuggagcgaauagccgggcuggaacaggaggacuugguggaggcgcacggcaccuucuacacaucacacugcgucagcgccagcugccggcacgaauacccgcuaagcuggaugaaagagaagaucuucucugaggugacgcccaagugugaagacugucagagccuggugaagccugauaucgucuuuuuuggugagagccucccagcgcguuucuucuccuguaugcagucagacuuccugaagguggaccuccuccuggucauggguaccuccuugcaggugcagcccuuugccucccucaucagcaaggcaccccucuccaccccucgccugcucaucaacaaggagaaagcuggccagucggacccuuuccuggggaugauuaugggccucggaggaggcauggacuuugacuccaagaaggccuacagggacguggccuggcugggugaaugcgaccagggcugccuggcccuugcugagcuccuuggauggaagaaggagcuggaggaccuuguccggagggagcacgccagcauagaugcccagucgggggcggggguccccaaccccagcacuucagcuucccccaagaaguccccgccaccugccaaggacgaggccaggacaacagagagggagaaaccccaguga

SEQ ID NO: 3438 - RNA, 1170 nt, Artificial Sequence
  derived and/or modified sequence opt1 from SIRT2/m__Homo_sapiens__AAD40850
auggccgagcccgaccccagccacccccuggagacccaggccggcaaggugcaggaggcgcaggacagcgacagcgacuccgagggcggggccgccgggggcgaggccgacauggacuuccuccgcaaccuguucagccagacccugucccucgggagccagaaggagcggcugcuggacgagcucacgcuggagggcgucgcccgcuacaugcaguccgagcggugccgccgggugaucugccuggugggcgcggggaucagcaccuccgccggcauccccgacuuccgcagccccuccaccgggcucuacgacaaccuggagaaguaccaccucccguaccccgaggccaucuucgagaucagcuacuucaagaagcaccccgagcccuucuucgcccuggcgaaggagcuguacccgggccaguucaagcccaccaucugccacuacuucaugcggcugcucaaggacaaggggcugcugcuccgcugcuacacgcagaacaucgacacccuggagcggaucgccggccuggagcaggaggaccucgucgaggcccacggcaccuucuacaccucccacugcgugagcgccuccugccgccacgaguacccccugagcuggaugaaggagaagaucuucuccgaggugacgcccaagugcgaggacugccagagccuggucaagccggacaucguguucuucggggagucccuccccgcccgguucuucagcugcaugcagagcgacuuccugaagguggaccugcuccuggucaugggcaccucccuccaggugcagcccuucgcgagccugaucuccaaggcgccccugagcaccccgcgccugcucaucaacaaggagaaggccgggcaguccgaccccuuccugggcaugaucaugggccucgggggcgggauggacuucgacagcaagaaggccuaccgggacguggccuggcugggcgagugcgaccaggggugccuggcccuggccgagcuccugggcuggaagaaggagcuggaggaccucguccgccgggagcacgccuccaucgacgcccagagcggcgccggggugcccaaccccuccaccagcgcguccccgaagaaguccccgccgcccgccaaggacgaggcccgcacgaccgagcgggagaagccccaguga

SEQ ID NO: 3439 - RNA, 1170 nt, Artificial Sequence
  derived and/or modified sequence opt2 from SIRT2/m__Homo_sapiens__AAD40850
auggccgagcccgaccccucccacccccucgagacccaggccggcaagguccaggaggcccaggacuccgacuccgacuccgagggcggcgccgccggcggcgaggccgacauggacuuccuccgcaaccucuucucccagacccucucccucggcucccagaaggagcgccuccucgacgagcucacccucgagggcgucgcccgcuacaugcaguccgagcgcugccgccgcgucaucugccucgucggcgccggcaucuccaccuccgccggcauccccgacuuccgcucccccuccaccggccucuacgacaaccucgagaaguaccaccuccccuaccccgaggccaucuucgagaucuccuacuucaagaagcaccccgagcccuucuucgcccucgccaaggagcucuaccccggccaguucaagcccaccaucugccacuacuucaugcgccuccucaaggacaagggccuccuccuccgcugcuacacccagaacaucgacacccucgagcgcaucgccggccucgagcaggaggaccucgucgaggcccacggcaccuucuacaccucccacugcgucuccgccuccugccgccacgaguacccccucuccuggaugaaggagaagaucuucuccgaggucacccccaagugcgaggacugccagucccucgucaagcccgacaucgucuucuucggcgagucccuccccgcccgcuucuucuccugcaugcaguccgacuuccucaaggucgaccuccuccucgucaugggcaccucccuccagguccagcccuucgccucccucaucuccaaggccccccucuccaccccccgccuccucaucaacaaggagaaggccggccaguccgaccccuuccucggcaugaucaugggccucggcggcggcauggacuucgacuccaagaaggccuaccgcgacgucgccuggcucggcgagugcgaccagggcugccucgcccucgccgagcuccucggcuggaagaaggagcucgaggaccucguccgccgcgagcacgccuccaucgacgcccaguccggcgccggcguccccaaccccuccaccuccgccucccccaagaagucccccccccccgccaaggacgaggcccgcaccaccgagcgcgagaagccccaguga

SEQ ID NO: 3440 - RNA, 1170 nt, Artificial Sequence
  derived and/or modified sequence opt3 from SIRT2/m__Homo_sapiens__AAD40850
auggccgagcccgacccuagccacccacuggaaacccaggcuggcaaggugcaagaggcacaggauuccgacucugauucagaagggggagccgcggguggcgaggcugacauggauuuccucagaaaccuuuuuagucagacacugagcuuggggucccagaaagaaagguuacuggacgagcuaacucucgagggagucgcccgguacaugcaaucugaacgcugccgacguguuaucugucuggugggcgcagguauuucgacgucagccgggauaccggauuucagaagccccaguaccggacuuuaugacaaucuggagaaguaccauuugccuuauccagaagcuaucuuugagauuuccuacuucaaaaagcaccccgagccauuuuucgcacucgccaaagaacuguauccuggccaguuuaagcccacaaucugccauuacuucaugaggcugcucaaggauaaaggcuuacugcuucgguguuauacucagaacauugacaccuuggagcgcaucgcugggcuggaacaggaggaucuaguagaagcccacggaacauuuuacaccucucauugcgugagcgcguccuguagacacgaguacccucucucauggaugaaggagaaaauauucagugaagucacuccaaagugcgaggacugucaaagccuggugaaaccggauaucguguuuuucggugaaucucuucccgcaagguuuuucuccugcaugcagucagacuuccugaagguugacuugcuccuggucaugggcaccagcuuacaggugcagccuuuugccagucugauuucuaaggcuccacucuccacaccccggcuucugaucaauaaagagaaggccgggcaaagcgauccuuucuugggaaugauuaugggccuaggugggggaauggacuuugauucgaaaaaggcauaucgcgacguagcuuggcugggcgaaugugaucagggcugccucgcccuggcggagcuucugggguggaaaaaggaguuggaagaccucguucgaagagagcacgccucuaucgaugcacaguccggagcuggugugccaaaccccucaacgagugccagcccgaaaaaguccccucccccagcuaaggacgaagccaggacuaccgagcgggaaaaaccucaauga

SEQ ID NO: 3441 - RNA, 1170 nt, Artificial Sequence
  derived and/or modified sequence opt4 from SIRT2/m__Homo_sapiens__AAD40850
auggccgagcccgaccccagccacccccuggagacccaggccggcaaggugcaggaggcccaggacagcgacagcgacagcgagggcggcgccgccggcggcgaggccgacauggacuuccugagaaaccuguucagccagacccugagccugggcagccagaaggagagacugcuggacgagcugacccuggagggcguggccagauacaugcagagcgagagaugcagaagagugaucugccuggugggcgccggcaucagcaccagcgccggcauccccgacuucagaagccccagcaccggccuguacgacaaccuggagaaguaccaccugcccuaccccgaggccaucuucgagaucagcuacuucaagaagcaccccgagcccuucuucgcccuggccaaggagcuguaccccggccaguucaagcccaccaucugccacuacuucaugagacugcugaaggacaagggccugcugcugagaugcuacacccagaacaucgacacccuggagagaaucgccggccuggagcaggaggaccugguggaggcccacggcaccuucuacaccagccacugcgugagcgccagcugcagacacgaguacccccugagcuggaugaaggagaagaucuucagcgaggugacccccaagugcgaggacugccagagccuggugaagcccgacaucguguucuucggcgagagccugcccgccagauucuucagcugcaugcagagcgacuuccugaagguggaccugcugcuggugaugggcaccagccugcaggugcagcccuucgccagccugaucagcaaggccccccugagcacccccagacugcugaucaacaaggagaaggccggccagagcgaccccuuccugggcaugaucaugggccugggcggcggcauggacuucgacagcaagaaggccuacagagacguggccuggcugggcgagugcgaccagggcugccuggcccuggccgagcugcugggcuggaagaaggagcuggaggaccuggugagaagagagcacgccagcaucgacgcccagagcggcgccggcgugcccaaccccagcaccagcgccagccccaagaagagccccccccccgccaaggacgaggccagaaccaccgagagagagaagccccaguga

SEQ ID NO: 3442 - RNA, 1170 nt, Artificial Sequence
  derived and/or modified sequence opt5 from SIRT2/m__Homo_sapiens__AAD40850
auggccgagcccgacccuagccacccgcuggaaacccaggcuggcaaggugcaagaggcccaggauuccgacucugauagcgaagggggagcggcuggcggggaggccgacauggauuuccucagaaaccuguuuucccagacacuuucucugggaagccagaaagaacggcuccuggacgagcuuacgcuggagggcgucgcccgcuacaugcaauccgaaagaugccggcgcguuaucugucucgugggggcuggaauuucuaccagcgccggcauccccgauuucagauccccuagcacaggccuguaugacaaucuggagaaguaccaucuccccuauccugaagcuauuuuugagaucucuuacuucaaaaagcaccccgagccguuuuucgcccuggcgaaagaacuuuauccugggcaguuuaagcccaccauuugccauuacuucaugcggcugcucaaggauaaaggacugcuucugcgcuguuauacacagaacaucgacacccucgagagaaucgccggccuggaacaggaggaucugguggaagcucacgggacauuuuacaccucccauugcgucagcgccucuugucggcacgaguacccucucuccuggaugaaggagaaaauuuucagcgaagugacgcccaagugcgaggacugucaaucucugguuaaaccugauaucguguuuuucggagaaucccuucccgcucgcuuuuucagcugcaugcaguccgacuuccugaaggucgaccuccugcuugugaugggcaccucucugcagguucagccguuugccagccucauuuccaaggcgccucugagcacacccagacugcucaucaauaaagagaaggccgggcaaucugauccuuuccugggaaugauuaugggccuuggcgggggaauggacuuugauuccaaaaaggcuuaucgggacguggccuggcugggcgaaugugaucaggggugccucgcucuggccgagcuucugggauggaaaaaggagcucgaagaccugguccgcagagagcacgccagcaucgaugcucagucuggcgcgggggugcccaaccccagcaccuccgccucuccuaaaaagagcccgcccccugcuaaggacgaagcccggacaaccgagcgcgaaaaaccccaauga

SEQ ID NO: 3443 - protein, 466 aa, Artificial Sequence
  SOX10__Homo_sapiens__P56693
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 3444 - RNA, 1401 nt, Artificial Sequence
  SOX10__Homo_sapiens__AAH02824
auggcggaggagcaggaccuaucggagguggagcugagccccgugggcucggaggagccccgcugccuguccccggggagcgcgcccucgcuagggcccgacggcggcggcggcggaucgggccugcgagccagcccggggccaggcgagcugggcaaggucaagaaggagcagcaggacggcgaggcggacgaugacaaguuccccgugugcauccgcgaggccgucagccaggugcucagcggcuacgacuggacgcuggugcccaugcccgugcgcgucaacggcgccagcaaaagcaagccgcacgucaagcggcccaugaacgccuucauggugugggcucaggcagcgcgcaggaagcucgcggaccaguacccgcaccugcacaacgcugagcucagcaagacgcugggcaagcucuggaggcugcugaacgaaagugacaagcgccccuucaucgaggaggcugagcggcuccguaugcagcacaagaaagaccacccggacuacaaguaccagcccaggcggcggaagaacgggaaggccgcccagggcgaggcggagugccccgguggggaggccgagcaaggugggaccgccgccauccaggcccacuacaagagcgcccacuuggaccaccggcacccaggagagggcucccccaugucagaugggaaccccgagcaccccucaggccagagccauggcccacccaccccuccaaccaccccgaagacagagcugcagucgggcaaggcagacccgaagcgggacgggcgcuccaugggggagggcgggaagccucacaucgacuucggcaacguggacauuggugagaucagccacgagguaauguccaacauggagaccuuugauguggcugaguuggaccaguaccugccgcccaaugggcacccaggccaugugagcagcuacucagcagccggcuaugggcugggcagugcccuggccguggccaguggacacuccgccuggaucuccaagccaccaggcguggcucugcccacggucucaccaccugguguggaugccaaagcccaggugaagacagagaccgcggggccccaggggcccccacacuacaccgaccagccauccaccucacagaucgccuacaccucccucagccugccccacuauggcucagccuuccccuccaucucccgcccccaguuugacuacucugaccaucagcccucaggacccuauuauggccacucgggccaggccucuggccucuacucggccuucuccuauauggggcccucgcagcggccccucuacacggccaucucugaccccagccccucagggccccagucccacagccccacacacugggagcagccaguauauacgacacugucccggcccuaa

SEQ ID NO: 3445 - RNA, 1401 nt, Artificial Sequence
  derived and/or modified sequence opt1 from SOX10__Homo_sapiens__AAH02824
auggccgaggagcaggaccugagcgagguggagcucucccccgucggcagcgaggagccgcgcugccugucccccgggagcgcccccucccugggccccgacgggggcgggggcggcagcgggcuccgggcguccccgggccccggggagcugggcaaggugaagaaggagcagcaggacggggaggccgacgacgacaaguuccccgugugcauccgcgaggccgucagccaggugcuguccggcuacgacuggacccucgugcccaugccgguccgggugaacggcgccagcaaguccaagccccacgugaagcgccccaugaacgccuucauggucugggcgcaggccgcccggcgcaagcuggccgaccaguacccccaccuccacaacgcggagcucagcaagacccuggggaagcuguggcggcuccugaacgaguccgacaagcgcccguucaucgaggaggccgagcggcugcgcaugcagcacaagaaggaccaccccgacuacaaguaccagccccggcgccggaagaacggcaaggccgcccagggggaggccgagugccccggcggcgaggcggagcagggcgggacggccgccauccaggcccacuacaagagcgcccaccucgaccaccgccacccgggggagggcucccccaugagcgacgggaaccccgagcaccccuccggccagagccacggcccgcccaccccgcccaccacccccaagacggagcugcaguccgggaaggcggaccccaagcgggacggccgcagcaugggggagggcgggaagccccacaucgacuucggcaacguggacaucggcgagaucagccacgaggugauguccaacauggagaccuucgacgucgccgagcuggaccaguaccugcccccgaacgggcaccccggccacgugagcuccuacagcgccgccggguacggccugggguccgcccuggcgguggccagcggccacuccgccuggaucagcaagcccccgggcgucgcccuccccaccguguccccgcccgggguggacgccaaggcgcaggucaagaccgagacggccggcccccaggggccgccccacuacaccgaccagcccagcaccucccagaucgccuacaccagccugucccugccccacuacggcagcgccuuccccuccaucagccggccccaguucgacuacuccgaccaccagcccagcggcccguacuacgggcacuccggccaggcgagcgggcucuacagcgccuucuccuacaugggccccagccagcgcccccuguacacggccaucuccgaccccagcccguccgggccccagagccacucccccacccacugggagcagcccguguacaccacccugagccggccguga

SEQ ID NO: 3446 - RNA, 1401 nt, Artificial Sequence
  derived and/or modified sequence opt2 from SOX10__Homo_sapiens__AAH02824
auggccgaggagcaggaccucuccgaggucgagcucucccccgucggcuccgaggagccccgcugccucucccccggcuccgcccccucccucggccccgacggcggcggcggcggcuccggccuccgcgccucccccggccccggcgagcucggcaaggucaagaaggagcagcaggacggcgaggccgacgacgacaaguuccccgucugcauccgcgaggccgucucccagguccucuccggcuacgacuggacccucguccccaugcccguccgcgucaacggcgccuccaaguccaagccccacgucaagcgccccaugaacgccuucauggucugggcccaggccgcccgccgcaagcucgccgaccaguacccccaccuccacaacgccgagcucuccaagacccucggcaagcucuggcgccuccucaacgaguccgacaagcgccccuucaucgaggaggccgagcgccuccgcaugcagcacaagaaggaccaccccgacuacaaguaccagccccgccgccgcaagaacggcaaggccgcccagggcgaggccgagugccccggcggcgaggccgagcagggcggcaccgccgccauccaggcccacuacaaguccgcccaccucgaccaccgccaccccggcgagggcucccccauguccgacggcaaccccgagcaccccuccggccagucccacggcccccccaccccccccaccacccccaagaccgagcuccaguccggcaaggccgaccccaagcgcgacggccgcuccaugggcgagggcggcaagccccacaucgacuucggcaacgucgacaucggcgagaucucccacgaggucauguccaacauggagaccuucgacgucgccgagcucgaccaguaccucccccccaacggccaccccggccacgucuccuccuacuccgccgccggcuacggccucggcuccgcccucgccgucgccuccggccacuccgccuggaucuccaagccccccggcgucgcccuccccaccgucuccccccccggcgucgacgccaaggcccaggucaagaccgagaccgccggcccccagggccccccccacuacaccgaccagcccuccaccucccagaucgccuacaccucccucucccucccccacuacggcuccgccuuccccuccaucucccgcccccaguucgacuacuccgaccaccagcccuccggccccuacuacggccacuccggccaggccuccggccucuacuccgccuucuccuacaugggccccucccagcgcccccucuacaccgccaucuccgaccccucccccuccggcccccagucccacucccccacccacugggagcagcccgucuacaccacccucucccgccccuga

SEQ ID NO: 3447 - RNA, 1401 nt, Artificial Sequence
  derived and/or modified sequence opt3 from SOX10__Homo_sapiens__AAH02824
auggccgaggaacaggaccugagcgagguggaacucucccccgucggcucugaggaaccuagaugccuuucaccagggagugcuccgagccugggacccgaugguggcgggggaggcuccgguuugagggcaucuccugggccaggagaguuaggcaagguuaaaaaggagcaacaggacggcgaagccgaugacgauaaauuccccguguguauccgggaggcgguaucgcaagugcugucaggguacgacuggacccuagucccuaugccagugcgcguuaacggagcuagcaagaguaaaccccacgugaagcgaccuaugaaugccuuuauggucugggcacaggccgcucguagaaagcucgcagaucaauauccacaucugcacaacgccgaacuuuccaaaacacuggguaaguuguggaggcuccugaaugagucugacaaacggccguucauugaggaagcugagcgccugagaaugcagcauaagaaagaucaccccgacuacaaguaucagccuaggcggcgcaagaacggcaaagccgcgcagggggaagcagagugcccaggaggcgaagccgagcaaggugggacugcugccauacaggcacauuacaagagcgcucaccucgaucaccgacaucccggagagggcuccccuaugucagacggcaauccagaacaccccagugggcagagccauggaccgccuacgcccccaaccacaccuaaaacugaguuacagucugguaaggccgaucccaaaagagacggcagguccaugggggaaggaggcaagccacacaucgacuuugguaacguggauauuggggagaucucacacgaaguaaugagcaauauggagaccuucgacguugcggagcuggaucaauaucuucccccuaacggccauccaggacacgugaguucuuacuccgccgcaggcuauggguugggaagcgcucuggccgucgcuucgggucauucugccuggauuuccaaaccgcccggcguggcacuaccuacagugucaccacccggggucgacgccaaggcucagguuaagaccgaaacugcgggaccucagggcccaccccacuacacagaucaaccgaguaccagccagaucgcauacacgucccucucucugccucauuaugguagcgccuuuccaucaauaagucggccccaguucgacuacuccgaucaccagccuagcgggcccuauuacggccacucuggacaggcuucaggccuuuauagugccuuuagcuacauggggccaucccagcguccucuguauacugcaaucucugaccccucgccaagcggaccgcagucccauucaccuacccacugggagcagcccguguacacaacuuugagucgcccauga

SEQ ID NO: 3448 - RNA, 1401 nt, Artificial Sequence
  derived and/or modified sequence opt4 from SOX10__Homo_sapiens__AAH02824
auggccgaggagcaggaccugagcgagguggagcugagccccgugggcagcgaggagcccagaugccugagccccggcagcgcccccagccugggccccgacggcggcggcggcggcagcggccugagagccagccccggccccggcgagcugggcaaggugaagaaggagcagcaggacggcgaggccgacgacgacaaguuccccgugugcaucagagaggccgugagccaggugcugagcggcuacgacuggacccuggugcccaugcccgugagagugaacggcgccagcaagagcaagccccacgugaagagacccaugaacgccuucauggugugggcccaggccgccagaagaaagcuggccgaccaguacccccaccugcacaacgccgagcugagcaagacccugggcaagcuguggagacugcugaacgagagcgacaagagacccuucaucgaggaggccgagagacugagaaugcagcacaagaaggaccaccccgacuacaaguaccagcccagaagaagaaagaacggcaaggccgcccagggcgaggccgagugccccggcggcgaggccgagcagggcggcaccgccgccauccaggcccacuacaagagcgcccaccuggaccacagacaccccggcgagggcagccccaugagcgacggcaaccccgagcaccccagcggccagagccacggcccccccaccccccccaccacccccaagaccgagcugcagagcggcaaggccgaccccaagagagacggcagaagcaugggcgagggcggcaagccccacaucgacuucggcaacguggacaucggcgagaucagccacgaggugaugagcaacauggagaccuucgacguggccgagcuggaccaguaccugccccccaacggccaccccggccacgugagcagcuacagcgccgccggcuacggccugggcagcgcccuggccguggccagcggccacagcgccuggaucagcaagccccccggcguggcccugcccaccgugagcccccccggcguggacgccaaggcccaggugaagaccgagaccgccggcccccagggccccccccacuacaccgaccagcccagcaccagccagaucgccuacaccagccugagccugccccacuacggcagcgccuuccccagcaucagcagaccccaguucgacuacagcgaccaccagcccagcggccccuacuacggccacagcggccaggccagcggccuguacagcgccuucagcuacaugggccccagccagagaccccuguacaccgccaucagcgaccccagccccagcggcccccagagccacagccccacccacugggagcagcccguguacaccacccugagcagacccuga

SEQ ID NO: 3449 - RNA, 1401 nt, Artificial Sequence
  derived and/or modified sequence opt5 from SOX10__Homo_sapiens__AAH02824
auggccgaggaacaggaccugagcgagguggaacucucccccgucggcucugaggaaccuagaugccugagcccgggguccgcucccucucuuggaccugauggcgggggaggcgggagcggacugcgggccucccccggcccuggcgagcucgggaagguuaaaaaggagcaacaggacggagaagcggaugacgauaaauuccccguguguauccgcgaggcugugucucagguccugagcggcuacgacuggacccuugugccuaugccgguuagagugaacggggccuccaagagcaaaccccacgucaagcggccuaugaaugccuuuauggugugggcucaggccgcucgcagaaagcuggccgaucaauauccccaucuccacaacgcggaacugucuaaaacacugggaaagcucuggcggcugcuuaaugaguccgacaaacgcccuuucauugaggaagccgagagacugcggaugcagcauaagaaagaucaccccgacuacaaguaucagccgcgcagacggaagaacggcaaagcugcccagggggaagcugagugcccuggaggcgaagccgagcaaggcgggacggcggccauccaggcucauuacaagagcgcccaccucgaucaccgccaucccggagagggcucuccuauguccgacgggaaucccgaacaccccagcggacagucucauggcccuccgacacccccuaccacccccaaaacagagcugcaguccgggaaggcugauccuaaaagagacggacggagcaugggcgaaggcgggaagccccacauugacuuuggaaacguugauaucggcgagauuucccacgaagugaugucuaauauggagaccuucgacgucgccgagcuugaucaauaucugccgccuaacgggcaucccggacacgugagcuccuacagcgccgcuggcuaugggcucggcucugcgcuggccguggcuuccggacauagcgccuggaucucuaaaccucccggcgucgcccugccuacaguuagcccgcccgggguggacgcuaaggcccaggugaagaccgaaacggcgggaccucagggcccuccccacuacaccgaucaacccuccacaucucagaucgcuuacaccagccucucccugccgcauuaugggagcgccuuucccucuauuucccgcccucaguucgacuacagcgaucaccagcccucuggaccuuauuacggccacuccgggcaagccagcggccuuuauuccgcuuuuucuuacaugggacccagccagagaccucuguauacagccaucuccgaccccucuccgagcggcccucagucccauagccccacccacugggagcagccugucuacacgacacucucucggcccuga

SEQ ID NO: 3450 - protein, 151 aa, Artificial Sequence
  SP17__Homo_sapiens__Q15506
MSIPFSNTHYRIPQGFGNLLEGLTREILREQPDNIPAFAAAYFESLLEKREKTNFDPAEWGSKVEDRFYNNHAFEEQEPPEKSDPKQEESQISGKEEETSVTILDSSEEDKEKEEVAAVKIQAAFRGHIAREEAKKMKTNSLQNEEKEENK

SEQ ID NO: 3451 - RNA, 456 nt, Artificial Sequence
  SP17__Homo_sapiens__AAH32457
augucgauuccauucuccaacacccacuaccgaauuccacaaggauuugggaaucuucuugaagggcugacacgcgagauucugagagagcaaccggacaauauaccagcuuuugcagcagccuauuuugagagccuucuagagaaaagagagaaaaccaacuuugauccagcagaaugggggaguaagguagaagaccgcuucuauaacaaucaugcauucgaggagcaagaaccaccugagaaaagugauccuaaacaagaagagucucagauaucugggaaggaggaagagacaucagucaccaucuuagacucuucugaggaagauaaggaaaaagaagagguugcugcugucaaaauccaagcugccuuccggggacacauagccagagaggaggcaaagaaaaugaaaacaaauagucuucaaaaugaggaaaaagaggaaaacaaguga

SEQ ID NO: 3452 - RNA, 456 nt, Artificial Sequence
  derived and/or modified sequence opt1 from SP17__Homo_sapiens__AAH32457
augagcauccccuucuccaacacccacuaccgcaucccgcagggcuucgggaaccugcucgagggccugacccgggagauccugcgcgagcagcccgacaacauccccgccuucgccgcggccuacuucgagagccuccuggagaagcgggagaagacgaacuucgaccccgccgaguggggguccaagguggaggaccgcuucuacaacaaccacgccuucgaggagcaggagccgcccgagaaguccgaccccaagcaggaggagagccagaucagcggcaaggaggaggagaccuccgucaccauccuggacagcuccgaggaggacaaggagaaggaggagguggccgcggugaagauccaggccgccuuccgggggcacaucgcccgcgaggaggcgaagaagaugaagaccaacagccuccagaacgaggagaaggaggagaacaaguga

SEQ ID NO: 3453 - RNA, 456 nt, Artificial Sequence
  derived and/or modified sequence opt2 from SP17__Homo_sapiens__AAH32457
auguccauccccuucuccaacacccacuaccgcaucccccagggcuucggcaaccuccucgagggccucacccgcgagauccuccgcgagcagcccgacaacauccccgccuucgccgccgccuacuucgagucccuccucgagaagcgcgagaagaccaacuucgaccccgccgaguggggcuccaaggucgaggaccgcuucuacaacaaccacgccuucgaggagcaggagccccccgagaaguccgaccccaagcaggaggagucccagaucuccggcaaggaggaggagaccuccgucaccauccucgacuccuccgaggaggacaaggagaaggaggaggucgccgccgucaagauccaggccgccuuccgcggccacaucgcccgcgaggaggccaagaagaugaagaccaacucccuccagaacgaggagaaggaggagaacaaguga

SEQ ID NO: 3454 - RNA, 456 nt, Artificial Sequence
  derived and/or modified sequence opt3 from SP17__Homo_sapiens__AAH32457
augagcauccccuucuccaacacccacuacaggauuccucagggcuuugggaaucugcucgagggacuuacaagagaaauacugcgggagcaaccagacaacaucccggccuucgcugcagccuauuuugaaucuuuguuagagaagcgcgagaaaacuaauuucgaucccgcggagugggguucaaagguggaggaccgauuuuacaacaaucaugcuuucgaagaacaggaaccuccagagaaaagugaucccaagcaggaggaaagccagauuuccggcaaagaggaagagacgucugucaccauccuggacucgucagaagaggauaaggagaaggaagagguugccgcagugaaaauucaagccgcuuuucgugggcacaucgcaagagaagaggccaagaaaaugaagacaaacagccuacagaaugaagagaaagaggaaaacaaguga

SEQ ID NO: 3455 - RNA, 456 nt, Artificial Sequence
  derived and/or modified sequence opt4 from SP17__Homo_sapiens__AAH32457
augagcauccccuucagcaacacccacuacagaaucccccagggcuucggcaaccugcuggagggccugaccagagagauccugagagagcagcccgacaacauccccgccuucgccgccgccuacuucgagagccugcuggagaagagagagaagaccaacuucgaccccgccgaguggggcagcaagguggaggacagauucuacaacaaccacgccuucgaggagcaggagccccccgagaagagcgaccccaagcaggaggagagccagaucagcggcaaggaggaggagaccagcgugaccauccuggacagcagcgaggaggacaaggagaaggaggagguggccgccgugaagauccaggccgccuucagaggccacaucgccagagaggaggccaagaagaugaagaccaacagccugcagaacgaggagaaggaggagaacaaguga

SEQ ID NO: 3456 - RNA, 456 nt, Artificial Sequence
  derived and/or modified sequence opt5 from SP17__Homo_sapiens__AAH32457
augagcauccccuucuccaacacccacuaccggauuccucagggcuuugggaaucugcucgagggacugacaagagaaauccuucgcgagcaaccggacaacauucccgccuucgcugccgcguauuuugaaucucugcucgagaagagagagaaaacgaauuucgauccugcugaguggggcagcaagguggaggaccgguuuuacaacaaucaugccuucgaagaacaggaacccccugagaaauccgaucccaagcaggaggaaucucagaucagcgggaaagaggaagagaccuccgucacaauucuggacucuagcgaagaggauaaggagaaggaagagguugccgcugugaaaauccaagccgcuuuucgcggacacaucgccagagaagaggcgaagaaaaugaagaccaacucccuucagaaugaagagaaagaggaaaacaaguga

SEQ ID NO: 3457 - protein, 97 aa, Artificial Sequence
  SPNXA__Homo_sapiens__Q9NS26
MDKQSSAGGVKRSVPCDSNEANEMMPETPTGDSDPQPAPKKMKTSESSTILVVRYRRNFKRTSPEELLNDHARENRINPLQMEEEEFMEIMVEIPAK

SEQ ID NO: 3458 - RNA, 294 nt, Artificial Sequence
  SPNXA__Homo_sapiens__AAF28420
auggacaaacaauccagugccggcggggugaagaggagcguccccugugauuccaacgaggccaacgagaugaugccggagaccccaacuggggacucagacccgcaaccugcuccuaaaaaaaugaaaacaucugaguccucgaccauacuagugguucgcuacaggaggaacuuuaaaagaacaucuccagaggaacugcugaaugaccacgcccgagagaacagaaucaacccccuccaaauggaggaggaggaauucauggaaauaaugguugaaauaccugcaaaguag

SEQ ID NO: 3459 - RNA, 294 nt, Artificial Sequence
  derived and/or modified sequence opt1 from SPNXA__Homo_sapiens__AAF28420
auggacaagcagagcuccgccggcggggugaagcgcagcguccccugcgacuccaacgaggccaacgagaugaugccggagacccccaccggcgacagcgacccccagcccgcgccgaagaagaugaagacguccgagagcuccaccauccugguggugcgguaccgccggaacuucaagcgcaccagccccgaggagcuccugaacgaccacgcccgggagaaccgcaucaacccccugcagauggaggaggaggaguucauggagaucauggucgagauccccgccaaguga

SEQ ID NO: 3460 - RNA, 294 nt, Artificial Sequence
  derived and/or modified sequence opt2 from SPNXA__Homo_sapiens__AAF28420
auggacaagcaguccuccgccggcggcgucaagcgcuccguccccugcgacuccaacgaggccaacgagaugaugcccgagacccccaccggcgacuccgacccccagcccgcccccaagaagaugaagaccuccgaguccuccaccauccucgucguccgcuaccgccgcaacuucaagcgcaccucccccgaggagcuccucaacgaccacgcccgcgagaaccgcaucaacccccuccagauggaggaggaggaguucauggagaucauggucgagauccccgccaaguga

SEQ ID NO: 3461 - RNA, 294 nt, Artificial Sequence
  derived and/or modified sequence opt3 from SPNXA__Homo_sapiens__AAF28420
auggacaagcagagcuccgccggcggggugaaaagaucuguccccugcgauucaaacgaggcuaaugaaaugaugccugagaccccaacaggagacagugauccgcaacccgcaccuaagaaaaugaagacuagcgaauccucuacgauccugguugugagguaccggcgcaacuucaaacgaaccucgccagaggaacuccuuaaugaccacgcccgugagaacagaauuaauccccugcagauggaggaagaggaauuuauggagauaaugguagagaucccugcgaaguga

SEQ ID NO: 3462 - RNA, 294 nt, Artificial Sequence
  derived and/or modified sequence opt4 from SPNXA__Homo_sapiens__AAF28420
auggacaagcagagcagcgccggcggcgugaagagaagcgugcccugcgacagcaacgaggccaacgagaugaugcccgagacccccaccggcgacagcgacccccagcccgcccccaagaagaugaagaccagcgagagcagcaccauccugguggugagauacagaagaaacuucaagagaaccagccccgaggagcugcugaacgaccacgccagagagaacagaaucaacccccugcagauggaggaggaggaguucauggagaucaugguggagauccccgccaaguga

SEQ ID NO: 3463 - RNA, 294 nt, Artificial Sequence
  derived and/or modified sequence opt5 from SPNXA__Homo_sapiens__AAF28420
auggacaagcagagcuccgccggcggggugaaaagaucuguccccugcgauagcaacgaggcuaaugaaaugaugccugagaccccgacaggagacuccgauccccaaccugcccccaagaaaaugaagacgucugaaagcuccaccauccugguugugcgguaccgcagaaacuucaaacggacaucuccugaggaacuccugaaugaccacgcgcgcgagaacagaauuaauccccuucagauggaggaagaggaauuuauggagaucaugguggagauuccugcuaaguga

SEQ ID NO: 3464 - protein, 141 aa, Artificial Sequence
  SPXN3__Homo_sapiens__Q5MJ09
MEQPTSSTNGEKTKSPCESNNKKNDEMQEVPNRVLAPEQSLKKTKTSEYPIIFVYYLRKGKKINSNQLENEQSQENSINPIQKEEDEGVDLSEGSSNEDEDLGPCEGPSKEDKDLDSSEGSSQEDEDLGLSEGSSQDSGED

SEQ ID NO: 3465 - RNA, 426 nt, Artificial Sequence
  SPXN3__Homo_sapiens__AAH62750
auggaacagccaacuuccaguaccaauggggagaagacgaagagccccugugaauccaauaacaaaaaaaaugaugagaugcaagagguaccaaacagagucuuagcccccgaacagaguuugaagaagacaaaaacaucagaauauccaauaauauuuguguauuaccucaggaaggguaagaaaauaaauucaaaucaacuggagaaugaacagucccaagagaacuccaucaauccaauccaaaaggaggaggacgaaggcguagacuuaucugaaggaucuucaaaugaggaugaagaccuaggcccaugugaaggaccuucaaaggaggacaaagaucuagacucaucugaaggauccucacaggaggaugaagaccuaggcuuaucugaaggaucuucacaggacaguggggaggauuag

SEQ ID NO: 3466 - RNA, 426 nt, Artificial Sequence
  derived and/or modified sequence opt1 from SPXN3__Homo_sapiens__AAH62750
auggagcagcccaccagcuccaccaacggcgagaagaccaagagcccgugcgaguccaacaacaagaagaacgacgagaugcaggaggugcccaaccgcguccuggcccccgagcagagccucaagaagacgaagaccuccgaguaccccaucaucuucguguacuaccugcggaaggggaagaagaucaacagcaaccagcuggagaacgagcagucccaggagaacagcaucaacccgauccagaaggaggaggacgagggcguggaccucuccgaggggagcuccaacgaggacgaggaccugggccccugcgaggggcccagcaaggaggacaaggaccuggacuccagcgagggcuccagccaggaggacgaggaccucggccuguccgaggggagcucccaggacagcggcgaggacuga

SEQ ID NO: 3467 - RNA, 426 nt, Artificial Sequence
  derived and/or modified sequence opt2 from SPXN3__Homo_sapiens__AAH62750
auggagcagcccaccuccuccaccaacggcgagaagaccaagucccccugcgaguccaacaacaagaagaacgacgagaugcaggagguccccaaccgcguccucgcccccgagcagucccucaagaagaccaagaccuccgaguaccccaucaucuucgucuacuaccuccgcaagggcaagaagaucaacuccaaccagcucgagaacgagcagucccaggagaacuccaucaaccccauccagaaggaggaggacgagggcgucgaccucuccgagggcuccuccaacgaggacgaggaccucggccccugcgagggccccuccaaggaggacaaggaccucgacuccuccgagggcuccucccaggaggacgaggaccucggccucuccgagggcuccucccaggacuccggcgaggacuga

SEQ ID NO: 3468 - RNA, 426 nt, Artificial Sequence
  derived and/or modified sequence opt3 from SPXN3__Homo_sapiens__AAH62750
auggagcagcccaccagcuccacaaacggcgaaaagacuaaaucuccuugcgagucaaauaacaagaaaaaugacgaaaugcaagaggugccaaacagaguccuggccccggaacagagucucaagaaaacgaagaccagcgaguaccccaucauuuucguuuauuaccuuaggaaggggaaaaagauaaauuccaaccagcuggagaaugaacagucucaagagaacucgaucaauccuauucagaaagaagaggaugagggaguggacuugucagaagguagcaguaacgaggaugaagacuuaggcccaugugaggggcccuccaaggaagauaaagaccuggauucuagcgagggauccucacaggaggacgaagaucuaggccucagugaggguagcucucaggacuccggggaagauuga

SEQ ID NO: 3469 - RNA, 426 nt, Artificial Sequence
  derived and/or modified sequence opt4 from SPXN3__Homo_sapiens__AAH62750
auggagcagcccaccagcagcaccaacggcgagaagaccaagagccccugcgagagcaacaacaagaagaacgacgagaugcaggaggugcccaacagagugcuggcccccgagcagagccugaagaagaccaagaccagcgaguaccccaucaucuucguguacuaccugagaaagggcaagaagaucaacagcaaccagcuggagaacgagcagagccaggagaacagcaucaaccccauccagaaggaggaggacgagggcguggaccugagcgagggcagcagcaacgaggacgaggaccugggccccugcgagggccccagcaaggaggacaaggaccuggacagcagcgagggcagcagccaggaggacgaggaccugggccugagcgagggcagcagccaggacagcggcgaggacuga

SEQ ID NO: 3470 - RNA, 426 nt, Artificial Sequence
  derived and/or modified sequence opt5 from SPXN3__Homo_sapiens__AAH62750
auggagcagcccaccagcuccacaaacggcgaaaagacgaaaucuccuugcgagagcaauaacaagaaaaaugacgaaaugcaagaggugccgaacagaguccuggcccccgaacagucccucaagaaaaccaagacaucugaguacccuaucauuuucguuuauuaccugcggaaggggaaaaagaucaauagcaaccagcuugagaaugaacagucccaagagaacucuauuaaucccauccagaaagaagaggaugagggaguggaccugagcgaaggcuccagcaacgaggaugaagaccucgggccuugugagggacccucuaaggaagauaaagaccuggauuccagcgaggggucuucccaggaggacgaagaucuuggccugagcgagggaucuucccaggacagcggcgaagauuga

SEQ ID NO: 3471 - protein, 188 aa, Artificial Sequence
  SSX-1__Homo_sapiens__Q16384
MNGDDTFAKRPRDDAKASEKRSKAFDDIATYFSKKEWKKMKYSEKISYVYMKRNYKAMTKLGFKVTLPPFMCNKQATDFQGNDFDNDHNRRIQVEHPQMTFGRLHRIIPKIMPKKPAEDENDSKGVSEASGPQNDGKQLHPPGKANISEKINKRSGPKRGKHAWTHRLRERKQLVIYEEISDPEEDDE

SEQ ID NO: 3472 - RNA, 567 nt, Artificial Sequence
  SSX-1__Homo_sapiens__AAH01003
augaacggagacgacaccuuugcaaagagacccagggaugaugcuaaagcaucagagaagagaagcaaggccuuugaugauauugccacauacuucucuaagaaagaguggaaaaagaugaaauacucggagaaaaucagcuauguguauaugaagagaaacuauaaggccaugacuaaacuagguuucaaagucacccucccaccuuucauguguaauaaacaggccacagacuuccaggggaaugauuuugauaaugaccauaaccgcaggauucagguugaacauccucagaugacuuucggcaggcuccacagaaucaucccgaagaucaugcccaagaagccagcagaggacgaaaaugauucgaagggagugucagaagcaucuggcccacaaaacgaugggaaacaacugcaccccccaggaaaagcaaauauuucugagaagauuaauaagagaucuggacccaaaagggggaaacaugccuggacccacagacugcgugagagaaagcagcuggugauuuaugaagagaucagcgacccugaggaagaugacgaguaa

SEQ ID NO: 3473 - RNA, 567 nt, Artificial Sequence
  derived and/or modified sequence opt1 from SSX-1__Homo_sapiens__AAH01003
augaacggcgacgacaccuucgccaagcgcccccgggacgacgccaaggcgagcgagaagcgcuccaaggccuucgacgacaucgccaccuacuucagcaagaaggaguggaagaagaugaaguacuccgagaagaucagcuacguguacaugaagcggaacuacaaggccaugacgaagcugggguucaaggucacccucccgcccuucaugugcaacaagcaggccaccgacuuccagggcaacgacuucgacaacgaccacaaccgccggauccagguggagcacccccagaugaccuucgggcgccugcaccggaucauccccaagaucaugccgaagaagcccgcggaggacgagaacgacuccaagggcgugagcgaggccuccgggccccagaacgacggcaagcagcugcacccgcccggcaaggccaacaucagcgagaagaucaacaagcgcuccgggcccaagcggggcaagcacgccuggacgcaccgccuccgggagcgcaagcagcuggucaucuacgaggagaucagcgaccccgaggaggacgacgaguga

SEQ ID NO: 3474 - RNA, 567 nt, Artificial Sequence
  derived and/or modified sequence opt2 from SSX-1__Homo_sapiens__AAH01003
augaacggcgacgacaccuucgccaagcgcccccgcgacgacgccaaggccuccgagaagcgcuccaaggccuucgacgacaucgccaccuacuucuccaagaaggaguggaagaagaugaaguacuccgagaagaucuccuacgucuacaugaagcgcaacuacaaggccaugaccaagcucggcuucaaggucacccucccccccuucaugugcaacaagcaggccaccgacuuccagggcaacgacuucgacaacgaccacaaccgccgcauccaggucgagcacccccagaugaccuucggccgccuccaccgcaucauccccaagaucaugcccaagaagcccgccgaggacgagaacgacuccaagggcgucuccgaggccuccggcccccagaacgacggcaagcagcuccacccccccggcaaggccaacaucuccgagaagaucaacaagcgcuccggccccaagcgcggcaagcacgccuggacccaccgccuccgcgagcgcaagcagcucgucaucuacgaggagaucuccgaccccgaggaggacgacgaguga

SEQ ID NO: 3475 - RNA, 567 nt, Artificial Sequence
  derived and/or modified sequence opt3 from SSX-1__Homo_sapiens__AAH01003
augaacggcgacgauaccuucgccaagagacccagggacgaugcuaaagcaagcgagaagcgguccaaagccuuugacgauaucgcgacauacuucucuaagaaagaauggaagaagaugaaauauucagagaagauuaguuacguguauaugaaacgcaauuacaaggcuaugacuaaacugggguuuaaggucacgcucccuccauucaugugcaacaagcaggccaccgacuuucaaggaaaugauuucgacaacgaucacaaucgacguauacagguugaacauccgcagaugacauuugguagacuucacaggaucauucccaaaaucaugccuaagaaaccagcagaggacgaaaacgauagcaagggcguguccgaggccucugggccccagaaugacggaaaacaacugcauccuccaggcaaggcuaacauuucggagaaaaucaauaagcggucaggucccaagcgcgggaaacacgcauggacucauagauugagggaacggaagcaguuaguaauauaugaggaaaucagcgauccugaggaggacgacgaauga

SEQ ID NO: 3476 - RNA, 567 nt, Artificial Sequence
  derived and/or modified sequence opt4 from SSX-1__Homo_sapiens__AAH01003
augaacggcgacgacaccuucgccaagagacccagagacgacgccaaggccagcgagaagagaagcaaggccuucgacgacaucgccaccuacuucagcaagaaggaguggaagaagaugaaguacagcgagaagaucagcuacguguacaugaagagaaacuacaaggccaugaccaagcugggcuucaaggugacccugccccccuucaugugcaacaagcaggccaccgacuuccagggcaacgacuucgacaacgaccacaacagaagaauccagguggagcacccccagaugaccuucggcagacugcacagaaucauccccaagaucaugcccaagaagcccgccgaggacgagaacgacagcaagggcgugagcgaggccagcggcccccagaacgacggcaagcagcugcacccccccggcaaggccaacaucagcgagaagaucaacaagagaagcggccccaagagaggcaagcacgccuggacccacagacugagagagagaaagcagcuggugaucuacgaggagaucagcgaccccgaggaggacgacgaguga

SEQ ID NO: 3477 - RNA, 567 nt, Artificial Sequence
  derived and/or modified sequence opt5 from SSX-1__Homo_sapiens__AAH01003
augaacggcgacgauaccuucgccaagagaccccgggacgaugcuaaagccagcgagaagcgcuccaaagcguuugacgauaucgcuacauacuucucuaagaaagaauggaagaagaugaaauauagcgagaagauuuccuacguguauaugaaaagaaauuacaaggccaugacgaaacugggguuuaaggucacccucccuccguucaugugcaacaagcaggccacagacuuucaaggaaaugauuucgacaacgaucacaaucggcgcauccagguugaacauccccagaugaccuuuggcagacugcaccggauuaucccuaaaauuaugcccaagaaaccugcugaggacgaaaacgauucuaagggggugagcgaggccuccggaccccagaaugacggcaaacaacuucauccuccggggaaggcuaacaucucugagaaaaucaauaagcgcagcggacccaagagaggcaaacacgccuggacacaucggcugcgcgaaagaaagcagcucgugauuuaugaggaaaucuccgauccugaggaggacgacgaauga

SEQ ID NO: 3478 - protein, 188 aa, Artificial Sequence
  SSX-2__Homo_sapiens__Q16385
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 3479 - RNA, 567 nt, Artificial Sequence
  SSX-2__Homo_sapiens__AAH16957
augaacggagacgacgccuuugcaaggagacccacgguuggugcucaaauaccagagaagauccaaaaggccuucgaugauauugccaaauacuucucuaaggaagagugggaaaagaugaaagccucagagaaaaucuucuauguguauaugaagagaaaguaugaggcuaugacuaaacuagguuucaaggccacccucccaccuuucauguguaauaaacgggccgaagacuuccaggggaaugauuuggauaaugacccuaaccgugggaaucagguugaacguccucagaugacuuucggcaggcuccagggaaucuccccgaagaucaugcccaagaagccagcagaggaaggaaaugauucggaggaagugccagaagcaucuggcccacaaaaugaugggaaagagcugugccccccgggaaaaccaacuaccucugagaagauucacgagagaucuggacccaaaaggggggaacaugccuggacccacagacugcgugagagaaaacagcuggugauuuaugaagagaucagcgacccugaggaagaugacgaguaa

SEQ ID NO: 3480 - RNA, 567 nt, Artificial Sequence
  derived and/or modified sequence opt1 from SSX-2__Homo_sapiens__AAH16957
augaacggcgacgacgccuucgcccgccggcccaccgugggggcgcagaucccggagaagauccagaaggccuucgacgacaucgccaaguacuucagcaaggaggagugggagaagaugaaggccuccgagaagaucuucuacgucuacaugaagcgcaaguacgaggccaugaccaagcugggcuucaaggcgacgcucccgcccuucaugugcaacaagcgggccgaggacuuccaggggaacgaccuggacaacgaccccaaccgcggcaaccagguggagcggccccagaugaccuucgggcgccugcagggcaucagccccaagaucaugcccaagaagcccgccgaggagggcaacgacuccgaggaggugccggaggccagcgggccccagaacgacggcaaggagcucugcccgcccgggaagcccaccaccuccgagaagauccacgagcggagcggccccaagcgcggggagcacgcguggacgcaccggcugcgcgagcggaagcagcuggucaucuacgaggagaucuccgaccccgaggaggacgacgaguga

SEQ ID NO: 3481 - RNA, 567 nt, Artificial Sequence
  derived and/or modified sequence opt2 from SSX-2__Homo_sapiens__AAH16957
augaacggcgacgacgccuucgcccgccgccccaccgucggcgcccagauccccgagaagauccagaaggccuucgacgacaucgccaaguacuucuccaaggaggagugggagaagaugaaggccuccgagaagaucuucuacgucuacaugaagcgcaaguacgaggccaugaccaagcucggcuucaaggccacccucccccccuucaugugcaacaagcgcgccgaggacuuccagggcaacgaccucgacaacgaccccaaccgcggcaaccaggucgagcgcccccagaugaccuucggccgccuccagggcaucucccccaagaucaugcccaagaagcccgccgaggagggcaacgacuccgaggagguccccgaggccuccggcccccagaacgacggcaaggagcucugcccccccggcaagcccaccaccuccgagaagauccacgagcgcuccggccccaagcgcggcgagcacgccuggacccaccgccuccgcgagcgcaagcagcucgucaucuacgaggagaucuccgaccccgaggaggacgacgaguga

SEQ ID NO: 3482 - RNA, 567 nt, Artificial Sequence
  derived and/or modified sequence opt3 from SSX-2__Homo_sapiens__AAH16957
augaacggcgacgaugccuucgcuagaaggcccaccgugggggcacagaucccugagaagauucaaaaagccuuugacgauauagcgaaguacuucagcaaagaagagugggaaaagaugaaggcuuccgagaaaaucuuuuaugucuacaugaagcggaaauaugaagccaugacaaagcugggauucaaagcaacucucccaccguuuaugugcaauaagcgcgccgaggacuuccaggguaacgaucuugacaaugaucccaaccgaggcaaucagguugagcguccucagaugacguuugggagacugcaaggaauuucuccaaaaaucaugcccaagaagccugcugaagagggcaacgacucagaagaggugccagaggcaagugguccccagaaugaugggaaagaauuguguccuccaggaaagccgaccacaagcgagaaaauucacgaaagguccggccccaagcggggcgagcaugccuggacucaccgcuuaagagaaaggaaacagcugguaaucuacgaggagauaucugacccugaagaggaugacgaauga

SEQ ID NO: 3483 - RNA, 567 nt, Artificial Sequence
  derived and/or modified sequence opt4 from SSX-2__Homo_sapiens__AAH16957
augaacggcgacgacgccuucgccagaagacccaccgugggcgcccagauccccgagaagauccagaaggccuucgacgacaucgccaaguacuucagcaaggaggagugggagaagaugaaggccagcgagaagaucuucuacguguacaugaagagaaaguacgaggccaugaccaagcugggcuucaaggccacccugccccccuucaugugcaacaagagagccgaggacuuccagggcaacgaccuggacaacgaccccaacagaggcaaccagguggagagaccccagaugaccuucggcagacugcagggcaucagccccaagaucaugcccaagaagcccgccgaggagggcaacgacagcgaggaggugcccgaggccagcggcccccagaacgacggcaaggagcugugcccccccggcaagcccaccaccagcgagaagauccacgagagaagcggccccaagagaggcgagcacgccuggacccacagacugagagagagaaagcagcuggugaucuacgaggagaucagcgaccccgaggaggacgacgaguga

SEQ ID NO: 3484 - RNA, 567 nt, Artificial Sequence
  derived and/or modified sequence opt5 from SSX-2__Homo_sapiens__AAH16957
augaacggcgacgaugccuucgcuagacggcccaccgugggggcccagaucccugagaagauucaaaaagcguuugacgauaucgcuaaguacuucagcaaagaagagugggaaaagaugaaagccuccgagaagaucuuuuaugucuacaugaagcgcaaauaugaagccaugacaaagcugggauucaaagcuacgcucccgcccuuuaugugcaauaagagagccgaggacuuccagggcaacgaucuggacaaugauccuaaccgggggaaucagguugagcgcccccagaugaccuuuggaagacuucaaggcauuucuccuaaaauuaugcccaagaagccugcugaagaggggaacgacagcgaagaggugccggaggccuccggaccccagaaugauggcaaagaacuguguccucccggcaagccuacaaccucugagaaaauccacgaacggagcgggcccaagcgcggagagcaugcguggacacacagacuccgggaacgcaaacagcuggugaucuacgaggagauuuccgacccggaagaggaugacgaauga

SEQ ID NO: 3485 - protein, 188 aa, Artificial Sequence
  SSX3__Homo_sapiens__Q99909
MNGDDTFARRPTVGAQIPEKIQKAFDDIAKYFSKEEWEKMKVSEKIVYVYMKRKYEAMTKLGFKAILPSFMRNKRVTDFQGNDFDNDPNRGNQVQRPQMTFGRLQGIFPKIMPKKPAEEGNVSKEVPEASGPQNDGKQLCPPGKPTTSEKINMISGPKRGEHAWTHRLRERKQLVIYEEISDPEEDDE

SEQ ID NO: 3486 - RNA, 567 nt, Artificial Sequence
  SSX3__Homo_sapiens__AAC05819
augaacggagaugacaccuuugcaaggagacccacgguuggugcucaaauaccagagaagauacaaaaggccuucgaugauauugccaaauacuucucuaaggaagagugggaaaagaugaaagucucggagaaaaucgucuauguguauaugaagagaaaguaugaggccaugacuaaacuagguuucaaggccauccucccaucuuucaugcguaauaaacgggucacagacuuccaggggaaugauuuugauaaugacccuaaccgugggaaucagguucaacguccucagaugacuuucggcaggcuccagggaaucuucccgaagaucaugcccaagaagccagcagaggaaggaaauguuucgaaggaagugccagaagcaucuggcccacaaaacgaugggaaacagcugugccccccgggaaaaccaacuaccucugagaagauuaacaugauaucuggacccaaaaggggggaacaugccuggacccacagacugcgugagagaaagcagcuggugauuuaugaagagaucagcgauccugaggaagaugaugaguaa

SEQ ID NO: 3487 - RNA, 567 nt, Artificial Sequence
  derived and/or modified sequence opt1 from SSX3__Homo_sapiens__AAC05819
augaacggcgacgacaccuucgcccgccggcccaccgugggggcccagaucccggagaagauccagaaggcguucgacgacaucgccaaguacuucagcaaggaggagugggagaagaugaaggucuccgagaagaucguguacguguacaugaagcgcaaguacgaggccaugacgaagcugggcuucaaggccauccuccccagcuucaugcggaacaagcgcgucaccgacuuccaggggaacgacuucgacaacgaccccaaccggggcaaccaggugcagcgcccccagaugaccuucgggcggcugcagggcaucuucccgaagaucaugcccaagaagcccgccgaggagggcaacguguccaaggagguccccgaggcgagcgggccgcagaacgacggcaagcagcugugcccgcccgggaagcccaccacguccgagaagaucaacaugaucagcggccccaagcgcggggagcacgccuggacccaccggcuccgcgagcggaagcagcuggugaucuacgaggagaucuccgaccccgaggaggacgacgaguga

SEQ ID NO: 3488 - RNA, 567 nt, Artificial Sequence
  derived and/or modified sequence opt2 from SSX3__Homo_sapiens__AAC05819
augaacggcgacgacaccuucgcccgccgccccaccgucggcgcccagauccccgagaagauccagaaggccuucgacgacaucgccaaguacuucuccaaggaggagugggagaagaugaaggucuccgagaagaucgucuacgucuacaugaagcgcaaguacgaggccaugaccaagcucggcuucaaggccauccuccccuccuucaugcgcaacaagcgcgucaccgacuuccagggcaacgacuucgacaacgaccccaaccgcggcaaccagguccagcgcccccagaugaccuucggccgccuccagggcaucuuccccaagaucaugcccaagaagcccgccgaggagggcaacgucuccaaggagguccccgaggccuccggcccccagaacgacggcaagcagcucugcccccccggcaagcccaccaccuccgagaagaucaacaugaucuccggccccaagcgcggcgagcacgccuggacccaccgccuccgcgagcgcaagcagcucgucaucuacgaggagaucuccgaccccgaggaggacgacgaguga

SEQ ID NO: 3489 - RNA, 567 nt, Artificial Sequence
  derived and/or modified sequence opt3 from SSX3__Homo_sapiens__AAC05819
augaacggcgacgauaccuucgccagaaggcccacagugggggcucagaucccugagaagauucaaaaagcauuugacgauauagccaaguacuucagcaaagaagagugggaaaagaugaaagucuccgagaagaucguuuauguguacaugaagcggaaauaugaagcgaugacuaagcugggauuuaaagcuauucucccaucuuucaugcgcaauaagcgaguaacggacuuucaggguaacgauuucgacaaugauccgaaccguggcaaucaggugcagagaccccaaaugaccuuugggaggcuucagggaaucuucccuaaaauuaugccaaagaagcccgccgaggagggcaacgucucaaaagaagugccugaggcaagugguccacagaaugacgggaagcagcugugcccucccggaaaaccaacaacuagcgaaaagaucaacaugauauccggcccgaaacggggcgagcacgccuggacccaucgcuugagagagaggaagcaauuaguuaucuacgaagagauuucugaucccgaagaggacgaugaauga

SEQ ID NO: 3490 - RNA, 567 nt, Artificial Sequence
  derived and/or modified sequence opt4 from SSX3__Homo_sapiens__AAC05819
augaacggcgacgacaccuucgccagaagacccaccgugggcgcccagauccccgagaagauccagaaggccuucgacgacaucgccaaguacuucagcaaggaggagugggagaagaugaaggugagcgagaagaucguguacguguacaugaagagaaaguacgaggccaugaccaagcugggcuucaaggccauccugcccagcuucaugagaaacaagagagugaccgacuuccagggcaacgacuucgacaacgaccccaacagaggcaaccaggugcagagaccccagaugaccuucggcagacugcagggcaucuuccccaagaucaugcccaagaagcccgccgaggagggcaacgugagcaaggaggugcccgaggccagcggcccccagaacgacggcaagcagcugugcccccccggcaagcccaccaccagcgagaagaucaacaugaucagcggccccaagagaggcgagcacgccuggacccacagacugagagagagaaagcagcuggugaucuacgaggagaucagcgaccccgaggaggacgacgaguga

SEQ ID NO: 3491 - RNA, 567 nt, Artificial Sequence
  derived and/or modified sequence opt5 from SSX3__Homo_sapiens__AAC05819
augaacggcgacgauaccuucgccagacggcccacagugggggcucagaucccugagaagauucaaaaagccuuugacgauaucgcgaaguacuucagcaaagaagagugggaaaagaugaaagucuccgagaagauuguuuauguguacaugaagcgcaaauaugaagcuaugacgaagcugggauuuaaagccauccucccgucuuucaugagaaauaagcgggugaccgacuuucagggcaacgauuucgacaaugaucccaaccgcgggaaucagguccagagaccucaaaugacauuuggacggcugcagggcauuuuccccaaaaucaugccuaagaagcccgccgaggaggggaacgugagcaaagaaguuccugaggcuuccggaccgcagaaugacggcaagcagcuuugcccucccggcaaacccaccacaucugaaaagaucaacaugauuagcgggccuaaacgcggagagcacgccuggacccauagacugcgggagcgcaagcaacucgugaucuacgaagagauuuccgaucccgaagaggacgaugaauga

SEQ ID NO: 3492 - protein, 188 aa, Artificial Sequence
  SSX-4__Homo_sapiens__O60224
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKIMPKKPAEEENGLKEVPEASGPQNDGKQLCPPGNPSTLEKINKTSGPKRGKHAWTHRLRERKQLVVYEEISDPEEDDE

SEQ ID NO: 3493 - RNA, 567 nt, Artificial Sequence
  SSX-4__Homo_sapiens__AAC05820
augaacggagacgacgccuuugcaaggagacccagggaugaugcucaaauaucagagaaguuacgaaaggccuucgaugauauugccaaauacuucucuaagaaagagugggaaaagaugaaauccucggagaaaaucgucuauguguauaugaagcuaaacuaugaggucaugacuaaacuagguuucaaggucacccucccaccuuucaugcguaguaaacgggcugcagacuuccacgggaaugauuuugguaacgaucgaaaccacaggaaucagguugaacguccucagaugacuuucggcagccuccagagaaucuucccgaagaucaugcccaagaagccagcagaggaagaaaaugguuugaaggaagugccagaggcaucuggcccacaaaaugaugggaaacagcugugccccccgggaaauccaaguaccuuggagaagauuaacaagacaucuggacccaaaagggggaaacaugccuggacccacagacugcgugagagaaagcagcuggugguuuaugaagagaucagcgacccugaggaagaugacgaguaa

SEQ ID NO: 3494 - RNA, 567 nt, Artificial Sequence
  derived and/or modified sequence opt1 from SSX-4__Homo_sapiens__AAC05820
augaacggcgacgacgccuucgcccgccggccccgcgacgacgcgcagaucagcgagaagcugcggaaggccuucgacgacaucgccaaguacuucuccaagaaggagugggagaagaugaaguccagcgagaagaucguguacgucuacaugaagcucaacuacgaggugaugaccaagcugggguucaaggugacccugccgcccuucaugcgcagcaagcgggccgccgacuuccacggcaacgacuucgggaacgaccgcaaccaccggaaccaggucgagcgcccccagaugacguucggcucccuccagcggaucuuccccaagaucaugccgaagaagcccgcggaggaggagaacgggcugaaggaggugcccgaggccagcggcccccagaacgacggcaagcagcugugcccgcccgggaaccccuccacccucgagaagaucaacaagaccagcggccccaagcgcgggaagcacgccuggacccaccggcugcgcgagcggaagcagcugguggucuacgaggagaucuccgacccggaggaggacgacgaguga

SEQ ID NO: 3495 - RNA, 567 nt, Artificial Sequence
  derived and/or modified sequence opt2 from SSX-4__Homo_sapiens__AAC05820
augaacggcgacgacgccuucgcccgccgcccccgcgacgacgcccagaucuccgagaagcuccgcaaggccuucgacgacaucgccaaguacuucuccaagaaggagugggagaagaugaaguccuccgagaagaucgucuacgucuacaugaagcucaacuacgaggucaugaccaagcucggcuucaaggucacccucccccccuucaugcgcuccaagcgcgccgccgacuuccacggcaacgacuucggcaacgaccgcaaccaccgcaaccaggucgagcgcccccagaugaccuucggcucccuccagcgcaucuuccccaagaucaugcccaagaagcccgccgaggaggagaacggccucaaggagguccccgaggccuccggcccccagaacgacggcaagcagcucugcccccccggcaaccccuccacccucgagaagaucaacaagaccuccggccccaagcgcggcaagcacgccuggacccaccgccuccgcgagcgcaagcagcucgucgucuacgaggagaucuccgaccccgaggaggacgacgaguga

SEQ ID NO: 3496 - RNA, 567 nt, Artificial Sequence
  derived and/or modified sequence opt3 from SSX-4__Homo_sapiens__AAC05820
augaacggcgacgaugccuucgcuagaaggccccgggacgaugcacagaucagcgagaagcugcgcaaagccuuugacgauauugcgaaguacuucuccaaaaaggaaugggagaaaaugaagucuucagaaaagauaguguaugucuacaugaaacucaauuaugagguuaugaccaaacuuggguuuaaggugacacugccuccauucaugcgaaguaagcgugcugccgacuuucacggaaacgauuucgguaaugacagaaaccauaggaaucaaguagaacggccgcagaugacuuuuggcagcuugcagcgcaucuuccccaaaauuaugccuaagaagccagcagaggaggaaaacggguuaaaagaggugcccgaagccuccggaccucagaaugauggcaagcaacugugcccacccgguaacccuucuacgcuagagaaaaucaauaagaccucggggccaaaaagaggaaagcacgcuuggacacauaggcuccgggagcgcaaacagcuggucguguacgaagagauuucagacccggaagaggaugacgaauga

SEQ ID NO: 3497 - RNA, 567 nt, Artificial Sequence
  derived and/or modified sequence opt4 from SSX-4__Homo_sapiens__AAC05820
augaacggcgacgacgccuucgccagaagacccagagacgacgcccagaucagcgagaagcugagaaaggccuucgacgacaucgccaaguacuucagcaagaaggagugggagaagaugaagagcagcgagaagaucguguacguguacaugaagcugaacuacgaggugaugaccaagcugggcuucaaggugacccugccccccuucaugagaagcaagagagccgccgacuuccacggcaacgacuucggcaacgacagaaaccacagaaaccagguggagagaccccagaugaccuucggcagccugcagagaaucuuccccaagaucaugcccaagaagcccgccgaggaggagaacggccugaaggaggugcccgaggccagcggcccccagaacgacggcaagcagcugugcccccccggcaaccccagcacccuggagaagaucaacaagaccagcggccccaagagaggcaagcacgccuggacccacagacugagagagagaaagcagcuggugguguacgaggagaucagcgaccccgaggaggacgacgaguga

SEQ ID NO: 3498 - RNA, 567 nt, Artificial Sequence
  derived and/or modified sequence opt5 from SSX-4__Homo_sapiens__AAC05820
augaacggcgacgaugccuucgcuagacggccccgcgacgaugcccagaucagcgagaagcugagaaaagcguuugacgauauugcuaaguacuucuccaaaaaggaaugggagaaaaugaagucuagcgaaaagaucguguaugucuacaugaaacucaauuaugagguuaugaccaagcugggguuuaaagugacacuuccuccguucaugcgguccaagcgcgccgccgacuuucacggaaacgauuucggcaaugacagaaaccaucggaaucaaguggaacgcccccagaugacguuugggucucugcagagaauuuucccuaaaaucaugcccaagaagccugcugaggaggaaaacggacucaaagagguccccgaagccagcggcccucagaaugaugggaagcaacugugcccgcccggaaacccuuccacccuugagaaaauuaauaagacaucuggccccaaacggggcaagcacgcuuggacccaucgccugagagagcggaaacagcucgugguuuacgaagagaucagcgacccugaagaggaugacgaauga

SEQ ID NO: 3499 - protein, 295 aa, Artificial Sequence
  ST1A1__Homo_sapiens__P50225
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFVVQHTSFKEMKKNPMTNYTTVPQEFMDHSISPFMRKGMAGDWKTTFTVAQNERFDADYAEKMAGCSLSFRSEL

SEQ ID NO: 3500 - RNA, 888 nt, Artificial Sequence
  ST1A1__Homo_sapiens__CCDS32420.1
auggagcugauccaggacaccucccgcccgccacuggaguacgugaagggggucccgcucaucaaguacuuugcagaggcacuggggccccugcagagcuuccaggcccggccugaugaccugcucaucagcaccuaccccaaguccggcacuaccuggguaagccagauucuggacaugaucuaccaggguggugaccuggagaagugucaccgagcucccaucuucaugcgggugcccuuccuugaguucaaagccccagggauucccucagggauggagacucugaaagacacaccggccccacgacuccugaagacacaccugccccuggcucugcucccccagacucuguuggaucagaaggucaagguggucuauguugcccgcaacgcaaaggauguggcaguuuccuacuaccacuucuaccacauggccaaggugcacccugagccugggaccugggacagcuuccuggagaaguucauggucggagaaguguccuacggauccugguaccagcacgugcaggaguggugggagcugagccgcacccacccuguucucuaccucuucuaugaagacaugaaggagaacccgaaaagggagauucaaaagauccuggaguuuguggggcgcucccugccagaggagaccguggacuucgugguucagcacacgucguucaaggagaugaagaagaacccuaugaccaacuacaccaccgucccccaggaguucauggaccacagcaucucccccuucaugaggaaaggcauggcuggggacuggaagaccaccuucaccguggcgcagaaugagcgcuucgaugcggacuaugcggagaagauggcaggcugcagccucagcuuccgcucugagcuguga

SEQ ID NO: 3501 - RNA, 888 nt, Artificial Sequence
  derived and/or modified sequence opt1 from ST1A1__Homo_sapiens__CCDS32420.1
auggagcugauccaggacaccagccggcccccgcucgaguacgugaagggcgucccccugaucaaguacuucgccgaggcccuggggccccuccaguccuuccaggcgcgccccgacgaccugcugaucagcaccuacccgaaguccggcacgaccugggugagccagauccucgacaugaucuaccagggcggggaccuggagaagugccaccgcgcccccaucuucaugcgggugcccuuccuggaguucaaggcccccgggaucccguccggcauggagacccucaaggacacccccgcgccccgccugcugaagacgcaccucccccuggcccugcucccgcagacccugcuggaccagaaggucaaggugguguacgucgcccggaacgccaaggacguggccgugagcuacuaccacuucuaccacauggccaagguccaccccgagcccggcaccugggacuccuuccucgagaaguucauggugggggaggugagcuacggcuccugguaccagcacguccaggaguggugggagcugagccgcacccaccccgugcuguaccucuucuacgaggacaugaaggagaacccgaagcgggagauccagaagauccuggaguucguggggcgcucccugcccgaggagacggucgacuucguggugcagcacaccagcuucaaggagaugaagaagaaccccaugaccaacuacaccacggucccccaggaguucauggaccacuccaucagcccguucaugcggaagggcauggcgggggacuggaagaccaccuucaccguggcccagaacgagcgcuucgacgccgacuacgccgagaagauggccggcugcucccucagcuuccgguccgagcuguga

SEQ ID NO: 3502 - RNA, 888 nt, Artificial Sequence
  derived and/or modified sequence opt2 from ST1A1__Homo_sapiens__CCDS32420.1
auggagcucauccaggacaccucccgccccccccucgaguacgucaagggcgucccccucaucaaguacuucgccgaggcccucggcccccuccaguccuuccaggcccgccccgacgaccuccucaucuccaccuaccccaaguccggcaccaccugggucucccagauccucgacaugaucuaccagggcggcgaccucgagaagugccaccgcgcccccaucuucaugcgcguccccuuccucgaguucaaggcccccggcauccccuccggcauggagacccucaaggacacccccgccccccgccuccucaagacccaccucccccucgcccuccucccccagacccuccucgaccagaaggucaaggucgucuacgucgcccgcaacgccaaggacgucgccgucuccuacuaccacuucuaccacauggccaagguccaccccgagcccggcaccugggacuccuuccucgagaaguucauggucggcgaggucuccuacggcuccugguaccagcacguccaggaguggugggagcucucccgcacccaccccguccucuaccucuucuacgaggacaugaaggagaaccccaagcgcgagauccagaagauccucgaguucgucggccgcucccuccccgaggagaccgucgacuucgucguccagcacaccuccuucaaggagaugaagaagaaccccaugaccaacuacaccaccgucccccaggaguucauggaccacuccaucucccccuucaugcgcaagggcauggccggcgacuggaagaccaccuucaccgucgcccagaacgagcgcuucgacgccgacuacgccgagaagauggccggcugcucccucuccuuccgcuccgagcucuga

SEQ ID NO: 3503 - RNA, 888 nt, Artificial Sequence
  derived and/or modified sequence opt3 from ST1A1__Homo_sapiens__CCDS32420.1
auggagcugauccaggacaccagcagacccccucucgaauacgugaagggcgucccacuuauuaaauauuucgccgaggcucuggggccguugcaauccuuucaggcaaggcccgaugacuuacugauaucuacauacccuaagucaggaacuacguggguuagucagauccuagauaugauuuaucaggguggcgaccucgaaaaaugccaccgggccccaaucuucaugcgcgugcccuuucuggaguucaaggcgccugggauuccaagcggaauggaaacccuuaaagauacacccgcuccucgacuguugaagacucaucucccacuggcccugcucccgcaaaccuuacuggaccagaagguaaaaguggucuacguggcacguaacgccaaggauguugcuguguccuauuaccacuuuuaucauauggcaaaaguccaccccgagccuggcacaugggacucuuuccuugagaaguuuauggugggugaaguaucguacgggucaugguaccagcauguucaggaguggugggaauugagcagaacccacccagugcuguaucuauucuacgaggauaugaaagagaaucccaagagggaaauccaaaagauacucgaguuugucggacggagucugccugaagagacuguggacuucgugguccagcacacauccuuuaaagaaaugaagaaaaacccaaugaccaauuauacgacuguuccccaggaguucauggaucauucuaucagcccguuuaugcgcaagggcauggccggcgacuggaaaaccacauucacuguggcucagaacgagagauucgaugccgacuacgcggaaaagauggcaggguguucccuuucauuuaggagugagcuguga

SEQ ID NO: 3504 - RNA, 888 nt, Artificial Sequence
  derived and/or modified sequence opt4 from ST1A1__Homo_sapiens__CCDS32420.1
auggagcugauccaggacaccagcagacccccccuggaguacgugaagggcgugccccugaucaaguacuucgccgaggcccugggcccccugcagagcuuccaggccagacccgacgaccugcugaucagcaccuaccccaagagcggcaccaccugggugagccagauccuggacaugaucuaccagggcggcgaccuggagaagugccacagagcccccaucuucaugagagugcccuuccuggaguucaaggcccccggcauccccagcggcauggagacccugaaggacacccccgcccccagacugcugaagacccaccugccccuggcccugcugccccagacccugcuggaccagaaggugaaggugguguacguggccagaaacgccaaggacguggccgugagcuacuaccacuucuaccacauggccaaggugcaccccgagcccggcaccugggacagcuuccuggagaaguucauggugggcgaggugagcuacggcagcugguaccagcacgugcaggaguggugggagcugagcagaacccaccccgugcuguaccuguucuacgaggacaugaaggagaaccccaagagagagauccagaagauccuggaguucgugggcagaagccugcccgaggagaccguggacuucguggugcagcacaccagcuucaaggagaugaagaagaaccccaugaccaacuacaccaccgugccccaggaguucauggaccacagcaucagccccuucaugagaaagggcauggccggcgacuggaagaccaccuucaccguggcccagaacgagagauucgacgccgacuacgccgagaagauggccggcugcagccugagcuucagaagcgagcuguga

SEQ ID NO: 3505 - RNA, 888 nt, Artificial Sequence
  derived and/or modified sequence opt5 from ST1A1__Homo_sapiens__CCDS32420.1
auggagcugauccaggacaccagcagacccccucucgaauacgugaagggcgucccgcugauuaaauauuucgccgaggcucuugggccccugcaauccuuucaggcccggccugaugaccuccugaucucuacauaccccaagagcggaacgaccuggguuucccagauucuugauaugaucuaucagggcggggaccuggaaaaaugccaccgcgcgccuauuuucaugagagugcccuuucucgaguucaaggcuccuggaaucccgucuggcauggaaacacugaaagauacccccgccccucggcugcucaagacacaucugccccuugcccugcucccucaaacccugcuugaccagaaggugaaagucguguacguugcucgcaacgccaaggauguggcugucagcuauuaccacuuuuaucauauggccaaagugcaccccgagccggggacaugggacuccuuccuggagaaguuuaugguuggagaagugucuuacggcagcugguaccagcauguccaggaguggugggaacucuccagaacccacccugugcuguaucuguucuacgaggauaugaaagagaaucccaagcgggaaauccaaaagauucucgaguuugugggccgcagccugccugaagagacggucgacuucguugugcagcacaccucuuuuaaagaaaugaagaaaaaccccaugacaaauuauaccacagugccccaggaguucauggaucauuccaucagcccuuuuaugagaaaggggauggcgggagacuggaaaaccacguucacagucgcccagaacgagcgguucgaugcugacuacgccgaaaagauggcuggcuguucucuuuccuuucgcagcgagcuguga

SEQ ID NO: 3506 - protein, 1268 aa, Artificial Sequence
  STAG2__Homo_sapiens__Q8N3U4-2
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNTQVTWMLAQRQQEEARQQQERAAMSYVKLRTNLQHAIRRGTSLMEDDEEPIVEDVMMSSEGRIEDLNEGMDFDTMDIDLPPSKNRRERTELKPDFFDPASIMDESVLGVSMF

SEQ ID NO: 3507 - RNA, 3807 nt, Artificial Sequence
  STAG2__Homo_sapiens__CCDS43990.1
augauagcagcuccagaaauaccaacugauuuuaaucuacuacaggagucagaaacacauuuuucuucugacacagauuuugaagauaucgaaggaaaaaaccaaaagcaaggcaaaggcaaaacuuguaaaaaaggcaaaaagggcccagcagaaaagggcaaagguggaaauggaggaggaaaaccuccuucugguccaaaccgaaugaauggucaucaccaacagaauggaguggaaaacaugauguuguuugaaguuguuaaaaugggcaagagugcuaugcagucggugguagaugauuggauagaaucauacaagcaugaccgagauauagcacuucuugaccuuaucaacuuuuuuauucaguguucaggcuguaaaggaguugucacagcagaaauguuuagacauaugcagaacucugagauaauucgaaaaaugacugaagaauucgaugaggauaguggagauuauccacuuaccauggcugguccucaguggaagaaguucaaauccaguuuuugugaauucauuggcguguuaguacggcaaugucaauauaguaucauauaugaugaguauaugauggauacagucauuucacuucuuacaggauugucugacucacaagucagagcauuucgacauacaagcacccuggcagcuaugaaguugaugacagcuuuggugaauguggcacuaaaucuuagcauuaauauggauaauacacaaagacaauaugaagcagaacggaauaaaaugauuggaaaacgagccaaugagaggcuagaacuccugcuacaaaagcggaaagagcuucaggaaaaucaagaugaaauagaaaauaugaugaaugcaauauuuaaaggaguguuuguacauagauaccgugaugcgauagcugaaauucgagcuauuugcauugaagagauuggcauuuggaugaagauguauagugaugccuuucuuaaugacaguuauuuaaaauauguugguuggacuaugcaugauaagcaaggugaaguaagacucaaaugucuuacugcucuacaagggcuuuauuauaacaaagagcuuaauuccaaacuggaacuuuuuaccagucgguucaaggauagaauugugucuaugacccuugacaaagaauaugauguugcaguacaagcaauaaaauuacucacucuuguuuuacagaguagugaagaaguucucacugcagaagauugugaaaaugucuaucaucugguuuauucagcucaccggccaguagcaguagcagcuggagaauuucucuacaaaaagcucuucagucguagagauccagaggaggauggaaugaugaaaagaagaggaagacaagguccaaaugccaaccuuguuaagacauugguuuuuuucuuucuagaaagugaguuacaugagcaugcagcauaccuuguggauagcaugugggacugugcuacugagcugcugaaagacugggaauguaugaauagcuuguuacuggaagagccacuuaguggagaggaagcacuaacagauaggcaagagagugcucugauugaaauaaugcuuuguaccauuagacaagcggcugaaugucauccucccgugggaagagggacaggaaaaagggugcuuacagcaaaggagaagaagacacaguuggaugauaggacaaaaaucacugagcuuuuugccguggcccuuccucaguuauuagcaaaauacucuguagaugcagaaaaggugacuaacuuguugcaguugccucaguacuuugauuuggaaauauauaccacuggacgauuagaaaagcauuuggaugccuuauugcgacagauccggaauauuguagagaagcacacagauacagauguuuuggaagcauguucuaaaacuuaccaugcacucuguaaugaagaguucacaaucuucaacagaguagauauuucaagaagucaacugauagaugaauuggcagauaaauuuaaccggcuucuugaagauuuucugcaagagggugaagaaccugaugaagaugaugcauaucagguauugucaacauugaagaggaucacugcuuuucauaaugcccaugaccuuucaaagugggauuuauuugcuuguaauuacaaacucuugaaaacuggaaucgaaaauggagacaugccugagcagauuguuauucacgcacugcaguguacucacuauguaauccuuuggcaacuugcuaagauaacugaaagcagcucuacaaaggaggacuugcugcguuuaaagaaacaaaugagaguauuuugucagauaugucaacauuaccugaccaacgugaauacuacuguuaaggaacaggccuucacuauucugugugauauuuugaugaucuucagccaucagauuaugucaggagggcgugacauguuagagccauuaguguauaccccugauucuucauugcagucugaguugcucagcuuuauuuuggaucaugucuucauugaacaggaugaugauaauaauagugcagauggucagcaagaggaugaagccaguaaaauugaagcucugcacaagagaagaaauuuacuugcagcauuuuguaagcuaauuguauauacugugguggagaugaauacagcugcagauaucuucaaacaguauaugaaguauuauaaugacuauggagauaucaucaaagaaacaaugaguaaaacaaggcagauagacaaaauucagugugcuaagacccuuauucucagucugcaacagcuuuuuaaugaaaugauacaagaaaauggcuauaauuuugauagaucauccucuacauuuaguggcauaaaagaacuugcucgacguuuugcuuuaacuuuuggacuugaucaguugaaaacaagagaagccauugccaugcuacacaaagauggcauagaauuugcuuuuaaagagccuaauccgcaaggggagagccauccaccuuuaaauuuggcauuucuugauauucugagugaauuuucuucuaaacuacuucgacaagacaaaagaacaguguauguuuacuuggaaaaguucaugaccuuucagaugucacuccgaagagaggauguguggcuuccacugaugucuuaccgaaauucuuugcuagcugguggugaugaugacaccaugucagucauuaguggaaucagcagccgggggucaacaguacggaguaaaaaaucaaaaccaucuacaggaaaacggaaagugguugagggcaugcagcuuucacucacugaagaaaguaguaguagugacaguaugugguuaagcagagaacaaacacugcacaccccuguuaugaugcagacaccacaacucaccuccacuauuaugagagagcccaaaagauuacggccugaggauagcuucaugaguguuuauccaaugcagacugaacaucaucaaacaccucuugauuauaacacgcagguaacauggauguuagcucaaagacaacaagaggaagcaaggcaacagcaggagagagcagcaaugagcuauguuaaacugcgaacuaaucuucagcaugccauucggcguggcacaagccuaauggaagaugaugaagagccaauuguggaagauguuaugauguccucagaagggaggauugaggaucuuaaugagggaauggauuuugacaccauggauauagauuugccaccaucaaagaacagacgagagagaacagaacugaagccugauuucuuugauccagcuucaauuauggaugaaucaguucuuggagugucaauguuuuaa

SEQ ID NO: 3508 - RNA, 3807 nt, Artificial Sequence
  derived and/or modified sequence opt1 from STAG2__Homo_sapiens__CCDS43990.1
augaucgccgcccccgagaucccgaccgacuucaaccugcuccaggagagcgagacccacuucuccagcgacacggacuucgaggacaucgagggcaagaaccagaagcaggggaagggcaagaccugcaagaaggggaagaagggccccgcggagaaggggaagggcggcaacgggggcgggaagccgcccuccggccccaaccgcaugaacgggcaccaccagcagaacggcguggagaacaugaugcuguucgaggucgugaagaugggcaagagcgccaugcaguccguggucgacgacuggaucgagagcuacaagcacgaccgggacaucgcccugcucgaccugaucaacuucuucauccagugcuccgggugcaagggcguggugaccgccgagauguuccgccacaugcagaacagcgagaucauccggaagaugaccgaggaguucgacgaggacuccggggacuacccccugacgauggccggcccccaguggaagaaguucaagagcuccuucugcgaguucaucggcguccucgugcgccagugccaguacagcaucaucuacgacgaguacaugauggacaccgugaucucccugcugaccgggcucagcgacucccagguccgggcguuccgccacaccagcacgcuggccgccaugaagcugaugaccgcccucgugaacguggcgcugaaccuguccaucaacauggacaacacccagcggcaguacgaggccgagcgcaacaagaugaucggcaagcgggccaacgagcgccucgagcugcugcuccagaagcggaaggagcugcaggagaaccaggacgagaucgagaacaugaugaacgccaucuucaagggggucuucgugcaccgcuaccgggacgccaucgcggagauccgcgccaucugcaucgaggagaucggcaucuggaugaagauguacagcgacgccuuccugaacgacuccuaccucaaguacgugggguggaccaugcacgacaagcagggcgagguccggcugaagugccugacggcccuccagggccuguacuacaacaaggagcugaacagcaagcucgagcuguucaccagccgcuucaaggaccggaucguguccaugacccuggacaaggaguacgacguggccguccaggcgaucaagcuccugacccuggugcuccagagcuccgaggaggugcugacggccgaggacugcgagaacgucuaccaccugguguacagcgcccaccgccccguggccgucgccgcgggggaguuccucuacaagaagcuguucucccggcgcgacccggaggaggacggcaugaugaagcggcgcgggcgccagggccccaacgccaaccuggugaagacccucgucuucuucuuccuggagagcgagcugcacgagcacgccgccuaccucguggacuccaugugggacugcgccaccgagcugcugaaggacugggagugcaugaacagccuccugcuggaggagccccucuccggggaggaggcgcugaccgaccggcaggagagcgcccugaucgagaucaugcugugcacgauccgccaggccgccgagugccacccgcccgugggccggggcaccgggaagcgcguccucaccgcgaaggagaagaagacccagcuggacgaccggacgaagaucaccgagcuguucgccguggcccucccccagcugcuggccaaguacuccguggacgccgagaaggucaccaaccuccugcagcugccccaguacuucgaccucgagaucuacaccacgggccgccuggagaagcaccuggacgcgcuccugcggcagauccgcaacaucguggagaagcacaccgacaccgacgugcuggaggccugcagcaagaccuaccacgcccucugcaacgaggaguucacgaucuucaaccgggucgacaucucccgcagccagcugaucgacgagcuggccgacaaguucaaccggcuccuggaggacuuccugcaggagggggaggagcccgacgaggacgacgccuaccaggugcucuccacccugaagcgcaucaccgcguuccacaacgcccacgaccugagcaagugggaccucuucgccugcaacuacaagcugcugaagaccggcaucgagaacggggacaugccggagcagaucgugauccacgcccuccagugcacgcacuacgucauccuguggcagcuggccaagaucaccgaguccagcuccaccaaggaggaccuccugcggcugaagaagcagaugcgcguguucugccagaucugccagcacuaccucaccaacgugaacaccacggucaaggagcaggcguucaccauccugugcgacauccugaugaucuucagccaccagaucaugagcggcggccgggacaugcucgagccccugguguacacccccgacuccagccugcaguccgagcuccugagcuucauccuggaccacguguucaucgagcaggacgacgacaacaacuccgccgacgggcagcaggaggacgaggccagcaagaucgaggcccuccacaagcgccggaaccugcuggcggccuucugcaagcucaucgucuacaccgugguggagaugaacacggccgccgacaucuucaagcaguacaugaaguacuacaacgacuacggcgacaucaucaaggagaccauguccaagacccgccagaucgacaagauccagugcgccaagacccugauccugagccuccagcagcuguucaacgagaugauccaggagaacggguacaacuucgaccgguccagcuccacguucagcggcaucaaggagcuggcgcgccgcuucgcccucaccuucggccuggaccagcugaagacccgggaggccaucgccaugcuccacaaggacgggaucgaguucgccuucaaggagcccaacccgcagggcgagucccacccgccccugaaccuggcguuccucgacauccugagcgaguucuccagcaagcugcuccgccaggacaagcggaccgucuacguguaccuggagaaguucaugacguuccagaugucccugcgccgggaggacguguggcucccccugaugagcuaccgcaacagccugcucgccgggggcgacgacgacaccauguccgucaucagcgggaucuccagccggggcuccaccgugcgcagcaagaaguccaagcccagcaccggcaagcggaagguggucgaggggaugcagcugucccugacggaggagagcuccagcuccgacagcauguggcucucccgcgagcagacccugcacacccccgugaugaugcagacgccccagcugaccagcaccaucaugcgggagcccaagcgccuccggccggaggacuccuucaugagcguguaccccaugcagaccgagcaccaccagacgccccuggacuacaacacccaggucaccuggaugcuggcccagcgccagcaggaggaggcccggcagcagcaggagcgcgccgcgauguccuacgugaagcuccggaccaaccugcagcacgccauccgccggggcaccagccugauggaggacgacgaggagccgaucguggaggacgucaugaugagcuccgaggggcgcaucgaggaccucaacgagggcauggacuucgacacgauggacaucgaccugccgcccagcaagaaccggcgcgagcgcaccgagcugaagcccgacuucuucgaccccgccuccaucauggacgagagcgugcucgggguguccauguucuga

SEQ ID NO: 3509 - RNA, 3807 nt, Artificial Sequence
  derived and/or modified sequence opt2 from STAG2__Homo_sapiens__CCDS43990.1
augaucgccgcccccgagauccccaccgacuucaaccuccuccaggaguccgagacccacuucuccuccgacaccgacuucgaggacaucgagggcaagaaccagaagcagggcaagggcaagaccugcaagaagggcaagaagggccccgccgagaagggcaagggcggcaacggcggcggcaagccccccuccggccccaaccgcaugaacggccaccaccagcagaacggcgucgagaacaugaugcucuucgaggucgucaagaugggcaaguccgccaugcaguccgucgucgacgacuggaucgaguccuacaagcacgaccgcgacaucgcccuccucgaccucaucaacuucuucauccagugcuccggcugcaagggcgucgucaccgccgagauguuccgccacaugcagaacuccgagaucauccgcaagaugaccgaggaguucgacgaggacuccggcgacuacccccucaccauggccggcccccaguggaagaaguucaaguccuccuucugcgaguucaucggcguccucguccgccagugccaguacuccaucaucuacgacgaguacaugauggacaccgucaucucccuccucaccggccucuccgacucccagguccgcgccuuccgccacaccuccacccucgccgccaugaagcucaugaccgcccucgucaacgucgcccucaaccucuccaucaacauggacaacacccagcgccaguacgaggccgagcgcaacaagaugaucggcaagcgcgccaacgagcgccucgagcuccuccuccagaagcgcaaggagcuccaggagaaccaggacgagaucgagaacaugaugaacgccaucuucaagggcgucuucguccaccgcuaccgcgacgccaucgccgagauccgcgccaucugcaucgaggagaucggcaucuggaugaagauguacuccgacgccuuccucaacgacuccuaccucaaguacgucggcuggaccaugcacgacaagcagggcgagguccgccucaagugccucaccgcccuccagggccucuacuacaacaaggagcucaacuccaagcucgagcucuucaccucccgcuucaaggaccgcaucgucuccaugacccucgacaaggaguacgacgucgccguccaggccaucaagcuccucacccucguccuccaguccuccgaggagguccucaccgccgaggacugcgagaacgucuaccaccucgucuacuccgcccaccgccccgucgccgucgccgccggcgaguuccucuacaagaagcucuucucccgccgcgaccccgaggaggacggcaugaugaagcgccgcggccgccagggccccaacgccaaccucgucaagacccucgucuucuucuuccucgaguccgagcuccacgagcacgccgccuaccucgucgacuccaugugggacugcgccaccgagcuccucaaggacugggagugcaugaacucccuccuccucgaggagccccucuccggcgaggaggcccucaccgaccgccaggaguccgcccucaucgagaucaugcucugcaccauccgccaggccgccgagugccacccccccgucggccgcggcaccggcaagcgcguccucaccgccaaggagaagaagacccagcucgacgaccgcaccaagaucaccgagcucuucgccgucgcccucccccagcuccucgccaaguacuccgucgacgccgagaaggucaccaaccuccuccagcucccccaguacuucgaccucgagaucuacaccaccggccgccucgagaagcaccucgacgcccuccuccgccagauccgcaacaucgucgagaagcacaccgacaccgacguccucgaggccugcuccaagaccuaccacgcccucugcaacgaggaguucaccaucuucaaccgcgucgacaucucccgcucccagcucaucgacgagcucgccgacaaguucaaccgccuccucgaggacuuccuccaggagggcgaggagcccgacgaggacgacgccuaccagguccucuccacccucaagcgcaucaccgccuuccacaacgcccacgaccucuccaagugggaccucuucgccugcaacuacaagcuccucaagaccggcaucgagaacggcgacaugcccgagcagaucgucauccacgcccuccagugcacccacuacgucauccucuggcagcucgccaagaucaccgaguccuccuccaccaaggaggaccuccuccgccucaagaagcagaugcgcgucuucugccagaucugccagcacuaccucaccaacgucaacaccaccgucaaggagcaggccuucaccauccucugcgacauccucaugaucuucucccaccagaucauguccggcggccgcgacaugcucgagccccucgucuacacccccgacuccucccuccaguccgagcuccucuccuucauccucgaccacgucuucaucgagcaggacgacgacaacaacuccgccgacggccagcaggaggacgaggccuccaagaucgaggcccuccacaagcgccgcaaccuccucgccgccuucugcaagcucaucgucuacaccgucgucgagaugaacaccgccgccgacaucuucaagcaguacaugaaguacuacaacgacuacggcgacaucaucaaggagaccauguccaagacccgccagaucgacaagauccagugcgccaagacccucauccucucccuccagcagcucuucaacgagaugauccaggagaacggcuacaacuucgaccgcuccuccuccaccuucuccggcaucaaggagcucgcccgccgcuucgcccucaccuucggccucgaccagcucaagacccgcgaggccaucgccaugcuccacaaggacggcaucgaguucgccuucaaggagcccaacccccagggcgagucccaccccccccucaaccucgccuuccucgacauccucuccgaguucuccuccaagcuccuccgccaggacaagcgcaccgucuacgucuaccucgagaaguucaugaccuuccagaugucccuccgccgcgaggacgucuggcucccccucauguccuaccgcaacucccuccucgccggcggcgacgacgacaccauguccgucaucuccggcaucuccucccgcggcuccaccguccgcuccaagaaguccaagcccuccaccggcaagcgcaaggucgucgagggcaugcagcucucccucaccgaggaguccuccuccuccgacuccauguggcucucccgcgagcagacccuccacacccccgucaugaugcagaccccccagcucaccuccaccaucaugcgcgagcccaagcgccuccgccccgaggacuccuucauguccgucuaccccaugcagaccgagcaccaccagaccccccucgacuacaacacccaggucaccuggaugcucgcccagcgccagcaggaggaggcccgccagcagcaggagcgcgccgccauguccuacgucaagcuccgcaccaaccuccagcacgccauccgccgcggcaccucccucauggaggacgacgaggagcccaucgucgaggacgucaugauguccuccgagggccgcaucgaggaccucaacgagggcauggacuucgacaccauggacaucgaccucccccccuccaagaaccgccgcgagcgcaccgagcucaagcccgacuucuucgaccccgccuccaucauggacgaguccguccucggcgucuccauguucuga

SEQ ID NO: 3510 - RNA, 3807 nt, Artificial Sequence
  derived and/or modified sequence opt3 from STAG2__Homo_sapiens__CCDS43990.1
augaucgccgcucccgagauuccuaccgacuucaaccugcuccaggaaagcgagacacacuuuuccucugauacugacuucgaagauauagagggcaagaaucaaaaacaggggaagggaaaaacgugcaagaaagguaagaagggcccagcagaaaaagggaagggaggcaacggugggggaaaaccgcccucaggcccuaauagaaugaacggccaucaccagcagaaugggguggagaacaugaugcuuuuugaggucguuaagaugggaaaaagugccaugcaaagcgugguagacgauuggaucgaauccuacaagcaugacagggauauugcgcuguuggacuuaaucaauuucuuuauucaguguucugguugcaagggcguggucaccgcugagauguuccggcacaugcagaacucggaaaucauacgcaaaaugacagaggaguuugaugaagacucaggggauuauccacugacuauggccggaccccaguggaagaaauucaagagcaguuuuugugaguucaucggcgugcuaguucgacaaugccaguacuccauuaucuaugacgaauacaugauggauaccgugauuucucuccugacaggucuuagcgacucccagguccgugcauuuagacauaccucaacucuggccgcuaugaaauugaugacagcacucgugaauguagcccugaaccugaguaucaauauggacaacacccagaggcaauaugaggcugaacggaauaagaugauagggaaacgcgccaacgagagacucgaguuacugcuucagaagaggaaggaauugcaggagaaucaagaugaaauugagaacaugaugaacgcgaucuucaaaggaguuuuugugcaccgguaccgcgacgcaauugccgaaauccgagcuaucuguauugaggagauaggcaucuggaugaagauguauagcgaugccuuccugaaugacucuuaccuaaaauacgucggcuggacgaugcacgauaagcagggggaagugagacucaaaugccugacugcacuucagggacuguauuacaacaaggagcucaauuccaaguuggaacuguucaccucaagguuuaaagaccggauugugagcaugacauuagauaaggaguaugacgucgcuguucaggccaucaaacugcucacucuugugcugcaaaguucugaagagguauugaccgcggaggauugugaaaacguguaccaucuagucuauuccgcccaccguccuguggcaguugcugccggugaguuccuguacaagaaacucuuuagccgcagagacccagaagaggauggcaugaugaagaggcgggggcgacagggacccaaugcuaaccuggugaagacacuugucuucuuuuuccuggagucggaauugcaugagcacgccgcauaucucguggacucuaugugggacugcgccaccgaacuguuaaaagauugggaguguaugaacucccugcuacucgaagaaccucugucaggcgaggaagcucuuacggaccgccaggagagugcguugauagaaauuaugcugugcacuaucagacaggcagccgagugucacccaccgguagguagggggacaggcaagcggguucucaccgcuaaagaaaagaaaacucaacuggaugaccgcacaaagaucaccgagcuuuuugccguggcacugccccaguugcucgccaaguacagcgucgaugcugagaaagugacgaaucuguuacagcugccucaguacuucgaccuagaaauuuauaccacaggaagacucgagaagcaucuggaugcccuuuugaggcaaauccguaauauugucgaaaaacacacugacaccgaugugcuggaggcaugcuccaagacauaccaugcgcucugcaacgaagaguuuacuauauucaaucggguugacaucucucgaagccagcugauugaugaguuagcugacaaauuuaacagacugcuugaagauuucuugcaggagggcgaggagccagacgaggacgaugccuaucaggugcucucaacccugaagaggaucacagcauuucacaaugcccaugaccuaaguaaaugggaucuguucgcuuguaacuacaagcuccugaagaccgggaucgaaaauggagacaugcccgagcaaauuguaauacacgcccuucagugcacucacuaugucaucuuguggcagcuggcaaaaauuacggaauccagcucuacaaaggaggauuuacuccgccugaaaaagcaaaugcggguguucugucagaucugccagcauuaccuuaccaacguuaacacuaccgugaaagaacaggcuuuuacaauucugugugacaucuugaugauauucucacaccaaaucaugagugguggcagagauaugcucgagccucuggucuauaccccagacagcucccuacagucugagcugcucucguuuauucuggaucauguguucaucgaacaggacgaugacaauaacagcgccgaugggcagcaagaggacgaagcguccaagauugaggcccuucacaagaggcgcaauuugcuggcugcauuuugcaaauuaaucguauacacugugguugaaaugaacacagccgcugacauauucaagcaguacaugaaauauuacaaugauuauggagacauuaucaaggagacgaugucaaaaacccgacagauugauaagauccagugugccaagacucucauacugagucuucaacagcuguuuaacgagaugauccaggaaaauggcuacaacuucgaccggucuagcuccacauuuucagguauuaaagagcuagcacguagauucgcgcucaccuuugggcuggaucaauugaagacaagggaagccaucgcuaugcugcacaaagacggcauugaguucgccuuuaaggaacccaauccgcagggagagagccauccucccuuaaaccucgcauuccuggauauccuuucugaguucuccaguaaacuguugcgccaggacaagcggacugucuauguguaccucgaaaaguuuaugaccuuccagaugagccugagaagggaggauguguggcuaccacugaugucuuaucgaaauucccuucucgcuggcggggacgaugacacgaugucagucauaaguggaauuagcucgcgcgguuccaccguucggucuaaaaagagcaaaccuucaacaggcaagagaaaagugguggaagggaugcaacugaguuugacugaggaguccucuagcuccgacucaauguggcugagcagggaacagaccuuacacacacccguaaugaugcagacuccacagcucaccaguacgaucaugcgugagcccaagcgccugcggccugaagauucuuuuauguccgucuacccaaugcaaacagagcaucaccagaccccgcuugacuacaacacucaggugacauggaugcuggcccagagacaacaggaagaggcaaggcagcagcaagagcgagccgcuaugagcuauguuaaauugcggaccaaucuccagcaugcgauccgcagaggaacuucgcugauggaagaugacgaggaacccauuguggaggaugucaugaugucaucugaaggcaggaucgaggaccuaaacgaggguauggauuucgacaccauggauauugaccugccuccaaguaagaaucggcgagaaagaacagagcuuaagcccgacuuuuucgauccugccuccauaauggaugaaagcgugcucgggguuucuauguuuuga

SEQ ID NO: 3511 - RNA, 3807 nt, Artificial Sequence
  derived and/or modified sequence opt4 from STAG2__Homo_sapiens__CCDS43990.1
augaucgccgcccccgagauccccaccgacuucaaccugcugcaggagagcgagacccacuucagcagcgacaccgacuucgaggacaucgagggcaagaaccagaagcagggcaagggcaagaccugcaagaagggcaagaagggccccgccgagaagggcaagggcggcaacggcggcggcaagccccccagcggccccaacagaaugaacggccaccaccagcagaacggcguggagaacaugaugcuguucgagguggugaagaugggcaagagcgccaugcagagcgugguggacgacuggaucgagagcuacaagcacgacagagacaucgcccugcuggaccugaucaacuucuucauccagugcagcggcugcaagggcguggugaccgccgagauguucagacacaugcagaacagcgagaucaucagaaagaugaccgaggaguucgacgaggacagcggcgacuacccccugaccauggccggcccccaguggaagaaguucaagagcagcuucugcgaguucaucggcgugcuggugagacagugccaguacagcaucaucuacgacgaguacaugauggacaccgugaucagccugcugaccggccugagcgacagccaggugagagccuucagacacaccagcacccuggccgccaugaagcugaugaccgcccuggugaacguggcccugaaccugagcaucaacauggacaacacccagagacaguacgaggccgagagaaacaagaugaucggcaagagagccaacgagagacuggagcugcugcugcagaagagaaaggagcugcaggagaaccaggacgagaucgagaacaugaugaacgccaucuucaagggcguguucgugcacagauacagagacgccaucgccgagaucagagccaucugcaucgaggagaucggcaucuggaugaagauguacagcgacgccuuccugaacgacagcuaccugaaguacgugggcuggaccaugcacgacaagcagggcgaggugagacugaagugccugaccgcccugcagggccuguacuacaacaaggagcugaacagcaagcuggagcuguucaccagcagauucaaggacagaaucgugagcaugacccuggacaaggaguacgacguggccgugcaggccaucaagcugcugacccuggugcugcagagcagcgaggaggugcugaccgccgaggacugcgagaacguguaccaccugguguacagcgcccacagacccguggccguggccgccggcgaguuccuguacaagaagcuguucagcagaagagaccccgaggaggacggcaugaugaagagaagaggcagacagggccccaacgccaaccuggugaagacccugguguucuucuuccuggagagcgagcugcacgagcacgccgccuaccugguggacagcaugugggacugcgccaccgagcugcugaaggacugggagugcaugaacagccugcugcuggaggagccccugagcggcgaggaggcccugaccgacagacaggagagcgcccugaucgagaucaugcugugcaccaucagacaggccgccgagugccacccccccgugggcagaggcaccggcaagagagugcugaccgccaaggagaagaagacccagcuggacgacagaaccaagaucaccgagcuguucgccguggcccugccccagcugcuggccaaguacagcguggacgccgagaaggugaccaaccugcugcagcugccccaguacuucgaccuggagaucuacaccaccggcagacuggagaagcaccuggacgcccugcugagacagaucagaaacaucguggagaagcacaccgacaccgacgugcuggaggccugcagcaagaccuaccacgcccugugcaacgaggaguucaccaucuucaacagaguggacaucagcagaagccagcugaucgacgagcuggccgacaaguucaacagacugcuggaggacuuccugcaggagggcgaggagcccgacgaggacgacgccuaccaggugcugagcacccugaagagaaucaccgccuuccacaacgcccacgaccugagcaagugggaccuguucgccugcaacuacaagcugcugaagaccggcaucgagaacggcgacaugcccgagcagaucgugauccacgcccugcagugcacccacuacgugauccuguggcagcuggccaagaucaccgagagcagcagcaccaaggaggaccugcugagacugaagaagcagaugagaguguucugccagaucugccagcacuaccugaccaacgugaacaccaccgugaaggagcaggccuucaccauccugugcgacauccugaugaucuucagccaccagaucaugagcggcggcagagacaugcuggagccccugguguacacccccgacagcagccugcagagcgagcugcugagcuucauccuggaccacguguucaucgagcaggacgacgacaacaacagcgccgacggccagcaggaggacgaggccagcaagaucgaggcccugcacaagagaagaaaccugcuggccgccuucugcaagcugaucguguacaccgugguggagaugaacaccgccgccgacaucuucaagcaguacaugaaguacuacaacgacuacggcgacaucaucaaggagaccaugagcaagaccagacagaucgacaagauccagugcgccaagacccugauccugagccugcagcagcuguucaacgagaugauccaggagaacggcuacaacuucgacagaagcagcagcaccuucagcggcaucaaggagcuggccagaagauucgcccugaccuucggccuggaccagcugaagaccagagaggccaucgccaugcugcacaaggacggcaucgaguucgccuucaaggagcccaacccccagggcgagagccaccccccccugaaccuggccuuccuggacauccugagcgaguucagcagcaagcugcugagacaggacaagagaaccguguacguguaccuggagaaguucaugaccuuccagaugagccugagaagagaggacguguggcugccccugaugagcuacagaaacagccugcuggccggcggcgacgacgacaccaugagcgugaucagcggcaucagcagcagaggcagcaccgugagaagcaagaagagcaagcccagcaccggcaagagaaaggugguggagggcaugcagcugagccugaccgaggagagcagcagcagcgacagcauguggcugagcagagagcagacccugcacacccccgugaugaugcagaccccccagcugaccagcaccaucaugagagagcccaagagacugagacccgaggacagcuucaugagcguguaccccaugcagaccgagcaccaccagaccccccuggacuacaacacccaggugaccuggaugcuggcccagagacagcaggaggaggccagacagcagcaggagagagccgccaugagcuacgugaagcugagaaccaaccugcagcacgccaucagaagaggcaccagccugauggaggacgacgaggagcccaucguggaggacgugaugaugagcagcgagggcagaaucgaggaccugaacgagggcauggacuucgacaccauggacaucgaccugccccccagcaagaacagaagagagagaaccgagcugaagcccgacuucuucgaccccgccagcaucauggacgagagcgugcugggcgugagcauguucuga

SEQ ID NO: 3512 - RNA, 3807 nt, Artificial Sequence
  derived and/or modified sequence opt5 from STAG2__Homo_sapiens__CCDS43990.1
augaucgccgcucccgagauuccuaccgacuucaaccugcuccaggaaagcgagacacacuuuuccucugauacggacuucgaagauaucgagggcaagaaucaaaaacaggggaagggaaaaaccugcaagaaaggcaagaaggggccggccgaaaaaggaaagggcgggaacggaggcggcaaacccccuagcgggcccaauagaaugaacggacaucaccagcagaauggcguggagaacaugaugcuguuugaggucguuaagauggggaaauccgcgaugcaaucugugguggacgauuggauugaaagcuacaagcaugaccgggauaucgcccuucuggaccucauuaauuucuuuauccaguguuccggaugcaagggcgucgugacagcugagauguuccgccacaugcagaacucugaaaucauuagaaaaaugaccgaggaguuugaugaagacagcggggauuauccucugacaauggccggaccccaguggaagaaauucaaguccagcuuuugugaguucaucggcguucuugugcggcaaugccaguacucuauuaucuaugacgaauacaugauggauaccgucauuucccugcucacaggccugagcgacucucaggugcgcgcuuuuagacauaccuccacgcuggccgcuaugaaacucaugaccgcccugguuaauguggcgcuuaaccugagcaucaauauggacaacacacagcggcaauaugaggccgaacgcaauaagaugauugggaaaagagcuaacgagcggcucgagcugcuucugcagaagcgcaaggaacuccaggagaaucaagaugaaaucgagaacaugaugaacgccaucuucaaaggagucuuugugcacagauaccgggacgcuauugccgaaauccgcgcgauuuguaucgaggagauuggcaucuggaugaagauguauucugaugccuuccugaaugacuccuaccugaaauacgugggguggaccaugcacgauaagcagggagaagucagacucaaaugccugacagcccuucagggccuguauuacaacaaggagcucaauagcaagcuggaacuuuucaccucccgguuuaaagaccgcaucguuucuaugacgcuggauaaggaguaugacguggcugugcaggcuauuaaacuccugacacugguccuccaaagcuccgaagaggugcugaccgccgaggauugugaaaacguuuaccaucuuguguauagcgcccacagaccugucgcuguggcggccggggaguuccuguacaagaaacucuuuucucggagagacccggaagaggauggaaugaugaagcgccggggcagacagggccccaaugcuaaccugguuaagacacuuguguucuuuuuccuggaguccgaacuccaugagcacgccgccuaucuggucgacagcaugugggacugcgcuaccgaacugcucaaagauugggaguguaugaauagccugcuucuggaagaaccucucagcggggaggaagcccugaccgaccgccaggaguccgcgcugaucgaaauuaugcuuugcacaauccggcaggcugccgagugucaucccccugugggaagaggcacggggaagcgcguccucaccgccaaagaaaagaaaacacaacuggaugaccggaccaagauuacagagcuguuugcuguggcccucccccagcugcuugcuaaguacucuguugaugccgagaaagugaccaaccugcuccagcugccgcaguacuucgaccuggaaaucuauacgacaggaagacuugagaagcaccucgaugcgcugcugcgccaaauccggaauauugucgaaaaacacaccgacaccgaugugcucgaggccugcagcaagacauaccaugcucugugcaacgaagaguuuaccaucuucaauagaguugacauuucccgcagccagcuuaucgaugagcuggccgacaaauuuaaccggcuccuggaagauuuccugcaggagggcgaggagccugacgaggacgaugcuuaucaggugcuuucuacacucaagagaauuacggccuuucacaaugcgcaugaccuguccaaaugggaucuguucgccuguaacuacaagcuccugaagaccgggaucgaaaauggcgacaugcccgagcaaauugucauccacgcccuucagugcacacacuaugugauccuguggcagcucgcuaaaauuaccgaaucuucuuccacaaaggaggaucugcugcggcuuaaaaagcaaaugcgcguguucugucagaucugccagcauuaccucaccaacguuaacacgaccgucaaagaacaggcuuuuacaauucugugugacauccugaugauuuucagccaccaaaucauguccggaggcagagauaugcucgagccucugguguauacccccgacucuagccuucaguccgagcugcucucuuuuauccuggaucauguguucauugaacaggacgaugacaauaacagcgccgaugggcagcaagaggacgaagccuccaagaucgaggcucugcacaagcggagaaaucuucuggcggccuuuugcaaacucauugucuacacagugguugaaaugaacaccgcugccgacaucuucaagcaguacaugaaauauuacaaugauuauggagacauuaucaaggagacgaugagcaaaacacgccagaucgauaagauucagugugccaagacccugauccucucucugcaacagcuuuuuaacgagaugauucaggaaaauggcuacaacuucgaccgguccagcucuacauuuuccgggaucaaagagcuggcuagacgcuucgcccucaccuuuggacuggaucaacugaagaccagagaagcgauugcuaugcuucacaaagacggcaucgaguucgccuuuaaggaacccaauccucagggggagagccauccgccccugaaccucgccuuccuggauauccucucugaguucagcuccaaacugcuucggcaggacaagcgcacaguguaugucuaccuggaaaaguuuaugacguuccagaugagccucagacgggaggauguguggcugccucugaugucuuaucgcaauucccuucuggcuggcggagacgaugacaccaugagcguuauuuccggcaucucuagcagaggguccacagugcggucuaaaaagagcaaacccuccaccggaaagcgcaaagucguggaaggcaugcaacucucucugacagaggagagcuccagcucugacuccauguggcucagcagagaacagacccugcacacgccuguuaugaugcagacaccccagcuuaccucuaccauuaugcgggagccgaagcgccugagaccugaagauuccuuuaugagcguguaccccaugcaaacagagcaucaccagaccccucuggacuacaacacacaggucacguggaugcucgcccagcggcaacaggaagaggcgagacagcagcaagagcgcgcugccaugucuuaugugaaacugcggaccaaucuucagcaugccaucagacgcgggacaucccugauggaagaugacgaggaacccauuguggaggaugucaugaugagcuccgaaggacggaucgaggaccucaacgagggcauggauuucgacaccauggauauugaccugccucccagcaagaauagacgcgaacggacagagcucaagccggacuuuuucgauccugcuucuaucauggaugaaagcguucuggggguguccauguuuuga

SEQ ID NO: 3513 - protein, 490 aa, Artificial Sequence
  STAMP-1__Homo_sapiens__Q8NFT2
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGMGGTIPHVSPERVTVM

SEQ ID NO: 3514 - RNA, 1473 nt, Artificial Sequence
  STAMP-1__Homo_sapiens__CCDS5615.1
auggaaucaaucucuaugaugggaagcccuaagagccuuagugaaacuuuuuuaccuaauggcauaaaugguaucaaagaugcaaggaaggucacuguaggugugauuggaaguggagauuuugccaaauccuugaccauucgacuuauuagaugcggcuaucauguggucauaggaaguagaaauccuaaguuugcuucugaauuuuuuccucaugugguagaugucacucaucaugaagaugcucucacaaaaacaaauauaauauuuguugcuauacacagagaacauuauaccucccugugggaccugagacaucugcuuguggguaaaauccugauugaugugagcaauaacaugaggauaaaccaguacccagaauccaaugcugaauauuuggcuucauuauucccagauucuuugauugucaaaggauuuaauguugucucagcuugggcacuucaguuaggaccuaaggaugccagccggcagguuuauauaugcagcaacaauauucaagcgcgacaacagguuauugaacuugcccgccaguugaauuucauucccauugacuugggauccuuaucaucagccagagagauugaaaauuuaccccuacgacucuuuacucucuggagagggccaguggugguagcuauaagcuuggccacauuuuuuuuccuuuauuccuuugucagagaugugauucauccauaugcuagaaaccaacagagugacuuuuacaaaauuccuauagagauugugaauaaaaccuuaccuauaguugccauuacuuugcucucccuaguauaccucgcaggucuucuggcagcugcuuaucaacuuuauuacggcaccaaguauaggagauuuccaccuugguuggaaaccugguuacaguguagaaaacagcuuggauuacuaaguuuuuucuucgcuaugguccauguugccuacagccucugcuuaccgaugagaaggucagagagauauuuguuucucaacauggcuuaucagcagguucaugcaaauauugaaaacucuuggaaugaggaagaaguuuggagaauugaaauguauaucuccuuuggcauaaugagccuuggcuuacuuucccuccuggcagucacuucuaucccuucagugagcaaugcuuuaaacuggagagaauucaguuuuauucagucuacacuuggauaugucgcucugcucauaaguacuuuccauguuuuaauuuauggauggaaacgagcuuuugaggaagaguacuacagauuuuauacaccaccaaacuuuguucuugcucuuguuuugcccucaauuguaauucuggguaagauuauuuuauuccuuccauguauaagccgaaagcuaaaacgaauuaaaaaaggcugggaaaagagccaauuucuggaagaagguaugggaggaacaauuccucaugucuccccggagagggucacaguaauguga

SEQ ID NO: 3515 - RNA, 1473 nt, Artificial Sequence
  derived and/or modified sequence opt1 from STAMP-1__Homo_sapiens__CCDS5615.1
auggagagcaucuccaugaugggcagccccaagucccugagcgagaccuuccucccgaacgggaucaacggcaucaaggacgcccgcaaggugaccgucggggugaucggcuccggggacuucgccaagagccugacgauccggcugauccgcugcggcuaccacguggucaucggcucccggaaccccaaguucgcgagcgaguucuucccccacgugguggacgucacccaccacgaggacgcccucaccaagaccaacaucaucuucguggccauccaccgcgagcacuacacgucccugugggaccugcggcaccuccugguggggaagauccugaucgacgucagcaacaacaugcgcaucaaccaguaccccgaguccaacgccgaguaccucgccagccuguucccggacucccugaucgugaagggcuucaacguggucagcgcgugggcccuccagcuggggcccaaggacgccucccgccagguguacaucugcagcaacaacauccaggcccggcagcaggucaucgagcuggcgcggcagcucaacuucauccccaucgaccugggcucccugagcuccgcccgcgagaucgagaaccucccccugcggcuguucacccucuggcgcgggccgguggugguggccaucagccuggccaccuucuucuuccuguacagcuucguccgggacgugauccaccccuacgcccgcaaccagcaguccgacuucuacaagauccccaucgagaucgugaacaagacccuccccaucgucgcgaucacgcugcugagccucguguaccuggccggccugcucgccgccgccuaccagcuguacuacggcaccaaguaccggcgcuucccgcccuggcuggagaccuggcuccagugccggaagcagcuggggcugcucuccuucuucuucgcgauggugcacgucgccuacagccugugccugcccaugcgccgguccgagcgcuaccucuuccugaacauggccuaccagcagguccacgccaacaucgagaacagcuggaacgaggaggagguguggcggaucgagauguacaucuccuucggcaucaugagccuggggcuccugucccugcucgccgugaccagcauccccuccgugagcaacgcgcugaacuggcgcgaguucuccuucauccagagcacgcugggcuacgucgcccuccugaucuccaccuuccacgugcugaucuacggcuggaagcgcgccuucgaggaggaguacuaccgguucuacaccccgcccaacuucgugcuggcccucguccugcccagcaucgugauccuggggaagaucauccucuuccugcccugcaucucccgcaagcugaagcggaucaagaagggcugggagaagucccaguuccucgaggaggggaugggcgggaccaucccgcacgugagccccgagcgcgucacggugauguga

SEQ ID NO: 3516 - RNA, 1473 nt, Artificial Sequence
  derived and/or modified sequence opt2 from STAMP-1__Homo_sapiens__CCDS5615.1
auggaguccaucuccaugaugggcucccccaagucccucuccgagaccuuccuccccaacggcaucaacggcaucaaggacgcccgcaaggucaccgucggcgucaucggcuccggcgacuucgccaagucccucaccauccgccucauccgcugcggcuaccacgucgucaucggcucccgcaaccccaaguucgccuccgaguucuucccccacgucgucgacgucacccaccacgaggacgcccucaccaagaccaacaucaucuucgucgccauccaccgcgagcacuacaccucccucugggaccuccgccaccuccucgucggcaagauccucaucgacgucuccaacaacaugcgcaucaaccaguaccccgaguccaacgccgaguaccucgccucccucuuccccgacucccucaucgucaagggcuucaacgucgucuccgccugggcccuccagcucggccccaaggacgccucccgccaggucuacaucugcuccaacaacauccaggcccgccagcaggucaucgagcucgcccgccagcucaacuucauccccaucgaccucggcucccucuccuccgcccgcgagaucgagaaccucccccuccgccucuucacccucuggcgcggccccgucgucgucgccaucucccucgccaccuucuucuuccucuacuccuucguccgcgacgucauccaccccuacgcccgcaaccagcaguccgacuucuacaagauccccaucgagaucgucaacaagacccuccccaucgucgccaucacccuccucucccucgucuaccucgccggccuccucgccgccgccuaccagcucuacuacggcaccaaguaccgccgcuucccccccuggcucgagaccuggcuccagugccgcaagcagcucggccuccucuccuucuucuucgccaugguccacgucgccuacucccucugccuccccaugcgccgcuccgagcgcuaccucuuccucaacauggccuaccagcagguccacgccaacaucgagaacuccuggaacgaggaggaggucuggcgcaucgagauguacaucuccuucggcaucaugucccucggccuccucucccuccucgccgucaccuccauccccuccgucuccaacgcccucaacuggcgcgaguucuccuucauccaguccacccucggcuacgucgcccuccucaucuccaccuuccacguccucaucuacggcuggaagcgcgccuucgaggaggaguacuaccgcuucuacaccccccccaacuucguccucgcccucguccuccccuccaucgucauccucggcaagaucauccucuuccuccccugcaucucccgcaagcucaagcgcaucaagaagggcugggagaagucccaguuccucgaggagggcaugggcggcaccaucccccacgucucccccgagcgcgucaccgucauguga

SEQ ID NO: 3517 - RNA, 1473 nt, Artificial Sequence
  derived and/or modified sequence opt3 from STAMP-1__Homo_sapiens__CCDS5615.1
auggagagcaucuccaugaugggcucucccaagucacugagugaaaccuuccucccuaacgggauuaauggaauaaaagacgccagaaaggugacagucgguguuaucggcagcggggauuuugcuaaaucccuuacuauuaggcugauccggugcggauaccacgugguaauuggcucucgcaacccaaaguucgcaucggaguuuuucccgcauguggucgacgugacgcaccaugaagaugccuugaccaaaacaaauaucauauuuguugcgauccaccgagagcauuauacuucauuaugggaccugcgucaccuacucguggguaagauucugaucgaugucagcaacaauaugagaauuaaccaguaccccgaaaguaaugcugaguaucuugccucccuguucccugacucuuugaucgugaagggguuuaacguaguuagcgcaugggcccuccaacugggaccaaaagaugcuuccaggcaaguguacauauguucaaauaacauucaggcacggcagcaggucaucgagcuggcccgccagcucaauuucauucccaucgacuuaggcagucugagcucugcuagagaaaucgagaaccuuccuuugaggcuguuuacccuauggcggggcccagugguggucgccauuucccucgcgacauucuuuuuccuguauucauuuguucgcgaugugauacaccccuacgcacgaaaucagcagagcgacuucuauaagaucccuauugaaaucguaaacaaaacccuuccaauaguggccauuacucuguugagucucgucuaccuggcuggguuacuggccgcagcuuaccaacucuauuacggaacaaaguauagaagguucccgcccuggcuugagaccuggcugcagugccggaaacaguugggucuacugagcuuuuucuuugccauggugcauguugcguacucccucugucugccuaugcgucgcagcgagagauaucuuuuccugaauauggccuaccagcaagugcacgcaaacaucgaaaacucguggaaugaggaagaggucuggaggaucgaaauguauauuucuuuuggcaucauguccuuggggcuccugucauuacuggcugugacgaguauuccaagcguauccaacgcccuaaauuggcgggaguucucuuuuauacagagcacucucggauacguugcucugcuuaucucaaccuuccauguguugauuuacggcuggaagcgagccuuugaggaagaguauuaccgcuucuauacacccccuaacuuuguccuggcacucgugcugccaaguaucgucauccuugguaagauuauacuguucuugcccugcaucuccagaaaacucaagaggauuaaaaaggggugggaaaaaucucaguuucuggaggaaggaaugggcggcacuaucccgcacgugucuccugagcggguuaccgugauguga

SEQ ID NO: 3518 - RNA, 1473 nt, Artificial Sequence
  derived and/or modified sequence opt4 from STAMP-1__Homo_sapiens__CCDS5615.1
auggagagcaucagcaugaugggcagccccaagagccugagcgagaccuuccugcccaacggcaucaacggcaucaaggacgccagaaaggugaccgugggcgugaucggcagcggcgacuucgccaagagccugaccaucagacugaucagaugcggcuaccacguggugaucggcagcagaaaccccaaguucgccagcgaguucuucccccacgugguggacgugacccaccacgaggacgcccugaccaagaccaacaucaucuucguggccauccacagagagcacuacaccagccugugggaccugagacaccugcuggugggcaagauccugaucgacgugagcaacaacaugagaaucaaccaguaccccgagagcaacgccgaguaccuggccagccuguuccccgacagccugaucgugaagggcuucaacguggugagcgccugggcccugcagcugggccccaaggacgccagcagacagguguacaucugcagcaacaacauccaggccagacagcaggugaucgagcuggccagacagcugaacuucauccccaucgaccugggcagccugagcagcgccagagagaucgagaaccugccccugagacuguucacccuguggagaggccccguggugguggccaucagccuggccaccuucuucuuccuguacagcuucgugagagacgugauccaccccuacgccagaaaccagcagagcgacuucuacaagauccccaucgagaucgugaacaagacccugcccaucguggccaucacccugcugagccugguguaccuggccggccugcuggccgccgccuaccagcuguacuacggcaccaaguacagaagauucccccccuggcuggagaccuggcugcagugcagaaagcagcugggccugcugagcuucuucuucgccauggugcacguggccuacagccugugccugcccaugagaagaagcgagagauaccuguuccugaacauggccuaccagcaggugcacgccaacaucgagaacagcuggaacgaggaggagguguggagaaucgagauguacaucagcuucggcaucaugagccugggccugcugagccugcuggccgugaccagcauccccagcgugagcaacgcccugaacuggagagaguucagcuucauccagagcacccugggcuacguggcccugcugaucagcaccuuccacgugcugaucuacggcuggaagagagccuucgaggaggaguacuacagauucuacaccccccccaacuucgugcuggcccuggugcugcccagcaucgugauccugggcaagaucauccuguuccugcccugcaucagcagaaagcugaagagaaucaagaagggcugggagaagagccaguuccuggaggagggcaugggcggcaccaucccccacgugagccccgagagagugaccgugauguga

SEQ ID NO: 3519 - RNA, 1473 nt, Artificial Sequence
  derived and/or modified sequence opt5 from STAMP-1__Homo_sapiens__CCDS5615.1
auggagagcaucuccaugaugggcucucccaagagccuguccgaaaccuuccucccuaacgggauuaauggaaucaaagacgccagaaaggugacagucggcguuauugggucuggagauuuugcuaaaagccugacgauccggcuuauucgcugcggcuaccacguggugaucggguccagaaacccgaaguucgccucugaguuuuucccccaugucguggacguuacccaccaugaagaugcgcugacaaaaaccaauaucauuuuuguggcuauccaccgggagcauuauacaagccucugggaccugcgccaccuucuggucggaaagauucucaucgauguguccaacaauaugagaauuaaccaguacccugaaagcaaugccgaguaucuggccucucuguuccccgacucccucaucguuaagggcuuuaacguggucagcgcuugggcccugcaacuuggcccuaaagaugcuucucgccagguguacauuuguuccaauaacauccaggcccggcagcaagugaucgagcuggcgagacagcucaauuucauucccaucgaccuggggagccuuucuuccgcccgggaaauugagaaccugccucuccgccuguuuacccuguggagaggaccggucguuguggcuaucagccucgccacauucuuuuuccuguauuccuuugugcgggaugucauucaccccuacgcucgcaaucagcagucugacuucuauaagaucccuaucgaaauugugaacaaaacccuucccaucguugccauuacgcugcucagccugguguaccuugcgggccugcucgccgcugccuaccaacuguauuacgggaccaaguauagacgguucccucccuggcuggagacauggcuccagugccgcaaacagcugggacuucuguccuuuuucuuugcuaugguccauguggccuacagccucugucugccgaugagacggucugagagauaucuuuuccugaauauggccuaccagcaaguucacgcuaacaucgaaaacuccuggaaugaggaagagguguggcgcauugaaauguauaucagcuuuggcaucaugucucucgggcugcugagccuccuggcggucaccuccauuccuucugugagcaacgcccuuaauuggcgggaguucuccuuuauccagagcacacugggauacgucgcucuccugauuucuaccuuccaugugcugaucuacggcuggaagagagccuuugaggaagaguauuaccgcuucuauacgcccccuaacuuuguucuugcccucgugcugcccuccauugucauccugggcaagauuauccucuuccugcccugcaucagccggaaacuuaagagaauuaaaaaggggugggaaaaaucucaguuucuggaggaaggaaugggcgggacaaucccucacguguccccggagcgcguuaccgugauguga

SEQ ID NO: 3520 - protein, 258 aa, Artificial Sequence [sequence omitted]

SEQ ID NO: 3521 - RNA, 777 nt, Artificial Sequence
  STEAP-1__Homo_sapiens__EAW93749
auggaaagcagaaaagacaucacaaaccaagaagaaauuuggaaaaugaagccuaggagaaauuuagaagacaacgauuauuugcauaaggacacgggagagaccagcaugcuaaaaagaccugugcuuuugcauuugcagcaaacagcccaugcugaugaauuugacugcccuucagaacuucagcacgcacaggaacucuuuccacaguggcacuugccaauuaaaauagcugcuguuauggcaucucugacuuuucuuuacacucuucugagggaaguaauucacccuuuagcaacuucccaucaacaauauuuuuauaaaauuccaauccuggucaucaacaaagucuugccaaugguuuccaucacucucuuggcauugguuuaccuaccaggugugauagcagcaauuguccaaguucauaauggaaccaaguauaagaaguuuccacauugguuggauaaguggauguuaacaagaaagcaguuugggcuucucaguuuguuuuuugcuguacugcaugcaauuuauacucugucuuacgcaaugaggcgauccuacagauacaaguugcuaaacugggcauaucaacagguccaacaaaauaaagaagaugccuggauugagcaugauguuuggagaauggagauuuaugugucucugggaauugugggacuggcaauacuggcucuguuggcugugacaucuauuccaucugugagugacucuuugacauggagagaauuucacuauauucagguaaauaauauauaa

SEQ ID NO: 3522 - RNA, 777 nt, Artificial Sequence
  derived and/or modified sequence opt1 from STEAP-1__Homo_sapiens__EAW93749
auggagagccgcaaggacaucaccaaccaggaggagaucuggaagaugaagccccggcgcaaccuggaggacaacgacuaccuccacaaggacaccggcgagacguccaugcugaagcggccggugcugcuccaccuccagcagaccgcccacgccgacgaguucgacugccccagcgagcugcagcacgcgcaggagcuguucccccaguggcaccuccccaucaagaucgccgccgucauggccucccugaccuuccuguacacccugcugcgcgaggugauccacccgcucgccacgagccaccagcaguacuucuacaagauccccauccuggugaucaacaagguccugcccaugguguccaucacccuccuggcgcugguguaccuccccggggucaucgccgccaucguccaggugcacaacggcaccaaguacaagaaguucccgcacuggcuggacaaguggaugcugacccggaagcaguucgggcuccugagccuguucuucgccgugcuccacgcgaucuacacgcuguccuacgccaugcgccggagcuaccgcuacaagcugcucaacugggccuaccagcagguccagcagaacaaggaggacgccuggaucgagcacgacguguggcggauggagaucuacgugucccugggcaucguggggcuggccauccucgcgcugcuggccgugaccagcauccccuccgucagcgacucccucaccuggcgcgaguuccacuacauccaggugaacaacaucuga

SEQ ID NO: 3523 - RNA, 777 nt, Artificial Sequence
  derived and/or modified sequence opt2 from STEAP-1__Homo_sapiens__EAW93749
auggagucccgcaaggacaucaccaaccaggaggagaucuggaagaugaagccccgccgcaaccucgaggacaacgacuaccuccacaaggacaccggcgagaccuccaugcucaagcgccccguccuccuccaccuccagcagaccgcccacgccgacgaguucgacugccccuccgagcuccagcacgcccaggagcucuucccccaguggcaccuccccaucaagaucgccgccgucauggccucccucaccuuccucuacacccuccuccgcgaggucauccacccccucgccaccucccaccagcaguacuucuacaagauccccauccucgucaucaacaagguccuccccauggucuccaucacccuccucgcccucgucuaccuccccggcgucaucgccgccaucguccagguccacaacggcaccaaguacaagaaguucccccacuggcucgacaaguggaugcucacccgcaagcaguucggccuccucucccucuucuucgccguccuccacgccaucuacacccucuccuacgccaugcgccgcuccuaccgcuacaagcuccucaacugggccuaccagcagguccagcagaacaaggaggacgccuggaucgagcacgacgucuggcgcauggagaucuacgucucccucggcaucgucggccucgccauccucgcccuccucgccgucaccuccauccccuccgucuccgacucccucaccuggcgcgaguuccacuacauccaggucaacaacaucuga

SEQ ID NO: 3524 - RNA, 777 nt, Artificial Sequence
  derived and/or modified sequence opt3 from STEAP-1__Homo_sapiens__EAW93749
auggagagcagaaaggacaucaccaaccaggaagagauuuggaaaaugaagcccaggcggaaucuggaagauaacgacuaccuccacaaagauacaggcgagacuuccaugcuuaagcgcccugugcuguugcauuuacaacagacggcccacgcugacgaguucgauugcccaucugaacugcagcaugcacaggagcuauuuccgcaauggcaccuccccauaaaaaucgccgcggucauggcuucacugaccuuccuuuauacacuguugcgagaaguuauucauccucucgccaccagucaccagcaguacuuuuauaagaucccaauucuggugaucaauaagguacugcccauggugagcauaacucucuuagcacuggucuaccuuccuggggugaucgccgcuauuguucaggugcacaacggaacaaaauauaagaaauucccacauugguuggacaaguggaugcugacccguaaacaauuuggucuacucucccuguucuuugcaguccuucacgccaucuacacucugucuuaugcuaugagaaggucguaccgguacaaguugcucaauugggccuaucaacaggugcagcagaacaaggaggaugcguggauugaacaugacguauggcgcauggagaucuacguuucacugggcauagugggguuagcaauucuggcccuccuugcugucacaagcauccccaguguguccgauucucugaccuggagagaguuccacuauauucaggugaauaacaucuga

SEQ ID NO: 3525 - RNA, 777 nt, Artificial Sequence
  derived and/or modified sequence opt4 from STEAP-1__Homo_sapiens__EAW93749
auggagagcagaaaggacaucaccaaccaggaggagaucuggaagaugaagcccagaagaaaccuggaggacaacgacuaccugcacaaggacaccggcgagaccagcaugcugaagagacccgugcugcugcaccugcagcagaccgcccacgccgacgaguucgacugccccagcgagcugcagcacgcccaggagcuguucccccaguggcaccugcccaucaagaucgccgccgugauggccagccugaccuuccuguacacccugcugagagaggugauccacccccuggccaccagccaccagcaguacuucuacaagauccccauccuggugaucaacaaggugcugcccauggugagcaucacccugcuggcccugguguaccugcccggcgugaucgccgccaucgugcaggugcacaacggcaccaaguacaagaaguucccccacuggcuggacaaguggaugcugaccagaaagcaguucggccugcugagccuguucuucgccgugcugcacgccaucuacacccugagcuacgccaugagaagaagcuacagauacaagcugcugaacugggccuaccagcaggugcagcagaacaaggaggacgccuggaucgagcacgacguguggagaauggagaucuacgugagccugggcaucgugggccuggccauccuggcccugcuggccgugaccagcauccccagcgugagcgacagccugaccuggagagaguuccacuacauccaggugaacaacaucuga

SEQ ID NO: 3526 - RNA, 777 nt, Artificial Sequence
  derived and/or modified sequence opt5 from STEAP-1__Homo_sapiens__EAW93749
auggagagcagaaaggacaucaccaaccaggaagagauuuggaaaaugaagccccggcgcaaucuggaagauaacgacuaccuccacaaagauacaggcgagacguccaugcugaagagaccugugcuucugcaucuccaacagaccgcccacgcugacgaguucgauugcccgucugaacugcagcaugcccaggagcuuuuuccccaauggcaucugccuaucaaaauugcggcugucauggccagccucacauuccuguauacccugcuccgggaaguuauccacccccuggccacaucccaccagcaguacuuuuauaagauuccuauccuugugaucaauaaggugcugcccauggucucuauuacccuccuggcucuuguguaccugccugggguuaucgccgcuauugugcagguccacaacggaacaaaauauaagaaauucccgcauuggcucgacaaguggaugcugacccgcaaacaauuuggccugcucagccuguucuuugccgugcuucacgcgaucuacacgcuguccuaugccaugagacggucuuaccgcuacaagcuccugaauugggcuuaucagcagguucagcaaaacaaggaggaugccuggauugaacaugacguguggagaauggagaucuacgucagccuugggauugugggacuggcuauccucgcccugcuggcggugaccuccauccccagcgucucugauucccucacauggcgggaguuccacuauauucagguuaauaacaucuga

SEQ ID NO: 3527 - protein, 339 aa, Artificial Sequence
  STEAP-1__Homo_sapiens__Q9UHE8
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 3528 - RNA, 1020 nt, Artificial Sequence
  STEAP-1__Homo_sapiens__AAD15620
auggaaagcagaaaagacaucacaaaccaagaagaacuuuggaaaaugaagccuaggagaaauuuagaagaagacgauuauuugcauaaggacacgggagagaccagcaugcuaaaaagaccugugcuuuugcauuugcaccaaacagcccaugcugaugaauuugacugcccuucagaacuucagcacacacaggaacucuuuccacaguggcacuugccaauuaaaauagcugcuauuauagcaucucugacuuuucuuuacacucuucugagggaaguaauucacccuuuagcaacuucccaucaacaauauuuuuauaaaauuccaauccuggucaucaacaaagucuugccaaugguuuccaucacucucuuggcauugguuuaccugccaggugugauagcagcaauuguccaacuucauaauggaaccaaguauaagaaguuuccacauugguuggauaaguggauguuaacaagaaagcaguuugggcuucucaguuucuuuuuugcuguacugcaugcaauuuauagucugucuuacccaaugaggcgauccuacagauacaaguugcuaaacugggcauaucaacagguccaacaaaauaaagaagaugccuggauugagcaugauguuuggagaauggagauuuaugugucucugggaauugugggauuggcaauacuggcucuguuggcugugacaucuauuccaucugugagugacucuuugacauggagagaauuucacuauauucagagcaagcuaggaauuguuucccuucuacugggcacaauacacgcauugauuuuugccuggaauaaguggauagauauaaaacaauuuguaugguauacaccuccaacuuuuaugauagcuguuuuccuuccaauuguuguccugauauuuaaaagcauacuauuccugccaugcuugaggaagaagauacugaagauuagacaugguugggaagacgucaccaaaauuaacaaaacugagauauguucccaguuguag

SEQ ID NO: 3529 - RNA, 1020 nt, Artificial Sequence
  derived and/or modified sequence opt1 from STEAP-1__Homo_sapiens__AAD15620
auggagagccgcaaggacaucaccaaccaggaggagcuguggaagaugaagccccggcgcaaccucgaggaggacgacuaccugcacaaggacaccggcgagacguccaugcugaagcggccggugcuccugcaccuccaccagaccgcccacgccgacgaguucgacugccccagcgagcugcagcacacccaggagcuguucccccaguggcaccuccccaucaagaucgcggccaucaucgccucccugaccuuccuguacacgcugcuccgcgaggucauccacccgcuggccaccagccaccagcaguacuucuacaagauccccauccuggugaucaacaaggugcuccccauggucuccaucacccugcuggcccucguguaccugcccggggugaucgcggccaucguccagcugcacaacggcaccaaguacaagaaguucccgcacuggcucgacaaguggaugcugacgcggaagcaguucgggcugcucagcuucuucuucgccgugcugcacgccaucuacucccugagcuaccccaugcgccgguccuaccgcuacaagcuccugaacugggcguaccagcagguccagcagaacaaggaggacgccuggaucgagcacgacguguggcggauggagaucuacgugagccugggcaucguggggcucgccauccuggcccugcucgccgucaccuccauccccagcguguccgacagccugaccuggcgcgaguuccacuacauccaguccaagcugggcaucgugagccuccugcugggcaccauccacgcgcucaucuucgccuggaacaaguggaucgacaucaagcaguucgucugguacacgcccccgaccuucaugaucgccguguuccugcccaucgugguccugaucuucaaguccauccucuuccugcccugccugcggaagaagauccucaagauccgccacgggugggaggacgugaccaagaucaacaagaccgagaucugcagccagcuguga

SEQ ID NO: 3530 - RNA, 1020 nt, Artificial Sequence
  derived and/or modified sequence opt2 from STEAP-1__Homo_sapiens__AAD15620
auggagucccgcaaggacaucaccaaccaggaggagcucuggaagaugaagccccgccgcaaccucgaggaggacgacuaccuccacaaggacaccggcgagaccuccaugcucaagcgccccguccuccuccaccuccaccagaccgcccacgccgacgaguucgacugccccuccgagcuccagcacacccaggagcucuucccccaguggcaccuccccaucaagaucgccgccaucaucgccucccucaccuuccucuacacccuccuccgcgaggucauccacccccucgccaccucccaccagcaguacuucuacaagauccccauccucgucaucaacaagguccuccccauggucuccaucacccuccucgcccucgucuaccuccccggcgucaucgccgccaucguccagcuccacaacggcaccaaguacaagaaguucccccacuggcucgacaaguggaugcucacccgcaagcaguucggccuccucuccuucuucuucgccguccuccacgccaucuacucccucuccuaccccaugcgccgcuccuaccgcuacaagcuccucaacugggccuaccagcagguccagcagaacaaggaggacgccuggaucgagcacgacgucuggcgcauggagaucuacgucucccucggcaucgucggccucgccauccucgcccuccucgccgucaccuccauccccuccgucuccgacucccucaccuggcgcgaguuccacuacauccaguccaagcucggcaucgucucccuccuccucggcaccauccacgcccucaucuucgccuggaacaaguggaucgacaucaagcaguucgucugguacaccccccccaccuucaugaucgccgucuuccuccccaucgucguccucaucuucaaguccauccucuuccuccccugccuccgcaagaagauccucaagauccgccacggcugggaggacgucaccaagaucaacaagaccgagaucugcucccagcucuga

SEQ ID NO: 3531 - RNA, 1020 nt, Artificial Sequence
  derived and/or modified sequence opt3 from STEAP-1__Homo_sapiens__AAD15620
auggagagcagaaaggacaucaccaaccaggaggaacuguggaaaaugaagcccaggcggaaucucgaagaggaugacuaccuucacaaagauacaggcgaaacuuccaugcugaagcgcccuguguuguuacaucugcaccaaacggcccaugcugacgaguucgauugcccaucugagcuacagcacacccaggaacucuuuccgcaguggcaucugcccauuaaaauagcagccaucauugcgucacuuacauuccuguauacuuugcuccgagaggucauccacccucuggcuaccagucaccaacaguacuuuuauaagauuccaauccugguuauaaacaaggugcuccccaugguaagcaucacauuacuggcccuuguguacuugccuggggucauugcagccaucgugcagcugcauaauggaaccaaauauaagaaauucccacacuggcuagacaaguggaugcucacucguaaacaguuuggucugcuuuccuucuuuuucgcuguucugcaugcaauuuacucuuugucguaucccaugagaaggucauaccgguacaagcuccugaacugggccuaucaacaggugcagcagaauaaggaagaugcuuggaucgagcacgacgucuggcgcauggagauauacgugagcuuaggcauuguagggcuggccauccucgcgcuucuggcaguuacaaguauuccuuccgugucugauagcuugaccuggagagaauuucacuauauccaauccaaacuaggaaucgucucacugcuccugggcacgauucaugcccuuauauucgcuuggaacaaguggaucgacauuaaacaguuugugugguacacuccaccgaccuucaugaucgccguguuucugcccauagucguuuugauuuucaagaguauccucuuccugccuuguuuaaggaaaaagauccugaaaauucggcacgguugggaggaugugacaaagaucaauaagacugaaauuugcagccagcuauga

SEQ ID NO: 3532 - RNA, 1020 nt, Artificial Sequence
  derived and/or modified sequence opt4 from STEAP-1__Homo_sapiens__AAD15620
auggagagcagaaaggacaucaccaaccaggaggagcuguggaagaugaagcccagaagaaaccuggaggaggacgacuaccugcacaaggacaccggcgagaccagcaugcugaagagacccgugcugcugcaccugcaccagaccgcccacgccgacgaguucgacugccccagcgagcugcagcacacccaggagcuguucccccaguggcaccugcccaucaagaucgccgccaucaucgccagccugaccuuccuguacacccugcugagagaggugauccacccccuggccaccagccaccagcaguacuucuacaagauccccauccuggugaucaacaaggugcugcccauggugagcaucacccugcuggcccugguguaccugcccggcgugaucgccgccaucgugcagcugcacaacggcaccaaguacaagaaguucccccacuggcuggacaaguggaugcugaccagaaagcaguucggccugcugagcuucuucuucgccgugcugcacgccaucuacagccugagcuaccccaugagaagaagcuacagauacaagcugcugaacugggccuaccagcaggugcagcagaacaaggaggacgccuggaucgagcacgacguguggagaauggagaucuacgugagccugggcaucgugggccuggccauccuggcccugcuggccgugaccagcauccccagcgugagcgacagccugaccuggagagaguuccacuacauccagagcaagcugggcaucgugagccugcugcugggcaccauccacgcccugaucuucgccuggaacaaguggaucgacaucaagcaguucgugugguacaccccccccaccuucaugaucgccguguuccugcccaucguggugcugaucuucaagagcauccuguuccugcccugccugagaaagaagauccugaagaucagacacggcugggaggacgugaccaagaucaacaagaccgagaucugcagccagcuguga

SEQ ID NO: 3533 - RNA, 1020 nt, Artificial Sequence
  derived and/or modified sequence opt5 from STEAP-1__Homo_sapiens__AAD15620
auggagagcagaaaggacaucaccaaccaggaggaacuguggaaaaugaagccccggcgcaaucucgaagaggaugacuaccugcacaaagauacaggcgaaacguccaugcuuaagagaccugugcugcuccaucugcaccaaaccgcccaugcugacgaguucgauugcccgucugagcuucagcacacacaggaacuguuuccccaguggcaucucccuauuaaaaucgccgcgauuaucgcuagccugaccuuccuguauacacuccugcgggaggucauucacccccuugccaccucccaccaacaguacuuuuauaagaucccuauccugguuauuaacaaggugcuccccauggugucuaucacacugcuugcccuggucuaccucccuggggugauugcugccaucguucagcugcauaauggaaccaaauauaagaaauucccgcacuggcuggacaaguggaugcucacgcgcaaacaguuuggccugcuuagcuucuuuuucgcugugcugcaugccauuuacucccucucuuaucccaugagacggagcuaccgcuacaagcugcuuaacugggcguaucaacagguccagcagaauaaggaagaugccuggaucgagcacgacguguggagaauggagauuuacguuucccuggggaucgugggacucgcuauccuggcccugcucgcugucaccagcauuccuucuguguccgauagccugacauggcgggaauuucacuauauccaaucuaaacuuggcauugugucccugcuccuggggaccauccaugcccuuauuuucgcguggaacaaguggaucgacaucaaacaguuugucugguacacacccccuaccuucaugauugccguuuuucugcccaucguggugcucauuuucaagagcauccuguuccugccgugucuccgcaaaaagauucugaaaaucagacacggaugggaggaugucacgaagaucaauaagacagaaauuugcucucagcuuuga

SEQ ID NO: 3534 - protein, 165 aa, Artificial Sequence
  Survivin-2B__Homo_sapiens__O15392-2
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAEKVRRAIEQLAAMD

SEQ ID NO: 3535 - RNA, 498 nt, Artificial Sequence
  Survivin-2B__Homo_sapiens__CCDS32752.1
augggugccccgacguugcccccugccuggcagcccuuucucaaggaccaccgcaucucuacauucaagaacuggcccuucuuggagggcugcgccugcaccccggagcggauggccgaggcuggcuucauccacugccccacugagaacgagccagacuuggcccaguguuucuucugcuucaaggagcuggaaggcugggagccagaugacgaccccauugggccgggcacgguggcuuacgccuguaauaccagcacuuugggaggccgaggcgggcggaucacgagagaggaacauaaaaagcauucguccgguugcgcuuuccuuucugucaagaagcaguuugaagaauuaacccuuggugaauuuuugaaacuggacagagaaagagccaagaacaaaauugcaaaggaaaccaacaauaagaagaaagaauuugaggaaacugcggagaaagugcgccgugccaucgagcagcuggcugccauggauuga

SEQ ID NO: 3536 - RNA, 498 nt, Artificial Sequence
  derived and/or modified sequence opt1 from Survivin-2B__Homo_sapiens__CCDS32752.1
augggcgcccccacccugccgcccgccuggcagcccuuccucaaggaccaccgcaucagcaccuucaagaacuggcccuuccuggaggggugcgcgugcacgccggagcggauggccgaggccggcuucauccacugccccaccgagaacgagcccgaccuggcccagugcuucuucugcuucaaggagcucgaggggugggagcccgacgacgacccgaucggccccgggaccguggccuacgcgugcaacaccuccacgcugggcggccgcgggggccggaucacccgcgaggagcacaagaagcacagcuccgggugcgccuuccugagcgucaagaagcaguucgaggagcucacccugggcgaguuccugaagcucgaccgggagcgcgccaagaacaagaucgccaaggagaccaacaacaagaagaaggaguucgaggagacggcggagaaggugcggcgcgccaucgagcagcuggccgccauggacuga

SEQ ID NO: 3537 - RNA, 498 nt, Artificial Sequence
  derived and/or modified sequence opt2 from Survivin-2B__Homo_sapiens__CCDS32752.1
augggcgcccccacccucccccccgccuggcagcccuuccucaaggaccaccgcaucuccaccuucaagaacuggcccuuccucgagggcugcgccugcacccccgagcgcauggccgaggccggcuucauccacugccccaccgagaacgagcccgaccucgcccagugcuucuucugcuucaaggagcucgagggcugggagcccgacgacgaccccaucggccccggcaccgucgccuacgccugcaacaccuccacccucggcggccgcggcggccgcaucacccgcgaggagcacaagaagcacuccuccggcugcgccuuccucuccgucaagaagcaguucgaggagcucacccucggcgaguuccucaagcucgaccgcgagcgcgccaagaacaagaucgccaaggagaccaacaacaagaagaaggaguucgaggagaccgccgagaagguccgccgcgccaucgagcagcucgccgccauggacuga

SEQ ID NO: 3538 - RNA, 498 nt, Artificial Sequence
  derived and/or modified sequence opt3 from Survivin-2B__Homo_sapiens__CCDS32752.1
augggcgcccccacccugccuccagcuuggcagccguuccucaaggaccacagaaucagcacauuuaaaaacuggcccuuccuugaggggugcgcauguacuccugaaaggauggccgaggcgggauuuauucauugcccaacggaaaaugagcccgaucuggcucaauguuucuuuugcuucaaggaauuggaggguugggagccugacgaugacccaauaggccccgggaccguggccuacgcauguaacacauccacuuuaggaggccggggugggcgcaucacccgagaagaacacaaaaagcauucuucaggaugcgccuuucugagugucaaaaagcaguucgaggagcuaacacucggcgaguuucugaaacuugaucgugaaagagcuaagaauaagauugcaaaagagaccaacaauaagaaaaaggaguucgaagaaacugccgagaagguuaggcgggcuaucgagcagcuggccgcgauggacuga

SEQ ID NO: 3539 - RNA, 498 nt, Artificial Sequence
  derived and/or modified sequence opt4 from Survivin-2B__Homo_sapiens__CCDS32752.1
augggcgcccccacccugccccccgccuggcagcccuuccugaaggaccacagaaucagcaccuucaagaacuggcccuuccuggagggcugcgccugcacccccgagagaauggccgaggccggcuucauccacugccccaccgagaacgagcccgaccuggcccagugcuucuucugcuucaaggagcuggagggcugggagcccgacgacgaccccaucggccccggcaccguggccuacgccugcaacaccagcacccugggcggcagaggcggcagaaucaccagagaggagcacaagaagcacagcagcggcugcgccuuccugagcgugaagaagcaguucgaggagcugacccugggcgaguuccugaagcuggacagagagagagccaagaacaagaucgccaaggagaccaacaacaagaagaaggaguucgaggagaccgccgagaaggugagaagagccaucgagcagcuggccgccauggacuga

SEQ ID NO: 3540 - RNA, 498 nt, Artificial Sequence
  derived and/or modified sequence opt5 from Survivin-2B__Homo_sapiens__CCDS32752.1
augggcgcccccacccugccuccggcuuggcagcccuuccucaaggaccacagaaucagcacauuuaaaaacuggccuuuccuggaggggugcgccuguacgcccgaacggauggcggaggcuggauuuauucauugcccuaccgaaaaugagcccgaucuugcccaauguuucuuuugcuucaaggaacuggagggcugggagccugacgaugacccgaucgggcccggaacaguggccuacgcuuguaacaccuccacacucggcgggcgcggaggcagaauuacccgggaagaacacaaaaagcauucuagcggcugcgccuuucuguccgucaaaaagcaguucgaggagcuuacacugggggaguuucucaagcuggaucgcgaaagagcuaaaaauaagaucgccaaagagaccaacaauaagaaaaaggaguucgaagaaacggcggagaagguucggcgcgccauugagcagcuggcugccauggacuga

SEQ ID NO: 3541 - protein, 142 aa, Artificial Sequence
  survivin__Homo_sapiens__O15392
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 3542 - RNA, 429 nt, Artificial Sequence
  survivin__Homo_sapiens__AAC51660
augggugccccgacguugcccccugccuggcagcccuuucucaaggaccaccgcaucucuacauucaagaacuggcccuucuuggagggcugcgccugcaccccggagcggauggccgaggcuggcuucauccacugccccacugagaacgagccagacuuggcccaguguuucuucugcuucaaggagcuggaaggcugggagccagaugacgaccccauagaggaacauaaaaagcauucguccgguugcgcuuuccuuucugucaagaagcaguuugaagaauuaacccuuggugaauuuuugaaacuggacagagaaagagccaagaacaaaauugcaaaggaaaccaacaauaagaagaaagaauuugaggaaacugcgaagaaagugcgccgugccaucgagcagcuggcugccauggauuga

SEQ ID NO: 3543 - RNA, 429 nt, Artificial Sequence
  derived and/or modified sequence opt1 from survivin__Homo_sapiens__AAC51660
augggcgcccccacccugccgcccgccuggcagcccuuccucaaggaccaccgcaucagcaccuucaagaacuggcccuuccuggaggggugcgcgugcacgccggagcggauggccgaggccggcuucauccacugccccaccgagaacgagcccgaccuggcccagugcuucuucugcuucaaggagcucgaggggugggagcccgacgacgacccgaucgaggagcacaagaagcacuccagcggcugcgccuuccuguccgugaagaagcaguucgaggagcugacccucggggaguuccugaagcuggaccgcgagcgggcgaagaacaagaucgccaaggagaccaacaacaagaagaaggaguucgaggagacggccaagaagguccgccgggccaucgagcagcucgcggccauggacuga

SEQ ID NO: 3544 - RNA, 429 nt, Artificial Sequence
  derived and/or modified sequence opt2 from survivin__Homo_sapiens__AAC51660
augggcgcccccacccucccccccgccuggcagcccuuccucaaggaccaccgcaucuccaccuucaagaacuggcccuuccucgagggcugcgccugcacccccgagcgcauggccgaggccggcuucauccacugccccaccgagaacgagcccgaccucgcccagugcuucuucugcuucaaggagcucgagggcugggagcccgacgacgaccccaucgaggagcacaagaagcacuccuccggcugcgccuuccucuccgucaagaagcaguucgaggagcucacccucggcgaguuccucaagcucgaccgcgagcgcgccaagaacaagaucgccaaggagaccaacaacaagaagaaggaguucgaggagaccgccaagaagguccgccgcgccaucgagcagcucgccgccauggacuga

SEQ ID NO: 3545 - RNA, 429 nt, Artificial Sequence
  derived and/or modified sequence opt3 from survivin__Homo_sapiens__AAC51660
augggcgcccccacccugccuccagcuuggcagccguuccucaaggaccacagaaucagcacauuuaaaaacuggcccuuccuugaggggugcgcauguacuccugaaaggauggccgaggcgggauuuauucauugcccaacggaaaaugagcccgaucuggcucaauguuucuuuugcuucaaggaauuggaggguugggagccugacgaugacccaauagaagaacacaaaaagcauuccucuggcugugccuuuuuaucagugaaaaagcaguucgaggagcugacccuaggggaguuucucaagcuggaucgggaacgcgccaaaaacaagaucgcaaaagagacaaauaacaagaaaaaggaguucgaagaaacugcuaagaaaguccgacgugcaauugagcagcuugccgcuauggacuga

SEQ ID NO: 3546 - RNA, 429 nt, Artificial Sequence
  derived and/or modified sequence opt4 from survivin__Homo_sapiens__AAC51660
augggcgcccccacccugccccccgccuggcagcccuuccugaaggaccacagaaucagcaccuucaagaacuggcccuuccuggagggcugcgccugcacccccgagagaauggccgaggccggcuucauccacugccccaccgagaacgagcccgaccuggcccagugcuucuucugcuucaaggagcuggagggcugggagcccgacgacgaccccaucgaggagcacaagaagcacagcagcggcugcgccuuccugagcgugaagaagcaguucgaggagcugacccugggcgaguuccugaagcuggacagagagagagccaagaacaagaucgccaaggagaccaacaacaagaagaaggaguucgaggagaccgccaagaaggugagaagagccaucgagcagcuggccgccauggacuga

SEQ ID NO: 3547 - RNA, 429 nt, Artificial Sequence
  derived and/or modified sequence opt5 from survivin__Homo_sapiens__AAC51660
augggcgcccccacccugccuccggcuuggcagcccuuccucaaggaccacagaaucagcacauuuaaaaacuggccuuuccuggaggggugcgccuguacgcccgaacggauggcggaggcuggauuuauucauugcccuaccgaaaaugagcccgaucuugcccaauguuucuuuugcuucaaggaacuggagggcugggagccugacgaugacccgaucgaagaacacaaaaagcauuccucugggugugccuuucucagcgugaaaaagcaguucgaggagcugacacuuggagaguuucugaagcucgaucgcgaaagagcuaaaaacaagauugccaaagagaccaauaacaagaaaaaggaguucgaagaaacagcuaagaaaguccggcgcgccaucgagcagcuggcggccauggacuga

SEQ ID NO: 3548 - protein, 976 aa, Artificial Sequence
  SYCP1__Homo_sapiens__A0A024R0I2
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKKDKKTQTFLLETPEIYWKLDSKAVPSQTVSRNFTSVDHGISKDKRDYLWTSAKNTLSTPLPKAYTVKTPTKPKLQQRENLNIPIEESKKKRKMAFEFDINSDSSETTDLLSMVSEEETLKTLYRNNNPPASHLCVKTPKKAPSSLTTPGSTLKFGAIRKMREDRWAVIAKMDRKKKLKEAEKLFV

SEQ ID NO: 3549 - RNA, 2931 nt, Artificial Sequence
  SYCP1__Homo_sapiens__EAW56623
auggaaaagcaaaagcccuuugcauuguucguaccaccgagaucaagcagcagucaggugucugcggugaaaccucagacccugggaggcgauuccacuuucuucaagaguuucaacaaauguacugaagaugauuuugaguuuccauuugcaaagacuaaucucuccaaaaauggggaaaacauugauucagauccugcuuuacaaaaaguuaauuucuugcccgugcuugagcagguugguaauucugacugucacuaucaggaaggacuaaaagacucugauuuggagaauucagagggauugagcagaguguauucaaaacuguauaaggaggcugaaaagauaaaaaaauggaaaguaaguacagaagcugaacugagacagaaagaaaguaaguugcaagaaaacagaaagauaauugaagcacagcgaaaagccauucaggaacugcaauuuggaaaugaaaaaguaaguuugaaauuagaagaaggaauacaagaaaauaaagauuuaauaaaagagaauaaugccacaaggcauuuauguaaucuacucaaagaaaccugugcuagaucugcagaaaagacaaagaaauaugaauaugaacgggaagaaaccaggcaaguuuauauggaucuaaauaauaacauugagaaaaugauaacagcuuuugaggaacuucgugugcaagcugagaauuccagacuggaaaugcauuuuaaguuaaaggaagauuaugaaaaaauccaacaccuugaacaagaauacaagaaggaaauaaaugacaaggaaaagcagguaucacuacuauugauccaaaucacugagaaagaaaauaaaaugaaagauuuaacauuucugcuagaggaauccagagauaaaguuaaucaauuagaggaaaagacaaaauuacagagugaaaacuuaaaacaaucaauugagaaacagcaucauuugacuaaagaacuagaagauauuaaagugucauuacaaagaagugugaguacucaaaaggcuuuagaggaagauuuacagauagcaacaaaaacaauuugucagcuaacugaagaaaaagaaacucaaauggaagaaucuaauaaagcuagagcugcucauucguuugugguuacugaauuugaaacuacugucugcagcuuggaagaauuauugagaacagaacagcaaagauuggaaaaaaaugaagaucaauugaaaauacuuaccauggagcuucaaaagaaaucaagugagcuggaagagaugacuaagcuuacaaauaacaaagaaguagaacuugaagaauugaaaaaagucuugggagaaaaggaaacacuuuuauaugaaaauaaacaauuugagaagauugcugaagaauuaaaaggaacagaacaagaacuaauuggucuucuccaagccagagagaaagaaguacaugauuuggaaauacaguuaacugccauuaccacaagugaacaguauuauucaaaagagguuaaagaucuaaaaacugagcuugaaaacgagaagcuuaagaauacugaauuaacuucacacugcaacaagcuuucacuagaaaacaaagagcucacacaggaaacaagugauaugacccuagaacucaagaaucagcaagaagauauuaauaauaacaaaaagcaagaagaaaggauguugaaacaaauagaaaaucuucaagaaacagaaacccaauuaagaaaugaacuagaauaugugagagaagagcuaaaacagaaaagagaugaaguuaaauguaaauuggacaagagugaagaaaauuguaacaauuuaaggaaacaaguugaaaauaaaaacaaguauauugaagaacuucagcaggagaauaaggccuugaaaaaaaaagguacagcagaaagcaagcaacugaauguuuaugagauaaaggucaauaaauuagaguuagaacuagaaagugccaaacagaaauuuggagaaaucacagacaccuaucagaaagaaauugaggacaaaaagauaucagaagaaaaucuuuuggaagagguugagaaagcaaaaguaauagcugaugaagcaguaaaauuacagaaagaaauugauaagcgaugucaacauaaaauagcugaaaugguagcacuuauggaaaaacauaagcaccaauaugauaagaucauugaagaaagagacucagaauuaggacuuuauaagagcaaagaacaagaacagucaucacugagagcaucuuuggagauugaacuauccaaucucaaagcugaacuuuugucuguuaagaagcaacuugaaauagaaagagaagagaaggaaaaacucaaaagagaggcaaaagaaaacacagcuacucuuaaagaaaaaaaagacaagaaaacacaaacauuuuuauuggaaacaccugaaauuuauuggaaauuggauucuaaagcaguuccuucacaaacuguaucucgaaauuucacaucaguugaucauggcauauccaaagauaaaagagacuaucuguggacaucugccaaaaauacuuuaucuacaccauugccaaaggcauauacagugaagacaccaacaaaaccaaaacuacagcaaagagaaaacuugaauauacccauugaagaaaguaaaaaaaagagaaaaauggccuuugaauuugauauuaauucagauaguucagaaacuacugaucuuuugagcaugguuucagaagaagagacauugaaaacacuguauaggaacaauaauccaccagcuucucaucuuugugucaaaacaccaaaaaaggccccuucaucucuaacaaccccuggaucuacacugaaguuuggagcuauaagaaaaaugcgggaggaccguugggcuguaauugcuaaaauggauagaaaaaaaaaacuaaaagaagcugaaaaguuauuuguuuaa

SEQ ID NO: 3550 - RNA, 2931 nt, Artificial Sequence
  derived and/or modified sequence opt1 from SYCP1__Homo_sapiens__EAW56623
auggagaagcagaagcccuucgcccuguucgugccgccccgcagcuccagcucccaggucagcgccgugaagccccagacccucggcggggacuccaccuucuucaagagcuucaacaagugcacggaggacgacuucgaguuccccuucgcgaagaccaaccuguccaagaacggcgagaacaucgacagcgacccggcccugcagaaggugaacuuccuccccguccuggagcaggucgggaacuccgacugccacuaccaggagggccugaaggacagcgaccucgagaacuccgaggggcugagccggguguacuccaagcuguacaaggaggccgagaagaucaagaaguggaaggugagcaccgaggccgagcuccgccagaaggaguccaagcugcaggagaaccggaagaucaucgaggcccagcgcaaggcgauccaggagcugcaguucggcaacgagaaggugagccucaagcuggaggagggcauccaggagaacaaggaccugaucaaggagaacaacgccacccggcaccucugcaaccugcugaaggagacgugcgcccgcuccgccgagaagaccaagaaguacgaguacgagcgggaggagacccgccagguguacauggaccucaacaacaacaucgagaagaugaucaccgcguucgaggagcugcggguccaggccgagaacagccgccuggagaugcacuucaagcucaaggaggacuacgagaagauccagcaccuggagcaggaguacaagaaggagaucaacgacaaggagaagcaggucucccugcuccugauccagaucacggagaaggagaacaagaugaaggaccugaccuuccuccuggaggagagccgggacaaggugaaccagcuggaggagaagaccaagcuccagagcgagaaccugaagcaguccaucgagaagcagcaccaccugaccaaggagcucgaggacaucaaggugagccugcagcgcuccgugagcacgcagaaggcccuggaggaggaccuccagaucgccaccaagaccaucugccagcugaccgaggagaaggagacgcagauggaggaguccaacaaggcccgggcggcccacagcuucguggucaccgaguucgagaccaccgugugcucccuggaggagcuccugcgcacggagcagcagcggcuggagaagaacgaggaccagcucaagauccugaccauggagcugcagaagaaguccagcgagcucgaggagaugaccaagcugaccaacaacaaggagguggagcuggaggagcucaagaagguccugggggagaaggagacgcugcuguacgagaacaagcaguucgagaagaucgccgaggagcucaagggcaccgagcaggagcugaucgggcugcuccaggcccgcgagaaggaggugcacgaccuggagauccagcugaccgccaucaccacgagcgagcaguacuacuccaaggaggugaaggaccucaagaccgagcuggagaacgagaagcugaagaacaccgagcucaccagccacugcaacaagcugucccuggagaacaaggagcucacgcaggagaccagcgacaugacccuggagcugaagaaccagcaggaggacaucaacaacaacaagaagcaggaggagcggaugcucaagcagaucgagaaccugcaggagaccgagacgcagcugcgcaacgagcucgaguacguccgggaggagcugaagcagaagcgcgacgaggugaagugcaagcuggacaaguccgaggagaacugcaacaaccuccggaagcaggucgagaacaagaacaaguacaucgaggagcugcagcaggagaacaaggcgcugaagaagaagggcaccgccgagagcaagcagcucaacguguacgagaucaaggugaacaagcuggagcuggagcucgaguccgccaagcagaaguucggggagaucaccgacaccuaccagaaggagaucgaggacaagaagaucagcgaggagaaccugcuggaggaggucgagaaggccaaggugaucgccgacgaggcggugaagcuccagaaggagaucgacaagcgcugccagcacaagaucgccgagauggucgcccugauggagaagcacaagcaccaguacgacaagaucaucgaggagcgcgacuccgagcugggccucuacaagagcaaggagcaggagcagagcucccugcgggccagccuggagaucgagcucuccaaccugaaggccgagcugcucagcgugaagaagcagcuggagaucgagcgcgaggagaaggagaagcugaagcgggaggcgaaggagaacaccgccacgcucaaggagaagaaggacaagaagacccagaccuuccugcuggagacccccgagaucuacuggaagcucgacuccaaggccgugcccagccagacggucucccgcaacuucaccagcguggaccacggcaucuccaaggacaagcgggacuaccuguggaccagcgccaagaacacccuguccacgccgcuccccaaggcguacaccgugaagacccccaccaagcccaagcugcagcagcgcgagaaccugaacaucccgaucgaggagagcaagaagaagcggaagauggccuucgaguucgacaucaacuccgacagcuccgagacgaccgaccuccugagcauggucuccgaggaggagacccugaagacccucuaccgcaacaacaacccgcccgccagccaccugugcgugaagacgcccaagaaggcccccagcucccugaccacccccgggagcacccucaaguucggcgccauccggaagaugcgcgaggaccggugggcggugaucgccaagauggaccgcaagaagaagcugaaggaggccgagaagcuguucgucuga

SEQ ID NO: 3551 - RNA, 2931 nt, Artificial Sequence
  derived and/or modified sequence opt2 from SYCP1__Homo_sapiens__EAW56623
auggagaagcagaagcccuucgcccucuucguccccccccgcuccuccuccucccaggucuccgccgucaagccccagacccucggcggcgacuccaccuucuucaaguccuucaacaagugcaccgaggacgacuucgaguuccccuucgccaagaccaaccucuccaagaacggcgagaacaucgacuccgaccccgcccuccagaaggucaacuuccuccccguccucgagcaggucggcaacuccgacugccacuaccaggagggccucaaggacuccgaccucgagaacuccgagggccucucccgcgucuacuccaagcucuacaaggaggccgagaagaucaagaaguggaaggucuccaccgaggccgagcuccgccagaaggaguccaagcuccaggagaaccgcaagaucaucgaggcccagcgcaaggccauccaggagcuccaguucggcaacgagaaggucucccucaagcucgaggagggcauccaggagaacaaggaccucaucaaggagaacaacgccacccgccaccucugcaaccuccucaaggagaccugcgcccgcuccgccgagaagaccaagaaguacgaguacgagcgcgaggagacccgccaggucuacauggaccucaacaacaacaucgagaagaugaucaccgccuucgaggagcuccgcguccaggccgagaacucccgccucgagaugcacuucaagcucaaggaggacuacgagaagauccagcaccucgagcaggaguacaagaaggagaucaacgacaaggagaagcaggucucccuccuccucauccagaucaccgagaaggagaacaagaugaaggaccucaccuuccuccucgaggagucccgcgacaaggucaaccagcucgaggagaagaccaagcuccaguccgagaaccucaagcaguccaucgagaagcagcaccaccucaccaaggagcucgaggacaucaaggucucccuccagcgcuccgucuccacccagaaggcccucgaggaggaccuccagaucgccaccaagaccaucugccagcucaccgaggagaaggagacccagauggaggaguccaacaaggcccgcgccgcccacuccuucgucgucaccgaguucgagaccaccgucugcucccucgaggagcuccuccgcaccgagcagcagcgccucgagaagaacgaggaccagcucaagauccucaccauggagcuccagaagaaguccuccgagcucgaggagaugaccaagcucaccaacaacaaggaggucgagcucgaggagcucaagaagguccucggcgagaaggagacccuccucuacgagaacaagcaguucgagaagaucgccgaggagcucaagggcaccgagcaggagcucaucggccuccuccaggcccgcgagaaggagguccacgaccucgagauccagcucaccgccaucaccaccuccgagcaguacuacuccaaggaggucaaggaccucaagaccgagcucgagaacgagaagcucaagaacaccgagcucaccucccacugcaacaagcucucccucgagaacaaggagcucacccaggagaccuccgacaugacccucgagcucaagaaccagcaggaggacaucaacaacaacaagaagcaggaggagcgcaugcucaagcagaucgagaaccuccaggagaccgagacccagcuccgcaacgagcucgaguacguccgcgaggagcucaagcagaagcgcgacgaggucaagugcaagcucgacaaguccgaggagaacugcaacaaccuccgcaagcaggucgagaacaagaacaaguacaucgaggagcuccagcaggagaacaaggcccucaagaagaagggcaccgccgaguccaagcagcucaacgucuacgagaucaaggucaacaagcucgagcucgagcucgaguccgccaagcagaaguucggcgagaucaccgacaccuaccagaaggagaucgaggacaagaagaucuccgaggagaaccuccucgaggaggucgagaaggccaaggucaucgccgacgaggccgucaagcuccagaaggagaucgacaagcgcugccagcacaagaucgccgagauggucgcccucauggagaagcacaagcaccaguacgacaagaucaucgaggagcgcgacuccgagcucggccucuacaaguccaaggagcaggagcaguccucccuccgcgccucccucgagaucgagcucuccaaccucaaggccgagcuccucuccgucaagaagcagcucgagaucgagcgcgaggagaaggagaagcucaagcgcgaggccaaggagaacaccgccacccucaaggagaagaaggacaagaagacccagaccuuccuccucgagacccccgagaucuacuggaagcucgacuccaaggccguccccucccagaccgucucccgcaacuucaccuccgucgaccacggcaucuccaaggacaagcgcgacuaccucuggaccuccgccaagaacacccucuccaccccccuccccaaggccuacaccgucaagacccccaccaagcccaagcuccagcagcgcgagaaccucaacauccccaucgaggaguccaagaagaagcgcaagauggccuucgaguucgacaucaacuccgacuccuccgagaccaccgaccuccucuccauggucuccgaggaggagacccucaagacccucuaccgcaacaacaacccccccgccucccaccucugcgucaagacccccaagaaggcccccuccucccucaccacccccggcuccacccucaaguucggcgccauccgcaagaugcgcgaggaccgcugggccgucaucgccaagauggaccgcaagaagaagcucaaggaggccgagaagcucuucgucuga

SEQ ID NO: 3552 - RNA, 2931 nt, Artificial Sequence
  derived and/or modified sequence opt3 from SYCP1__Homo_sapiens__EAW56623
auggagaagcagaaacccuucgcccuguuugugccuccaagaagcuccucuucacaagucagugcuguuaagccgcagacccucggcggggacagcacauucuuuaaauccuucaacaagugcacugaagaugacuuugaguuccccuuugcaaaaacgaaucuuucuaagaacggagaaaauaucgauucggacccugcccugcagaaggugaacuucuugccaguauuagaacagguggguaauucagauugucacuaccaagaaggccugaaagacagcgaucuagagaacagugaggggcucuccagggucuauucuaagcuguacaaagaagcggagaagauuaaaaaguggaaggugagcaccgaagcugagcuucggcagaaagaguccaagcugcaggaaaaucgcaaaauaaucgaggcccagcgaaaggcaauucaagaauugcaguuuggaaacgagaaaguuucacucaagcuggaagagggcauccaggagaauaaagaccugauuaaggaaaacaaugccacacgucaucucugcaacuuacugaaggagacuugugcuagaagugcagagaaaaccaagaaauaugaguacgaaagggaggagacacgccagguguauauggaucuuaauaacaauaucgaaaagaugauaaccgccuucgaggaauugcggguccaagcugagaacagcagacuggaaaugcacuuuaaacuaaaggaggacuacgagaagauccagcaucucgaacaggaguauaaaaaggaaauuaacgauaaagagaagcaagugucucugcuucugauccagauuacugagaaagaaaauaagaugaaggacuugacauuccuccuggaggaauccagggauaaaguaaaccaguuagaggaaaagaccaaacugcagucagagaaucucaagcaaagcaucgagaaacagcaccaucuuacgaaggaacuggaggacauaaagguuaguuugcagcggucuguguccacucagaaagcccuagaagaggaccugcaaauugcgaccaagacaaucugccagcucacugaagagaaagagacccagauggaagagagcaacaaggcacgcgccgcucacucguuugucgugacagaguucgaaaccacgguguguucucuggaggaacuucugcgaacugagcagcaaagauuggagaaaaaugaagaucagcucaagauucugacaauggaauuacagaaaaaguccucagagcuggaggaaaugaccaagcuaacuaacaauaaagaggucgaacucgaggaacugaagaaaguucuuggugagaaggagacauugcuguacgaaaacaaacaguucgagaagaucgccgaggaacucaaggggaccgaacaagagcugaucggacuucugcaggcaagggagaaagaagugcacgacuuggagauucagcucacggcuauaaccacaagugaacaauacuauagcaaggagguaaaagaucugaagacugaauuagagaaugagaaacugaagaacaccgaacuaacaucccauugcaauaagcucucucuggagaacaaagaacuuacucaggagaccagcgacaugacauuggagcugaagaaucagcaggaagauaucaacaauaacaaaaagcaagaggaacggaugcucaaacagauugagaaccugcaggaaaccgagacucaguuacguaaugagcuggaauacgugcgcgaggaacuuaagcaaaagagagacgaggucaaauguaaguuggauaaaucagaagagaacugcaauaaccucaggaaacagguggagaauaaaaacaaguauaucgaggaacugcagcaggaaaauaaagcccuaaagaagaaaggcacggcggagaguaagcaacugaacguuuacgaaauaaaagugaauaagcucgagcuggagcuugaauccgccaaacagaaguuuggcgagauuacagacaccuaucagaaggaaaucgaggauaaaaagaucagcgaggaaaacuugcuggaggaagucgagaaagcaaaggugauugcugacgaagccguaaaauuacaaaaggagaucgauaagcggugucagcacaaaauugcugagaugguugcccucauggaaaagcauaaacaccaguacgacaagauaaucgaggaacgagacucugagcuggggcuuuauaaaucaaaggaacaggagcaaaguagccugcgcgcauccuuggagauugaacucucuaaucugaaggccgagcuacugucggugaaaaagcagcucgaaaucgagagagaagagaaagagaagcugaaaagggaagcuaaggagaacacugcgacccuuaaggagaaaaaggauaaaaagacacagaccuucuugcuggaaacucccgagaucuacuggaaauuagacagcaaggcagucccuucccagacagugucacggaauuuuacgagugucgaucacggaauuucuaaagacaagcgcgauuaccucuggaccagcgccaagaacacucuguccacaccacuucccaaggcuuauaccgugaagacaccuacuaaaccaaagcugcaacagagagaaaaucuaaacauaccgaucgaggaaagcaaaaagaagaggaaaauggccuucgaguuugacauuaacucagauucuuccgaaaccacggaccuccugaguaugguuagcgaggaggaaaccuugaagacacuguaccguaauaacaaucccccugcaucucauuuaugcgugaaaacuccaaagaaagcccccuccucacucaccacaccugguaguacucugaaguucggcgcuauccggaagaugcgagaggauagaugggccguaauugcaaaaauggacaggaagaagaaacuuaaagaagcggagaagcuguuugucuga

SEQ ID NO: 3553 - RNA, 2931 nt, Artificial Sequence
  derived and/or modified sequence opt4 from SYCP1__Homo_sapiens__EAW56623
auggagaagcagaagcccuucgcccuguucgugccccccagaagcagcagcagccaggugagcgccgugaagccccagacccugggcggcgacagcaccuucuucaagagcuucaacaagugcaccgaggacgacuucgaguuccccuucgccaagaccaaccugagcaagaacggcgagaacaucgacagcgaccccgcccugcagaaggugaacuuccugcccgugcuggagcaggugggcaacagcgacugccacuaccaggagggccugaaggacagcgaccuggagaacagcgagggccugagcagaguguacagcaagcuguacaaggaggccgagaagaucaagaaguggaaggugagcaccgaggccgagcugagacagaaggagagcaagcugcaggagaacagaaagaucaucgaggcccagagaaaggccauccaggagcugcaguucggcaacgagaaggugagccugaagcuggaggagggcauccaggagaacaaggaccugaucaaggagaacaacgccaccagacaccugugcaaccugcugaaggagaccugcgccagaagcgccgagaagaccaagaaguacgaguacgagagagaggagaccagacagguguacauggaccugaacaacaacaucgagaagaugaucaccgccuucgaggagcugagagugcaggccgagaacagcagacuggagaugcacuucaagcugaaggaggacuacgagaagauccagcaccuggagcaggaguacaagaaggagaucaacgacaaggagaagcaggugagccugcugcugauccagaucaccgagaaggagaacaagaugaaggaccugaccuuccugcuggaggagagcagagacaaggugaaccagcuggaggagaagaccaagcugcagagcgagaaccugaagcagagcaucgagaagcagcaccaccugaccaaggagcuggaggacaucaaggugagccugcagagaagcgugagcacccagaaggcccuggaggaggaccugcagaucgccaccaagaccaucugccagcugaccgaggagaaggagacccagauggaggagagcaacaaggccagagccgcccacagcuucguggugaccgaguucgagaccaccgugugcagccuggaggagcugcugagaaccgagcagcagagacuggagaagaacgaggaccagcugaagauccugaccauggagcugcagaagaagagcagcgagcuggaggagaugaccaagcugaccaacaacaaggagguggagcuggaggagcugaagaaggugcugggcgagaaggagacccugcuguacgagaacaagcaguucgagaagaucgccgaggagcugaagggcaccgagcaggagcugaucggccugcugcaggccagagagaaggaggugcacgaccuggagauccagcugaccgccaucaccaccagcgagcaguacuacagcaaggaggugaaggaccugaagaccgagcuggagaacgagaagcugaagaacaccgagcugaccagccacugcaacaagcugagccuggagaacaaggagcugacccaggagaccagcgacaugacccuggagcugaagaaccagcaggaggacaucaacaacaacaagaagcaggaggagagaaugcugaagcagaucgagaaccugcaggagaccgagacccagcugagaaacgagcuggaguacgugagagaggagcugaagcagaagagagacgaggugaagugcaagcuggacaagagcgaggagaacugcaacaaccugagaaagcagguggagaacaagaacaaguacaucgaggagcugcagcaggagaacaaggcccugaagaagaagggcaccgccgagagcaagcagcugaacguguacgagaucaaggugaacaagcuggagcuggagcuggagagcgccaagcagaaguucggcgagaucaccgacaccuaccagaaggagaucgaggacaagaagaucagcgaggagaaccugcuggaggagguggagaaggccaaggugaucgccgacgaggccgugaagcugcagaaggagaucgacaagagaugccagcacaagaucgccgagaugguggcccugauggagaagcacaagcaccaguacgacaagaucaucgaggagagagacagcgagcugggccuguacaagagcaaggagcaggagcagagcagccugagagccagccuggagaucgagcugagcaaccugaaggccgagcugcugagcgugaagaagcagcuggagaucgagagagaggagaaggagaagcugaagagagaggccaaggagaacaccgccacccugaaggagaagaaggacaagaagacccagaccuuccugcuggagacccccgagaucuacuggaagcuggacagcaaggccgugcccagccagaccgugagcagaaacuucaccagcguggaccacggcaucagcaaggacaagagagacuaccuguggaccagcgccaagaacacccugagcaccccccugcccaaggccuacaccgugaagacccccaccaagcccaagcugcagcagagagagaaccugaacauccccaucgaggagagcaagaagaagagaaagauggccuucgaguucgacaucaacagcgacagcagcgagaccaccgaccugcugagcauggugagcgaggaggagacccugaagacccuguacagaaacaacaacccccccgccagccaccugugcgugaagacccccaagaaggcccccagcagccugaccacccccggcagcacccugaaguucggcgccaucagaaagaugagagaggacagaugggccgugaucgccaagauggacagaaagaagaagcugaaggaggccgagaagcuguucguguga

SEQ ID NO: 3554 - RNA, 2931 nt, Artificial Sequence
  derived and/or modified sequence opt5 from SYCP1__Homo_sapiens__EAW56623
auggagaagcagaaacccuucgcccuguuugugccuccgagaagcuccucuagccaagucuccgcuguuaagccccagacccucggcggggacucuacauucuuuaagagcuucaacaagugcacggaagaugacuuugaguucccuuuugccaaaaccaaucuguccaagaacggagaaaauaucgauucugaccccgcgcuucagaaggugaacuuccugccugugcucgagcaggucggcaauagcgauugucacuaccaagaagggcugaaagacuccgaucuugagaacagcgagggacugucucggguguauuccaagcucuacaaagaagcugagaagauuaaaaaguggaagguuagcacagaagccgagcugcgccagaaagagucuaagcugcaggaaaauagaaaaaucauugaggcccagcggaaggcuauccaagaacuccaguuuggcaacgagaaagugucccugaaacuugaagaggggauucaggagaauaaagaccugaucaaggaaaacaaugccacccgccaucucugcaaccugcuuaaggagacaugugcuagaagcgccgaaaagaccaagaaauaugaguacgaacgggaggagacacgccaggucuauauggaucugaauaacaauaucgaaaagaugauuaccgcguucgaggaacucagagugcaagccgagaacucucggcuggaaaugcacuuuaaacugaaggaggacuacgagaagauccagcaucucgaacaggaguauaaaaaggaaauuaacgauaaagagaagcaaguuucccugcuucugauccagauuacggagaaagaaaauaagaugaaggaccucaccuuccugcuugaggaaagccgcgauaaagugaaccagcuggaggaaaagacaaaacuccaguccgagaaucugaagcaaucuaucgagaaacagcaccaucugaccaaggaacucgaggacauuaaggucagccugcagagauccgugagcacacagaaagcucuugaagaggaccugcaaaucgccaccaagacgaucugccagcucacagaagagaaagagacccagauggaagagucuaacaaggcucgggccgcgcacuccuuuguggucacagaguucgaaaccaccguuuguagccuggaggaacuucugcgcacagagcagcaaagacucgaaaagaaugaggaucagcugaagauucugacgauggaacuccagaaaaagucuagcgagcuggaggaaaugaccaaacuuacaaacaauaaagagguggaacuggaggaacucaagaaagugcugggagagaaggagacccugcuuuacgaaaacaaacaguucgagaagaucgccgaggaacucaagggcacagaacaagagcugauuggccugcuccaggcucgggagaaagaaguccacgaccuggagauccagcuuaccgccauuacgacauccgaacaauacuauucuaaggaggugaaagaucugaagaccgaacucgagaaugagaaacugaagaacaccgaacugacaagccauugcaauaaacuuucccucgagaacaaagaacugacccaggagacaagcgacaugacgcuggagcucaagaaucagcaggaagauaucaacaauaacaaaaagcaagaggaacgcaugcugaaacagaucgagaaccuucaggaaaccgagacacagcugagaaaugagcucgaauacguucgggaggaacugaagcaaaagagagacgaggugaaauguaagcuggauaaaucugaagagaacugcaauaaccuucgcaagcaggucgagaauaaaaacaaguauauugaggaacuccagcaggaaaauaaagcucugaagaagaaagggaccgccgaguccaagcaacugaacguguacgaaaucaaaguuaauaagcucgagcuggagcuugaaagcgccaaacagaaguuuggagagauuacagacaccuaucagaaggaaaucgaggauaaaaagauuucugaggaaaaccugcucgaggaaguggagaaagcuaaggucaucgcggacgaagccgugaaacugcaaaaggagaucgauaagcggugucagcacaaaauugcugagauggucgcccugauggaaaagcauaaacaccaguacgacaagaucauugaggaaagagacuccgagcuuggccucuauaaaagcaaggaacaggagcaauccucucugcgcgccagccuggagaucgaacucuccaaucugaaggcugagcuucugucugugaaaaagcagcucgaaauugagcgggaagagaaagagaagcugaaaagagaagccaaggagaacacggcgacccugaaggaaaagaaggauaaaaagacacagaccuuccuucuggagacacccgagaucuacuggaaacucgacagcaaggcuguuccuucccagaccgugagccgcaauuuuacgucugucgaucacgggauuuccaaagacaagcgggauuaccuguggacaagcgccaagaacacccucucuacaccgcugcccaaagccuauaccgugaagaccccuacaaaacccaaacuucaacagagagaaaaucugaacaucccuaucgaggaauccaaaaagaagcgcaaaauggcuuucgaguuugacauuaacagcgauucuagcgaaacgaccgaccuccuguccaugguuagcgaggaggaaacacugaagacccuuuaccggaauaacaaucccccggccucucaucugugcgugaaaacaccuaagaaagcucccuccagccucaccacgccuggauccacacugaaguucggcgccaucagaaagaugcgcgaggaucggugggcggucauugccaaaauggacagaaagaaaaagcucaaagaagcugagaagcuguuuguguga

SEQ ID NO: 3555 - protein, 976 aa, Artificial Sequence [sequence omitted]

SEQ ID NO: 3556 - RNA, 2931 nt, Artificial Sequence
  SYCP1__Homo_sapiens__AAI44020
auggaaaagcaaaagcccuuugcauuguucguaccaccgagaucaagcagcagucaggugucugcggugaaaccucagacccugggaggcgauuccacuuucuucaagaguuucaacaaauguacugaagaugauuuugaguuuccauuugcaaagacuaaucucuccaaaaauggggaaaacauugauucagauccugcuuuacaaaaaguuaauuucuugcccguguuugagcagguugguaauucugacugucacuaucaggaaggacuaaaagacucugauuuggagaauucagagggauugagcagaguguauucaaaacuguauaaggaggcugaaaagauaaaaaaauggaaaguaaguacagaagcugaacugagacagaaagaaaguaaguugcaagaaaacagaaagauaauugaagcacagcgaaaagccauucaggaacugcaauuuggaaaugaaaaaguaaguuugaaauuagaagaaggaauacaagaaaauaaagauuuaauaaaagagaauaaugccacaaggcauuuauguaaucuacucaaagaaaccugugcuagaucugcagaaaagacaaagaaauaugaauaugaacgggaagaaaccaggcaaguuuauauggaucuaaauaguaacauugagaaaaugauaacagcuuuugaggaacuucgugugcaagcugagaauuccagacuggaaaugcauuuuaaguuaaaggaagauuaugaaaaaauccaacaccuugaacaagaauacaagaaggaaauaaaugacaaggaaaagcagguaucacuacuauugauccaaaucacugagaaagaaaauaaaaugaaagauuuaacauuucugcuagaggaauccagagauaaaguuaaucaauuagaggaaaagacaaaauuacagagugaaaacuuaaaacaaucaauugagaaacagcaucauuugacuaaagaacuagaagauauuaaagugucauuacaaagaagugugaguacucaaaaggcuuuagaggaagauuuacagauagcaacaaaaacaauuugucagcuaacugaagaaaaagaaacucaaauggaagaaucuaauaaagcuagagcugcucauucguuugugguuacugaauuugaaacuacugucugcagcuuggaagaauuauugagaacagaacagcaaagauuggaaaaaaaugaagaucaauugaaaauacuuaccauggagcuucaaaagaaaucaagugagcuggaagagaugacuaagcuuacaaauaacaaagaaguagaacuugaagaauugaaaaaagucuugggagaaaaggaaacacuuuuauaugaaaauaaacaauuugagaagauugcugaagaauuaaaaggaacagaacaagaacuaauuggucuucuccaagccagagagaaagaaguacaugauuuggaaauacaguuaacugccauuaccacaagugaacaguauuauucaaaagagguuaaagaucuaaaaacugagcuugaaaacgagaagcuuaagaauacugaauuaacuucacacugcaacaagcuuucacuagaaaacaaagagcucacacaggaaacaagugauaugacccuagaacucaagaaucagcaagaagauauuaauaauaacaaaaagcaagaagaaaggauguugaaacaaauagaaaaucuucaagaaacagaaacccaauuaagaaaugaacuagaauaugugagagaagagcuaaaacagaaaagagaugaaguuaaauguaaauuggacaagagugaagaaaauuguaacaauuuaaggaaacaaguugaaaauaaaaacaaguauauugaagaacuucagcaggagaauaaggccuugaaaaaaaaagguacagcagaaagcaagcaacugaauguuuaugagauaaaggucaauaaauuagaguuagaacuagaaagugccaaacagaaauuuggagaaaucacagacaccuaucagaaagaaauugaggacaaaaagauaucagaagaaaaucuuuuggaagagguugagaaagcaaaaguaauagcugaugaagcaguaaaauuacagaaagaaauugauaagcgaugucaacauaaaauagcugaaaugguagcacuuauggaaaaacauaagcaccaauaugauaagaucauugaagaaagagacucagaauuaggacuuuauaagagcaaagaacaagaacagucaucacugagagcaucuuuggagauugaacuauccaaucucaaagcugaacuuuugucuguuaagaagcaacuugaaauagaaagagaagagaaggaaaaacucaaaagagaggcaaaagaaaacacagcuacucuuaaagaaaaaaaagacaagaaaacacaaacauuuuuauuggaaacaccugaaauuuauuggaaauuggauucuaaagcaguuccuucacaaacuguaucucgaaauuucacaucaguugaucauggcauauccaaagauaaaagagacuaucuguggacaucugccaaaaauacuuuaucuacaccauugccaaaggcauauacagugaagacaccaacaaaaccaaaacuacagcaaagagaaaacuugaauauacccauugaagaaaguaaaaaaaagagaaaaauggccuuugaauuugauauuaauucagauaguucagaaacuacugaucuuuugagcaugguuucagaagaagagacauugaaaacacuguauaggaacaauaauccaccagcuucucaucuuugugucaaaacaccaaaaaaggccccuucaucucuaacaaccccuggaucuacacugaaguuuggagcuauaagaaaaaugcgggaggaccguugggcuguaauugcuaaaauggauagaaaaaaaaaacuaaaagaagcugaaaaguuauuuguuuaa

SEQ ID NO: 3557 - RNA, 2931 nt, Artificial Sequence
  derived and/or modified sequence opt1 from SYCP1__Homo_sapiens__AAI44020
auggagaagcagaagcccuucgcccuguucgugccgccccgcagcuccagcucccaggucagcgccgugaagccccagacccucggcggggacuccaccuucuucaagagcuucaacaagugcacggaggacgacuucgaguuccccuucgcgaagaccaaccuguccaagaacggcgagaacaucgacagcgacccggcccugcagaaggugaacuuccuccccgucuucgagcaggucgggaacuccgacugccacuaccaggagggccugaaggacagcgaccuggagaacuccgaggggcucagccggguguacuccaagcuguacaaggaggccgagaagaucaagaaguggaaggugagcaccgaggccgagcugcgccagaaggaguccaagcuccaggagaaccggaagaucaucgaggcccagcgcaaggcgauccaggagcugcaguucggcaacgagaaggugagccugaagcucgaggagggcauccaggagaacaaggaccugaucaaggagaacaacgccacccggcaccugugcaaccuccugaaggagacgugcgcccgcuccgccgagaagaccaagaaguacgaguacgagcgggaggagacccgccagguguacauggaccugaacagcaacaucgagaagaugaucaccgcguucgaggagcuccggguccaggccgagaacucccgccuggagaugcacuucaagcugaaggaggacuacgagaagauccagcaccucgagcaggaguacaagaaggagaucaacgacaaggagaagcaggucagccugcugcucauccagaucacggagaaggagaacaagaugaaggaccugaccuuccugcucgaggagagccgggacaaggugaaccagcuggaggagaagaccaagcugcaguccgagaaccucaagcagagcaucgagaagcagcaccaccugaccaaggagcuggaggacaucaaggugucccuccagcgcagcguguccacgcagaaggcccuggaggaggaccugcagaucgccaccaagaccaucugccagcucaccgaggagaaggagacgcagauggaggagagcaacaaggcccgggcggcccacuccuucguggucaccgaguucgagaccaccgugugcagccuggaggagcugcuccgcacggagcagcagcggcuggagaagaacgaggaccagcugaagauccucaccauggagcugcagaagaaguccagcgagcuggaggagaugaccaagcucaccaacaacaaggagguggagcuggaggagcugaagaagguccucggggagaaggagacgcugcuguacgagaacaagcaguucgagaagaucgccgaggagcugaagggcaccgagcaggagcucaucgggcugcugcaggcccgcgagaaggaggugcacgaccucgagauccagcugaccgccaucaccacguccgagcaguacuacagcaaggaggugaaggaccugaagaccgagcucgagaacgagaagcugaagaacaccgagcugaccucccacugcaacaagcucagccuggagaacaaggagcugacgcaggagaccuccgacaugacccucgagcugaagaaccagcaggaggacaucaacaacaacaagaagcaggaggagcggaugcugaagcagaucgagaaccuccaggagaccgagacgcagcugcgcaacgagcuggaguacguccgggaggagcucaagcagaagcgcgacgaggugaagugcaagcuggacaagagcgaggagaacugcaacaaccugcggaagcaggucgagaacaagaacaaguacaucgaggagcuccagcaggagaacaaggcgcugaagaagaagggcaccgccgaguccaagcagcugaacguguacgagaucaaggugaacaagcucgagcuggagcuggagagcgccaagcagaaguucggggagaucaccgacaccuaccagaaggagaucgaggacaagaagaucuccgaggagaaccuccuggaggaggucgagaaggccaaggugaucgccgacgaggcggugaagcugcagaaggagaucgacaagcgcugccagcacaagaucgccgagauggucgcccucauggagaagcacaagcaccaguacgacaagaucaucgaggagcgcgacagcgagcugggccuguacaagagcaaggagcaggagcaguccagccuccgggccucccuggagaucgagcugagcaaccucaaggccgagcugcuguccgugaagaagcagcucgagaucgagcgcgaggagaaggagaagcugaagcgggaggcgaaggagaacaccgccacgcugaaggagaagaaggacaagaagacccagaccuuccuccuggagacccccgagaucuacuggaagcuggacagcaaggccgugcccucccagacggucagccgcaacuucaccuccguggaccacggcaucagcaaggacaagcgggacuaccucuggaccuccgccaagaacacccugagcacgccgcugcccaaggcguacaccgugaagacccccaccaagcccaagcuccagcagcgcgagaaccugaacaucccgaucgaggaguccaagaagaagcggaagauggccuucgaguucgacaucaacagcgacuccagcgagacgaccgaccugcucuccauggucagcgaggaggagacccugaagacccuguaccgcaacaacaacccgcccgccagccaccucugcgugaagacgcccaagaaggcccccuccagccugaccacccccggguccacccugaaguucggcgccauccggaagaugcgcgaggaccggugggcggugaucgccaagauggaccgcaagaagaagcucaaggaggccgagaagcuguucgucuga

SEQ ID NO: 3558 - RNA, 2931 nt, Artificial Sequence
  derived and/or modified sequence opt2 from SYCP1__Homo_sapiens__AAI44020
auggagaagcagaagcccuucgcccucuucguccccccccgcuccuccuccucccaggucuccgccgucaagccccagacccucggcggcgacuccaccuucuucaaguccuucaacaagugcaccgaggacgacuucgaguuccccuucgccaagaccaaccucuccaagaacggcgagaacaucgacuccgaccccgcccuccagaaggucaacuuccuccccgucuucgagcaggucggcaacuccgacugccacuaccaggagggccucaaggacuccgaccucgagaacuccgagggccucucccgcgucuacuccaagcucuacaaggaggccgagaagaucaagaaguggaaggucuccaccgaggccgagcuccgccagaaggaguccaagcuccaggagaaccgcaagaucaucgaggcccagcgcaaggccauccaggagcuccaguucggcaacgagaaggucucccucaagcucgaggagggcauccaggagaacaaggaccucaucaaggagaacaacgccacccgccaccucugcaaccuccucaaggagaccugcgcccgcuccgccgagaagaccaagaaguacgaguacgagcgcgaggagacccgccaggucuacauggaccucaacuccaacaucgagaagaugaucaccgccuucgaggagcuccgcguccaggccgagaacucccgccucgagaugcacuucaagcucaaggaggacuacgagaagauccagcaccucgagcaggaguacaagaaggagaucaacgacaaggagaagcaggucucccuccuccucauccagaucaccgagaaggagaacaagaugaaggaccucaccuuccuccucgaggagucccgcgacaaggucaaccagcucgaggagaagaccaagcuccaguccgagaaccucaagcaguccaucgagaagcagcaccaccucaccaaggagcucgaggacaucaaggucucccuccagcgcuccgucuccacccagaaggcccucgaggaggaccuccagaucgccaccaagaccaucugccagcucaccgaggagaaggagacccagauggaggaguccaacaaggcccgcgccgcccacuccuucgucgucaccgaguucgagaccaccgucugcucccucgaggagcuccuccgcaccgagcagcagcgccucgagaagaacgaggaccagcucaagauccucaccauggagcuccagaagaaguccuccgagcucgaggagaugaccaagcucaccaacaacaaggaggucgagcucgaggagcucaagaagguccucggcgagaaggagacccuccucuacgagaacaagcaguucgagaagaucgccgaggagcucaagggcaccgagcaggagcucaucggccuccuccaggcccgcgagaaggagguccacgaccucgagauccagcucaccgccaucaccaccuccgagcaguacuacuccaaggaggucaaggaccucaagaccgagcucgagaacgagaagcucaagaacaccgagcucaccucccacugcaacaagcucucccucgagaacaaggagcucacccaggagaccuccgacaugacccucgagcucaagaaccagcaggaggacaucaacaacaacaagaagcaggaggagcgcaugcucaagcagaucgagaaccuccaggagaccgagacccagcuccgcaacgagcucgaguacguccgcgaggagcucaagcagaagcgcgacgaggucaagugcaagcucgacaaguccgaggagaacugcaacaaccuccgcaagcaggucgagaacaagaacaaguacaucgaggagcuccagcaggagaacaaggcccucaagaagaagggcaccgccgaguccaagcagcucaacgucuacgagaucaaggucaacaagcucgagcucgagcucgaguccgccaagcagaaguucggcgagaucaccgacaccuaccagaaggagaucgaggacaagaagaucuccgaggagaaccuccucgaggaggucgagaaggccaaggucaucgccgacgaggccgucaagcuccagaaggagaucgacaagcgcugccagcacaagaucgccgagauggucgcccucauggagaagcacaagcaccaguacgacaagaucaucgaggagcgcgacuccgagcucggccucuacaaguccaaggagcaggagcaguccucccuccgcgccucccucgagaucgagcucuccaaccucaaggccgagcuccucuccgucaagaagcagcucgagaucgagcgcgaggagaaggagaagcucaagcgcgaggccaaggagaacaccgccacccucaaggagaagaaggacaagaagacccagaccuuccuccucgagacccccgagaucuacuggaagcucgacuccaaggccguccccucccagaccgucucccgcaacuucaccuccgucgaccacggcaucuccaaggacaagcgcgacuaccucuggaccuccgccaagaacacccucuccaccccccuccccaaggccuacaccgucaagacccccaccaagcccaagcuccagcagcgcgagaaccucaacauccccaucgaggaguccaagaagaagcgcaagauggccuucgaguucgacaucaacuccgacuccuccgagaccaccgaccuccucuccauggucuccgaggaggagacccucaagacccucuaccgcaacaacaacccccccgccucccaccucugcgucaagacccccaagaaggcccccuccucccucaccacccccggcuccacccucaaguucggcgccauccgcaagaugcgcgaggaccgcugggccgucaucgccaagauggaccgcaagaagaagcucaaggaggccgagaagcucuucgucuga

SEQ ID NO: 3559 - RNA, 2931 nt, Artificial Sequence
  derived and/or modified sequence opt3 from SYCP1__Homo_sapiens__AAI44020
auggagaagcagaagcccuucgcccuguuugugccuccaagaagcuccucuucacaagucagugcuguuaagccgcagacccucggcggggacagcacauucuuuaaauccuucaacaagugcacugaagaugacuuugaguuccccuuugcaaaaacgaaccuuucuaagaacggagaaaauaucgauucggacccugcccugcagaaggugaacuucuugccaguauuugaacagguggguaauucagauugucacuaccaagaaggcuuaaaagacagcgaucuggagaacagugaggggcuauccagggucuauucuaagcucuacaaagaagcggagaagauuaaaaaguggaaggugagcaccgaagcugagcugcggcagaaagaguccaaacuucaggaaaaucgcaaaauaaucgaggcccagcgaaaggcaauucaagaacugcaguucggaaacgagaaaguuucauugaagcucgaagagggcauccaggagaauaaagaccugauuaaggaaaacaaugccacacgucaucugugcaaccucuuaaaggagacuugugcuagaagugcagaaaagaccaagaaauaugaguacgaaagggaggagacacgccagguguauauggaucugaauagcaacaucgaaaagaugauaaccgccuuugaggaacuucggguccaagcugaaaauucuagauuggaaaugcacuucaaacugaaggaggacuacgagaagauccagcaucuagaacaggaguauaaaaaggaaauuaacgauaaagagaagcaagugucccuccugcuuauccagauuacugagaaagaaaacaagaugaaggaccugacauuuuugcucgaggaaucaagggauaaaguaaaucagcuggaggaaaagaccaaauuacagagcgagaaccugaagcaaaguaucgagaaacagcaccaucucacgaaggaacuugaggacauaaagguuucucugcagcgguccgugagcacucagaaagccuuggaagaggaccuacaaauugcgaccaagacaaucugccagcugacugaagagaaagagacccagauggaagagucgaauaaggcacgcgccgcucacucuuucgucgugacagaguucgagaccacgguguguucccucgaggagcugcuucgaacugagcagcaaagacuggaaaagaacgaggaucaguugaagauucucacaauggaacugcagaaaaagucaagugaguuagaggaaaugaccaagcugacuaauaacaaagaggucgaacuagaggaacucaagaaaguucugggugagaaggagacacuuuuguacgaaaauaaacaguuugagaagaucgccgaggaacugaaggggaccgaacaagagcucaucggacugcuucaggcaagggagaaagaagugcacgaccuggagauucaguugacggcuauaaccacaagcgaacaauacuauuccaaggagguaaaagaucucaagacugaacuggagaacgagaaauuaaagaauaccgaacugacaucucauugcaacaagcuaagccucgagaauaaagaacugacucaggagaccucagacaugacacuugaguugaagaaccagcaggaagauaucaauaacaauaaaaagcaagaggaacggaugcugaaacagauugagaaccuccaggaaaccgagacucagcugcguaacgaguuagaauacgugcgcgaggaacugaagcaaaagagagacgaggucaaauguaaacuugauaaaagugaagagaauugcaacaauuugaggaaacagguggagaacaaaaauaaguauaucgaggaacuccagcaggaaaacaaagcccugaagaagaaaggcacggcggaguccaagcaacuaaauguuuacgaaauaaaagugaacaagcuggagcucgagcuggaaagcgccaaacagaaguucggcgagauuacagacaccuaucagaaggaaaucgaggauaaaaagaucucugaggaaaaucuuuuggaggaagucgagaaagcaaaggugauugcugacgaagccguaaaacugcaaaaggagaucgauaagcggugucagcacaaaauugcugagaugguugccuuaauggaaaagcauaaacaccaguacgacaagauaaucgaggaacgagacucagagcucgggcuguauaaaaguaaggaacaggagcaaagcucccuucgcgcaucucuggagauugaauugucgaaccucaaggccgagcugcuaagcgugaaaaagcagcuggaaaucgagagagaagagaaagagaagcucaaaagggaagcuaaggagaauacugcgacccugaaggaaaagaaggauaaaaagacacagaccuuucuuuuggagacucccgagaucuacuggaaacuggacuccaaggcagucccuucacagacagugagucggaacuucacgucugucgaucacggaauuagcaaagacaagcgcgauuacuuauggaccuccgccaagaauacucucucaacaccacugcccaaggcuuauaccgugaagacaccuacuaaaccaaaacuucaacagagagaaaaccugaauauaccgaucgaggaaagcaaaaagaagaggaaaauggccuuugaguucgacauuaacucugauuccagugaaaccacggaccuacucagcaugguuucugaggaggaaacccugaagacauuguaccguaacaauaaucccccugcaucccaucugugcgugaaaacuccaaagaaagcccccucaaguuuaaccacaccugguagcacucucaaguuuggcgcuauccggaagaugcgagaggauagaugggccguaauugcaaaaauggacaggaagaaaaagcugaaagaagcggagaaacuuuucgucuga

SEQ ID NO: 3560 - RNA, 2931 nt, Artificial Sequence
  derived and/or modified sequence opt4 from SYCP1__Homo_sapiens__AAI44020
auggagaagcagaagcccuucgcccuguucgugccccccagaagcagcagcagccaggugagcgccgugaagccccagacccugggcggcgacagcaccuucuucaagagcuucaacaagugcaccgaggacgacuucgaguuccccuucgccaagaccaaccugagcaagaacggcgagaacaucgacagcgaccccgcccugcagaaggugaacuuccugcccguguucgagcaggugggcaacagcgacugccacuaccaggagggccugaaggacagcgaccuggagaacagcgagggccugagcagaguguacagcaagcuguacaaggaggccgagaagaucaagaaguggaaggugagcaccgaggccgagcugagacagaaggagagcaagcugcaggagaacagaaagaucaucgaggcccagagaaaggccauccaggagcugcaguucggcaacgagaaggugagccugaagcuggaggagggcauccaggagaacaaggaccugaucaaggagaacaacgccaccagacaccugugcaaccugcugaaggagaccugcgccagaagcgccgagaagaccaagaaguacgaguacgagagagaggagaccagacagguguacauggaccugaacagcaacaucgagaagaugaucaccgccuucgaggagcugagagugcaggccgagaacagcagacuggagaugcacuucaagcugaaggaggacuacgagaagauccagcaccuggagcaggaguacaagaaggagaucaacgacaaggagaagcaggugagccugcugcugauccagaucaccgagaaggagaacaagaugaaggaccugaccuuccugcuggaggagagcagagacaaggugaaccagcuggaggagaagaccaagcugcagagcgagaaccugaagcagagcaucgagaagcagcaccaccugaccaaggagcuggaggacaucaaggugagccugcagagaagcgugagcacccagaaggcccuggaggaggaccugcagaucgccaccaagaccaucugccagcugaccgaggagaaggagacccagauggaggagagcaacaaggccagagccgcccacagcuucguggugaccgaguucgagaccaccgugugcagccuggaggagcugcugagaaccgagcagcagagacuggagaagaacgaggaccagcugaagauccugaccauggagcugcagaagaagagcagcgagcuggaggagaugaccaagcugaccaacaacaaggagguggagcuggaggagcugaagaaggugcugggcgagaaggagacccugcuguacgagaacaagcaguucgagaagaucgccgaggagcugaagggcaccgagcaggagcugaucggccugcugcaggccagagagaaggaggugcacgaccuggagauccagcugaccgccaucaccaccagcgagcaguacuacagcaaggaggugaaggaccugaagaccgagcuggagaacgagaagcugaagaacaccgagcugaccagccacugcaacaagcugagccuggagaacaaggagcugacccaggagaccagcgacaugacccuggagcugaagaaccagcaggaggacaucaacaacaacaagaagcaggaggagagaaugcugaagcagaucgagaaccugcaggagaccgagacccagcugagaaacgagcuggaguacgugagagaggagcugaagcagaagagagacgaggugaagugcaagcuggacaagagcgaggagaacugcaacaaccugagaaagcagguggagaacaagaacaaguacaucgaggagcugcagcaggagaacaaggcccugaagaagaagggcaccgccgagagcaagcagcugaacguguacgagaucaaggugaacaagcuggagcuggagcuggagagcgccaagcagaaguucggcgagaucaccgacaccuaccagaaggagaucgaggacaagaagaucagcgaggagaaccugcuggaggagguggagaaggccaaggugaucgccgacgaggccgugaagcugcagaaggagaucgacaagagaugccagcacaagaucgccgagaugguggcccugauggagaagcacaagcaccaguacgacaagaucaucgaggagagagacagcgagcugggccuguacaagagcaaggagcaggagcagagcagccugagagccagccuggagaucgagcugagcaaccugaaggccgagcugcugagcgugaagaagcagcuggagaucgagagagaggagaaggagaagcugaagagagaggccaaggagaacaccgccacccugaaggagaagaaggacaagaagacccagaccuuccugcuggagacccccgagaucuacuggaagcuggacagcaaggccgugcccagccagaccgugagcagaaacuucaccagcguggaccacggcaucagcaaggacaagagagacuaccuguggaccagcgccaagaacacccugagcaccccccugcccaaggccuacaccgugaagacccccaccaagcccaagcugcagcagagagagaaccugaacauccccaucgaggagagcaagaagaagagaaagauggccuucgaguucgacaucaacagcgacagcagcgagaccaccgaccugcugagcauggugagcgaggaggagacccugaagacccuguacagaaacaacaacccccccgccagccaccugugcgugaagacccccaagaaggcccccagcagccugaccacccccggcagcacccugaaguucggcgccaucagaaagaugagagaggacagaugggccgugaucgccaagauggacagaaagaagaagcugaaggaggccgagaagcuguucguguga

SEQ ID NO: 3561 - RNA, 2931 nt, Artificial Sequence
  derived and/or modified sequence opt5 from SYCP1__Homo_sapiens__AAI44020
auggagaagcagaaacccuucgcccuguuugugccuccgagaagcuccucuagccaagucuccgcuguuaagccccagacccucggcggggacucuacauucuuuaagagcuucaacaagugcacggaagaugacuuugaguucccuuuugccaaaaccaaccuguccaagaacggagaaaauaucgauucugaccccgcgcuucagaaggugaacuuccugccuguguuugagcaggucggcaauagcgauugucacuaccaagaagggcucaaagacuccgaucuggagaacagcgagggacuuucucggguguauuccaagcuguacaaagaagcugagaagauuaaaaaguggaagguuagcacagaagccgagcuccgccagaaagagucuaagcugcaggaaaauagaaaaaucauugaggcccagcggaaggcuauccaagaacugcaguucggcaacgagaaagugucccucaagcuggaagaggggauucaggagaauaaagaccuuaucaaggaaaacaaugccacccgccaucugugcaaccuccugaaggagacaugugcuagaagcgccgagaaaaccaagaaauaugaguacgaacgggaggagacacgccaggucuauauggaucuuaauucuaacaucgaaaagaugauuaccgcguuugaggaacugagagugcaagccgaaaauucccggcucgaaaugcacuucaaacugaaggaggacuacgagaagauccagcaucuggaacaggaguauaaaaaggaaauuaacgauaaagagaagcaaguuagccuccugcuuauccagauuacggagaaagaaaacaagaugaaggaccugaccuuucuccuggaggaaucccgcgauaaagugaaucagcuugaggaaaagacaaaacugcagucugagaaccucaagcaaagcaucgagaaacagcaccaucugaccaaggaacuggaggacauuaaggucucccuccagagaagcgugucuacacagaaagcucuggaagaggaccuucaaaucgccaccaagacgaucugccagcugacagaagagaaagagacccagauggaagaguccaauaaggcucgggccgcgcacagcuucguggucacagaguucgaaaccaccguuuguucucucgaggaacugcuucgcacagagcagcaaagacuggagaaaaacgaagaucagcucaagauucugacgauggaacugcagaaaaagagcuccgagcucgaggaaaugaccaagcugacaaauaacaaagagguggaacuugaggaacugaagaaagugcucggagagaaggagacccugcuguacgaaaauaaacaguuugagaagaucgccgaggaacuuaagggcacagaacaagagcucauuggccugcugcaggcucgggagaaagaaguccacgaccucgagauccagcugaccgccauuacgacaucugaacaauacuauagcaaggaggugaaagaucuuaagaccgaacuggagaacgagaaacucaagaauaccgaacugacaucccauugcaacaagcugagccuugagaauaaagaacucacccaggagacaucugacaugacgcuggagcugaagaaccagcaggaagauaucaauaacaauaaaaagcaagaggaacgcaugcucaaacagaucgagaaccugcaggaaaccgagacacagcuuagaaacgagcuggaauacguucgggaggaacucaagcaaaagagagacgaggugaaauguaagcuggauaaauccgaagagaauugcaacaaucugcgcaagcaggucgagaacaaaaauaaguauauugaggaacuucagcaggaaaacaaagcucucaagaagaaagggaccgccgagagcaagcaacugaauguguacgaaaucaaaguuaacaagcuggagcucgagcuggaaucugccaaacagaaguucggagagauuacagacaccuaucagaaggaaaucgaggauaaaaagauuuccgaggaaaaucuucuggaggaaguggagaaagcuaaggucaucgcggacgaagccgugaaacuccaaaaggagaucgauaagcggugucagcacaaaauugcugagauggucgcccugauggaaaagcauaaacaccaguacgacaagaucauugaggaaagagacagcgagcugggccuuuauaaauccaaggaacaggagcaaucuagccuccgcgccucccuggagaucgaacugucuaaccucaaggcugagcugcuuagcgugaaaaagcagcuggaaauugagcgggaagagaaagagaagcucaaaagagaagccaaggagaauacggcgacccugaaggagaaaaaggauaaaaagacacagaccuuucugcuugaaacacccgagaucuacuggaaacuggacuccaaggcuguuccuagccagaccgugucucgcaacuucacguccgucgaucacgggauuagcaaagacaagcgggauuaccucuggacaucugccaagaauacccuguccacaccgcuccccaaagccuauaccgugaagaccccuacaaaacccaagcugcaacagagagaaaaccuuaauaucccuaucgaggaaagcaaaaagaagcgcaaaauggcuuuugaguucgacauuaacucugauagcuccgaaacgaccgaccugcucagcaugguuucugaggaggaaacacugaagacccuguaccggaacaauaaucccccggccucccaucuuugcgugaaaacaccuaagaaagcucccagcucccugaccacgccuggaucuacacucaaguuuggcgccaucagaaagaugcgcgaggaucggugggcggucauugccaaaauggacagaaagaaaaagcugaaagaagcugagaaacucuucguguga

SEQ ID NO: 3562 - protein, 976 aa, Artificial Sequence; identical to SEQ ID NO: 3548
  SYCP1__Homo_sapiens__Q15431

SEQ ID NO: 3563 - RNA, 2931 nt, Artificial Sequence; identical to SEQ ID NO: 3549
  SYCP1__Homo_sapiens__AAI26267

SEQ ID NO: 3564 - RNA, 2931 nt, Artificial Sequence; identical to SEQ ID NO: 3550
  derived and/or modified sequence opt1 from SYCP1__Homo_sapiens__AAI26267

SEQ ID NO: 3565 - RNA, 2931 nt, Artificial Sequence; identical to SEQ ID NO: 3551
  derived and/or modified sequence opt2 from SYCP1__Homo_sapiens__AAI26267

SEQ ID NO: 3566 - RNA, 2931 nt, Artificial Sequence; identical to SEQ ID NO: 3552
  derived and/or modified sequence opt3 from SYCP1__Homo_sapiens__AAI26267

SEQ ID NO: 3567 - RNA, 2931 nt, Artificial Sequence; identical to SEQ ID NO: 3553
  derived and/or modified sequence opt4 from SYCP1__Homo_sapiens__AAI26267

SEQ ID NO: 3568 - RNA, 2931 nt, Artificial Sequence; identical to SEQ ID NO: 3554
  derived and/or modified sequence opt5 from SYCP1__Homo_sapiens__AAI26267

SEQ ID NO: 3569 - protein, 109 aa, Artificial Sequence [sequence omitted]

SEQ ID NO: 3570 - RNA, 330 nt, Artificial Sequence
  SYCP1__Homo_sapiens__AAI05300
auggaaaagcaaaagcccuuugcauuguucguaccaccgagaucaagcagcagucaggugucugcggugaaaccucagacccugggaggcgauuccacuuucuucaagaguuucaacaaauguacugaagaugauuuugaguuuccauuugcaaagacuaaucucuccaaaaauggggaaaacauugauucagauccugcuuuacaaaacguuaauuucuugcccgugcuugagcagguugguaauucugacugucacuaucaggaaggacuaaaagacucugauuuggagaauucagagggauugagcagaguguauucaaaacuguaa

SEQ ID NO: 3571 - RNA, 330 nt, Artificial Sequence
  derived and/or modified sequence opt1 from SYCP1__Homo_sapiens__AAI05300
auggagaagcagaagcccuucgcccuguucgugccgccccgcagcuccagcucccaggugagcgccgugaagccccagacccucggcggggacuccaccuucuucaagagcuucaacaagugcacggaggacgacuucgaguuccccuucgcgaagaccaaccuguccaagaacggcgagaacaucgacagcgacccggcccugcagaacgugaacuuccuccccguccuggagcaggucgggaacuccgacugccacuaccaggagggccugaaggacagcgaccucgagaacuccgaggggcugagccggguguacuccaagcuguga

SEQ ID NO: 3572 - RNA, 330 nt, Artificial Sequence
  derived and/or modified sequence opt2 from SYCP1__Homo_sapiens__AAI05300
auggagaagcagaagcccuucgcccucuucguccccccccgcuccuccuccucccaggucuccgccgucaagccccagacccucggcggcgacuccaccuucuucaaguccuucaacaagugcaccgaggacgacuucgaguuccccuucgccaagaccaaccucuccaagaacggcgagaacaucgacuccgaccccgcccuccagaacgucaacuuccuccccguccucgagcaggucggcaacuccgacugccacuaccaggagggccucaaggacuccgaccucgagaacuccgagggccucucccgcgucuacuccaagcucuga

SEQ ID NO: 3573 - RNA, 330 nt, Artificial Sequence
  derived and/or modified sequence opt3 from SYCP1__Homo_sapiens__AAI05300
auggagaagcagaaacccuucgcccuguuugugccuccaagaagcuccucuucacaagucagugcuguuaagccgcagacccucggcggggacagcacauucuuuaaauccuucaacaagugcacugaagaugacuuugaguuccccuuugcaaaaacgaaucuuucuaagaacggagaaaauaucgauucggacccugcccugcagaacgugaauuucuugccaguauuagaacagguggguaacucagauugucacuaccaagagggccugaaggacagcgaucuagagaauagugaggggcucuccagggucuauucuaaacuguga

SEQ ID NO: 3574 - RNA, 330 nt, Artificial Sequence
  derived and/or modified sequence opt4 from SYCP1__Homo_sapiens__AAI05300
auggagaagcagaagcccuucgcccuguucgugccccccagaagcagcagcagccaggugagcgccgugaagccccagacccugggcggcgacagcaccuucuucaagagcuucaacaagugcaccgaggacgacuucgaguuccccuucgccaagaccaaccugagcaagaacggcgagaacaucgacagcgaccccgcccugcagaacgugaacuuccugcccgugcuggagcaggugggcaacagcgacugccacuaccaggagggccugaaggacagcgaccuggagaacagcgagggccugagcagaguguacagcaagcuguga

SEQ ID NO: 3575 - RNA, 330 nt, Artificial Sequence
  derived and/or modified sequence opt5 from SYCP1__Homo_sapiens__AAI05300
auggagaagcagaaacccuucgcccuguuugugccuccgagaagcuccucuagccaagucuccgcuguuaagccccagacccucggcggggacucuacauucuuuaagagcuucaacaaaugcacggaagaugacuuugaguucccuuuugccaaaaccaaucuguccaagaacggagaaaauaucgauucugaccccgcgcuucagaacgugaauuuccugccugugcucgagcaggucggcaacagcgauugucacuaccaagaagggcugaaggacuccgaucuugagaauagcgagggacugucucggguguauuccaaacucuga

SEQ ID NO: 3576 - protein, 488 aa, Artificial Sequence
  SYT-SSX-1__Homo_sapiens__A4PIV7
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQIMPKKPAEDENDSKGVSEASGPQNDGKQLHPPGKANISEKINKRSGPKRGKHAWTHRLRERKQLVIYEEISDPEEDDE

SEQ ID NO: 3577 - RNA, 1467 nt, Artificial Sequence
  SYT-SSX-1__Homo_sapiens__BAF56181
augucuguggcuuucgcggccccgaggcagcgaggcaagggggagaucacucccgcugcgauucagaagauguuggaugacaauaaccaucuuauucaguguauaauggacucucagaauaaaggaaagaccucagaguguucucaguaucagcagauguugcacacaaacuugguauaccuugcuacaauagcagauucuaaucaaaauaugcagucucuuuuaccagcaccacccacacagaauaugccuauggguccuggagggaugaaucagagcggcccucccccaccuccacgcucucacaacaugccuucagauggaaugguagguggggguccuccugcaccgcacaugcagaaccagaugaacggccagaugccugggccuaaccauaugccuaugcagggaccuggacccaaucaacucaauaugacaaacaguuccaugaauaugccuucaaguagccauggauccaugggagguuacaaccauucugugccaucaucgcagagcaugccaguacagaaucagaugacaaugagucagggacaaccaaugggaaacuauggucccagaccaaauaugaguaugcagccaaaccaagguccaaugaugcaucagcagccuccuucucagcaauacaauaugccacagggaggcggacagcauuaccaaggacagcagccaccuauggggaugaugggucaaguuaaccaaggcaaucauaugaugggucagagacagauuccucccuauagaccuccucaacagggcccaccacagcaguacucaggccaggaagacuauuacggggaccaauacagucaugguggacaagguccuccagaaggcaugaaccagcaauauuacccugauggucauaaugauuacgguuaucagcaaccgucguauccugaacaaggcuacgauaggccuuaugaggauuccucacaacauuacuacgaaggaggaaauucacaguauggccaacagcaagaugcauaccagggaccaccuccacaacagggauauccaccccagcagcagcaguacccagggcagcaagguuacccaggacagcagcagggcuacgguccuucacagggugguccagguccucaguauccuaacuacccacagggacaaggucagcaguauggaggauauagaccaacacagccuggaccaccacagccaccccagcagaggccuuauggauaugaccagaucaugcccaagaagccagcagaggacgaaaaugauucgaagggagugucagaagcaucuggcccacaaaacgaugggaaacaacugcaccccccaggaaaagcaaauauuucugagaagauuaauaagagaucuggacccaaaagggggaaacaugccuggacccacagacugcgugagagaaagcagcuggugauuuaugaagagaucagcgacccugaggaagaugacgaguaa

SEQ ID NO: 3578 - RNA, 1467 nt, Artificial Sequence
  derived and/or modified sequence opt1 from SYT-SSX-1__Homo_sapiens__BAF56181
augagcguggccuucgccgcgccccgccagcggggcaagggggagaucaccccggccgccauccagaagaugcuggacgacaacaaccaccucauccagugcaucauggacucccagaacaagggcaagaccagcgagugcucccaguaccagcagaugcugcacacgaaccuggucuaccucgccaccaucgccgacagcaaccagaacaugcagucccugcugcccgcgccccccacccagaacaugccgauggggcccggcgggaugaaccagagcggcccccccccgcccccccgcucccacaacaugcccagcgacggcaugguggggggcgggccgcccgccccccacaugcagaaccagaugaacggccagaugcccgggccgaaccacaugcccaugcagggccccggccccaaccagcucaacaugaccaacuccagcaugaacaugccguccagcucccacgggagcaugggcggguacaaccacuccgugcccagcucccagagcaugcccguccagaaccagaugacgaugucccagggccagcccaugggcaacuacgggccgcggcccaacaugagcaugcagcccaaccagggccccaugaugcaccagcagccgcccagccagcaguacaacaugccccaggggggcgggcagcacuaccagggccagcagccgcccaugggcaugauggggcaggugaaccagggcaaccacaugauggggcagcgccagaucccccccuaccggccgccccagcagggccccccccagcaguacuccgggcaggaggacuacuacggcgaccaguacagccacggcgggcagggcccgcccgaggggaugaaccagcaguacuaccccgacggccacaacgacuacggguaccagcagcccuccuacccggagcagggcuacgaccgccccuacgaggacagcucccagcacuacuacgagggcgggaacagccaguacggccagcagcaggacgccuaccaggggccccccccgcagcagggcuaccccccccagcagcagcaguaccccggccagcagggguacccgggccagcagcagggguacggccccucccaggggggccccggcccccaguacccgaacuacccccaggggcagggccagcaguacgggggcuaccggcccacccagccggggcccccccagcccccgcagcagcgccccuacggcuacgaccagaucaugcccaagaagcccgccgaggacgagaacgacagcaagggcguguccgaggcgagcgggccgcagaacgacggcaagcagcugcacccccccgggaaggccaacaucuccgagaagaucaacaagcggagcggccccaagcgcgggaagcacgccuggacccaccggcugcgcgagcggaagcagcucgucaucuacgaggagaucuccgacccggaggaggacgacgaguga

SEQ ID NO: 3579 - RNA, 1467 nt, Artificial Sequence
  derived and/or modified sequence opt2 from SYT-SSX-1__Homo_sapiens__BAF56181
auguccgucgccuucgccgccccccgccagcgcggcaagggcgagaucacccccgccgccauccagaagaugcucgacgacaacaaccaccucauccagugcaucauggacucccagaacaagggcaagaccuccgagugcucccaguaccagcagaugcuccacaccaaccucgucuaccucgccaccaucgccgacuccaaccagaacaugcagucccuccuccccgccccccccacccagaacaugcccaugggccccggcggcaugaaccaguccggcccccccccccccccccgcucccacaacaugcccuccgacggcauggucggcggcggcccccccgccccccacaugcagaaccagaugaacggccagaugcccggccccaaccacaugcccaugcagggccccggccccaaccagcucaacaugaccaacuccuccaugaacaugcccuccuccucccacggcuccaugggcggcuacaaccacuccguccccuccucccaguccaugcccguccagaaccagaugaccaugucccagggccagcccaugggcaacuacggcccccgccccaacauguccaugcagcccaaccagggccccaugaugcaccagcagccccccucccagcaguacaacaugccccagggcggcggccagcacuaccagggccagcagccccccaugggcaugaugggccaggucaaccagggcaaccacaugaugggccagcgccagaucccccccuaccgccccccccagcagggccccccccagcaguacuccggccaggaggacuacuacggcgaccaguacucccacggcggccagggcccccccgagggcaugaaccagcaguacuaccccgacggccacaacgacuacggcuaccagcagcccuccuaccccgagcagggcuacgaccgccccuacgaggacuccucccagcacuacuacgagggcggcaacucccaguacggccagcagcaggacgccuaccagggcccccccccccagcagggcuaccccccccagcagcagcaguaccccggccagcagggcuaccccggccagcagcagggcuacggccccucccagggcggccccggcccccaguaccccaacuacccccagggccagggccagcaguacggcggcuaccgccccacccagcccggccccccccagcccccccagcagcgccccuacggcuacgaccagaucaugcccaagaagcccgccgaggacgagaacgacuccaagggcgucuccgaggccuccggcccccagaacgacggcaagcagcuccacccccccggcaaggccaacaucuccgagaagaucaacaagcgcuccggccccaagcgcggcaagcacgccuggacccaccgccuccgcgagcgcaagcagcucgucaucuacgaggagaucuccgaccccgaggaggacgacgaguga

SEQ ID NO: 3580 - RNA, 1467 nt, Artificial Sequence
  derived and/or modified sequence opt3 from SYT-SSX-1__Homo_sapiens__BAF56181
augagcguggccuucgcugcacccagacagaggggcaagggggagaucaccccugccgcgauucagaaaaugcuggacgauaacaaucaccucauacaaugcaucauggacucccagaacaagggaaaaacaucugaauguucacaguaccaacagaugcuucauacuaaucuggucuauuuggcuacgauugccgauaguaaccagaauaugcagagcuuacugccagcaccgcccacccaaaacaugccuauggguccaggcgggaugaaucaguccggacccccuccacccccucggucucacaacaugccaucggacggcaugguuggugggggaccgcccgccccucauaugcagaaucagaugaacggccaaaugccaggccccaaucacaugccuaugcaggggccaggacccaaccagcuaaauaugacaaacucaagcaugaauaugccgaguuccucucaugguagcaugggcggguacaaccacuccgugccuucaagucaaagcaugcccguacagaaccagaugacuaugucucagggacaaccaaugggcaauuaugguccucgccccaacauguccaugcagccaaaucaggggcccaugaugcaccagcaaccuccaucacagcaguacaacaugccgcagggaggcggccaacauuaucaggggcagcagcccccuaugggaaugaugggucaagugaaucagggcaaccacaugauggggcagcgacaaaucccacccuaccguccuccacagcagggacccccgcagcaauauagcggccaggaggauuacuacggugaccaguauagucaugggggccagggaccuccagaaggcaugaaucaacaguacuaucccgaugggcacaacgacuacggauaucagcagccuucuuaccccgagcaagguuaugauagaccauacgaagacuccagccagcacuacuaugagggcggaaauucgcaguacgggcaacagcaggaugcuuaucagggcccucccccacaacaggguuacccgccucagcagcaacaguaucccgggcagcagggcuacccaggacaacagcagggcuaugggcccucucagggagguccuggcccacaauaccccaacuacccucaggggcagggacaacaguauggcgguuacaggccgacccagccagggcccccucagccaccccaacagcggccuuauggcuacgaccagauuaugccgaagaaacccgcagaggaugaaaaugacuccaagggagucucagaggccaguggcccacagaacgacgggaagcaacuccauccucccggaaaagcuaauaucagcgaaaagauaaacaaacgcuccggcccaaagagagguaaacacgccuggacacauaggcugcgggagcgcaagcagcuugugaucuaugaggaaauuucugauccugaggaagacgaugaguga

SEQ ID NO: 3581 - RNA, 1467 nt, Artificial Sequence
  derived and/or modified sequence opt4 from SYT-SSX-1__Homo_sapiens__BAF56181
augagcguggccuucgccgcccccagacagagaggcaagggcgagaucacccccgccgccauccagaagaugcuggacgacaacaaccaccugauccagugcaucauggacagccagaacaagggcaagaccagcgagugcagccaguaccagcagaugcugcacaccaaccugguguaccuggccaccaucgccgacagcaaccagaacaugcagagccugcugcccgccccccccacccagaacaugcccaugggccccggcggcaugaaccagagcggccccccccccccccccagaagccacaacaugcccagcgacggcauggugggcggcggcccccccgccccccacaugcagaaccagaugaacggccagaugcccggccccaaccacaugcccaugcagggccccggccccaaccagcugaacaugaccaacagcagcaugaacaugcccagcagcagccacggcagcaugggcggcuacaaccacagcgugcccagcagccagagcaugcccgugcagaaccagaugaccaugagccagggccagcccaugggcaacuacggccccagacccaacaugagcaugcagcccaaccagggccccaugaugcaccagcagccccccagccagcaguacaacaugccccagggcggcggccagcacuaccagggccagcagccccccaugggcaugaugggccaggugaaccagggcaaccacaugaugggccagagacagaucccccccuacagacccccccagcagggccccccccagcaguacagcggccaggaggacuacuacggcgaccaguacagccacggcggccagggcccccccgagggcaugaaccagcaguacuaccccgacggccacaacgacuacggcuaccagcagcccagcuaccccgagcagggcuacgacagacccuacgaggacagcagccagcacuacuacgagggcggcaacagccaguacggccagcagcaggacgccuaccagggcccccccccccagcagggcuaccccccccagcagcagcaguaccccggccagcagggcuaccccggccagcagcagggcuacggccccagccagggcggccccggcccccaguaccccaacuacccccagggccagggccagcaguacggcggcuacagacccacccagcccggccccccccagcccccccagcagagacccuacggcuacgaccagaucaugcccaagaagcccgccgaggacgagaacgacagcaagggcgugagcgaggccagcggcccccagaacgacggcaagcagcugcacccccccggcaaggccaacaucagcgagaagaucaacaagagaagcggccccaagagaggcaagcacgccuggacccacagacugagagagagaaagcagcuggugaucuacgaggagaucagcgaccccgaggaggacgacgaguga

SEQ ID NO: 3582 - RNA, 1467 nt, Artificial Sequence
  derived and/or modified sequence opt5 from SYT-SSX-1__Homo_sapiens__BAF56181
augagcguggccuucgcugcccccagacagcggggcaagggggagaucaccccugcggcuauucagaaaaugcuggacgauaacaaucaccucauccaaugcauuauggacucccagaacaagggaaaaacaucugaauguagccaguaccaacagaugcugcauacgaaucuugucuaucuggccaccaucgccgauuccaaccagaauaugcagucucuccugccggcucccccuacacaaaacaugcccaugggcccugggggaaugaaucagagcgggcccccuccgcccccucgcucccacaacaugcccucugacgggaugguuggaggcggcccucccgccccgcauaugcagaaucagaugaacgggcaaaugccuggacccaaucacaugccuaugcagggccccgggcccaaccagcuuaauaugaccaacagcuccaugaauaugccuucuagcucccauggaagcaugggcggguacaaccacucugugccguccagccaaucuaugcccgugcagaaccagaugacaaugucccagggacaaccuaugggcaauuauggccccagaccuaacaugagcaugcagcccaaucaggggccgaugaugcaccagcaaccucccucccagcaguacaacaugccucagggaggcgggcaacauuaucagggacagcagcccccuaugggcaugauggggcaagucaaucagggaaaccacaugaugggccagcggcaaauucccccguaccgcccuccccagcaggggcccccucagcaauauucuggccaggaggauuacuacggagaccaguauagccauggcgggcagggaccgcccgaaggcaugaaucaacaguacuauccugaugggcacaacgacuacggcuaucagcagcccuccuacccugagcaaggauaugauagacccuacgaagacagcucucagcacuacuaugagggcggcaauucccaguacggacaacagcaggaugcuuaucagggcccucccccgcaacagggguacccuccccagcagcaacaguauccuggacagcagggcuaccccgggcaacagcagggcuauggaccgagccagggcgggccuggaccccaauacccuaacuacccccagggccaggggcaacaguauggaggcuaccggcccacccagccugggccgccccagccuccccaacagcgcccuuauggcuacgaccagaucaugcccaagaaaccugccgaggaugaaaaugacucuaagggagugagcgaggcguccggcccgcagaacgacgggaagcaacugcaucccccuggaaaagccaauaucucugaaaagauuaacaaaagaagcggccccaagcgggggaaacacgcuuggacacaucgccucagagagcggaagcagcugguuaucuaugaggaaauuuccgauccugaggaagacgaugaguga

SEQ ID NO: 3583 - protein, 457 aa, Artificial Sequence
  SYT-SSX-1__Homo_sapiens__A4PIV8
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQIMPKKPAEDENDSKGVSEASGPQNDGKQLHPPGKANISEKINKRSGPKRGKHAWTHRLRERKQLVIYEEISDPEEDDE

SEQ ID NO: 3584 - RNA, 1374 nt, Artificial Sequence
  SYT-SSX-1__Homo_sapiens__BAF56182
augucuguggcuuucgcggccccgaggcagcgaggcaagggggagaucacucccgcugcgauucagaagauguuggaugacaauaaccaucuuauucaguguauaauggacucucagaauaaaggaaagaccucagaguguucucaguaucagcagauguugcacacaaacuugguauaccuugcuacaauagcagauucuaaucaaaauaugcagucucuuuuaccagcaccacccacacagaauaugccuauggguccuggagggaugaaucagagcggcccucccccaccuccacgcucucacaacaugccuucagauggaaugguagguggggguccuccugcaccgcacaugcagaaccagaugaacggccagaugccugggccuaaccauaugccuaugcagggaccuggacccaaucaacucaauaugacaaacaguuccaugaauaugccuucaaguagccauggauccaugggagguuacaaccauucugugccaucaucgcagagcaugccaguacagaaucagaugacaaugagucagggacaaccaaugggaaacuauggucccagaccaaauaugaguaugcagccaaaccaagguccaaugaugcaucagcagccuccuucucagcaauacaauaugccacagggaggcggacagcauuaccaaggacagcagccaccuauggggaugaugggucaaguuaaccaaggcaaucauaugaugggucagagacagauuccucccuauagaccuccucaacagggcccaccacagcaguacucaggccaggaagacuauuacggggaccaauacagucaugguggacaagguccuccagaaggcaugaaccagcaauauuacccugauggaaauucacaguauggccaacagcaagaugcauaccagggaccaccuccacaacagggauauccaccccagcagcagcaguacccagggcagcaagguuacccaggacagcagcagggcuacgguccuucacagggugguccagguccucaguauccuaacuacccacagggacaaggucagcaguauggaggauauagaccaacacagccuggaccaccacagccaccccagcagaggccuuauggauaugaccagaucaugcccaagaagccagcagaggacgaaaaugauucgaagggagugucagaagcaucuggcccacaaaacgaugggaaacaacugcaccccccaggaaaagcaaauauuucugagaagauuaauaagagaucuggacccaaaagggggaaacaugccuggacccacagacugcgugagagaaagcagcuggugauuuaugaagagaucagcgacccugaggaagaugacgaguaa

SEQ ID NO: 3585 - RNA, 1374 nt, Artificial Sequence
  derived and/or modified sequence opt1 from SYT-SSX-1__Homo_sapiens__BAF56182
augagcguggccuucgccgcgccccgccagcggggcaagggggagaucaccccggccgccauccagaagaugcuggacgacaacaaccaccucauccagugcaucauggacucccagaacaagggcaagaccagcgagugcucccaguaccagcagaugcugcacacgaaccuggucuaccucgccaccaucgccgacagcaaccagaacaugcagucccugcugcccgcgccccccacccagaacaugccgauggggcccggcgggaugaaccagagcggcccccccccgcccccccgcucccacaacaugcccagcgacggcaugguggggggcgggccgcccgccccccacaugcagaaccagaugaacggccagaugcccgggccgaaccacaugcccaugcagggccccggccccaaccagcucaacaugaccaacuccagcaugaacaugccguccagcucccacgggagcaugggcggguacaaccacuccgugcccagcucccagagcaugcccguccagaaccagaugacgaugucccagggccagcccaugggcaacuacgggccgcggcccaacaugagcaugcagcccaaccagggccccaugaugcaccagcagccgcccagccagcaguacaacaugccccaggggggcgggcagcacuaccagggccagcagccgcccaugggcaugauggggcaggugaaccagggcaaccacaugauggggcagcgccagaucccccccuaccggccgccccagcagggccccccccagcaguacuccgggcaggaggacuacuacggcgaccaguacagccacggcgggcagggcccgcccgaggggaugaaccagcaguacuaccccgacggcaacucccaguacgggcagcagcaggacgccuaccagggccccccgccccagcagggcuaccccccccagcagcagcaguacccggggcagcagggcuaccccgggcagcagcagggcuacggccccagccaggggggccccgggccgcaguaccccaacuacccccagggccaggggcagcaguacggcggcuaccgccccacccagccggggcccccccagccgccccagcagcggcccuacggcuacgaccagaucaugcccaagaagccggccgaggacgagaacgacuccaagggggugagcgaggcguccggcccccagaacgacgggaagcagcugcacccccccggcaaggccaacaucagcgagaagaucaacaagcgcuccggcccgaagcgggggaagcacgccuggacccaccgccugcgggagcgcaagcagcucgucaucuacgaggagaucagcgaccccgaggaggacgacgaguga

SEQ ID NO: 3586 - RNA, 1374 nt, Artificial Sequence
  derived and/or modified sequence opt2 from SYT-SSX-1__Homo_sapiens__BAF56182
auguccgucgccuucgccgccccccgccagcgcggcaagggcgagaucacccccgccgccauccagaagaugcucgacgacaacaaccaccucauccagugcaucauggacucccagaacaagggcaagaccuccgagugcucccaguaccagcagaugcuccacaccaaccucgucuaccucgccaccaucgccgacuccaaccagaacaugcagucccuccuccccgccccccccacccagaacaugcccaugggccccggcggcaugaaccaguccggcccccccccccccccccgcucccacaacaugcccuccgacggcauggucggcggcggcccccccgccccccacaugcagaaccagaugaacggccagaugcccggccccaaccacaugcccaugcagggccccggccccaaccagcucaacaugaccaacuccuccaugaacaugcccuccuccucccacggcuccaugggcggcuacaaccacuccguccccuccucccaguccaugcccguccagaaccagaugaccaugucccagggccagcccaugggcaacuacggcccccgccccaacauguccaugcagcccaaccagggccccaugaugcaccagcagccccccucccagcaguacaacaugccccagggcggcggccagcacuaccagggccagcagccccccaugggcaugaugggccaggucaaccagggcaaccacaugaugggccagcgccagaucccccccuaccgccccccccagcagggccccccccagcaguacuccggccaggaggacuacuacggcgaccaguacucccacggcggccagggcccccccgagggcaugaaccagcaguacuaccccgacggcaacucccaguacggccagcagcaggacgccuaccagggcccccccccccagcagggcuaccccccccagcagcagcaguaccccggccagcagggcuaccccggccagcagcagggcuacggccccucccagggcggccccggcccccaguaccccaacuacccccagggccagggccagcaguacggcggcuaccgccccacccagcccggccccccccagcccccccagcagcgccccuacggcuacgaccagaucaugcccaagaagcccgccgaggacgagaacgacuccaagggcgucuccgaggccuccggcccccagaacgacggcaagcagcuccacccccccggcaaggccaacaucuccgagaagaucaacaagcgcuccggccccaagcgcggcaagcacgccuggacccaccgccuccgcgagcgcaagcagcucgucaucuacgaggagaucuccgaccccgaggaggacgacgaguga

SEQ ID NO: 3587 - RNA, 1374 nt, Artificial Sequence
  derived and/or modified sequence opt3 from SYT-SSX-1__Homo_sapiens__BAF56182
augagcguggccuucgcugcacccagacagaggggcaagggggagaucaccccugccgcgauucagaaaaugcuggacgauaacaaucaccucauacaaugcaucauggacucccagaacaagggaaaaacaucugaauguucacaguaccaacagaugcuucauacuaaucuggucuauuuggcuacgauugccgauaguaaccagaauaugcagagcuuacugccagcaccgcccacccaaaacaugccuauggguccaggcgggaugaaucaguccggacccccuccacccccucggucucacaacaugccaucggacggcaugguuggugggggaccgcccgccccucauaugcagaaucagaugaacggccaaaugccaggccccaaucacaugccuaugcaggggccaggacccaaccagcuaaauaugacaaacucaagcaugaauaugccgaguuccucucaugguagcaugggcggguacaaccacuccgugccuucaagucaaagcaugcccguacagaaccagaugacuaugucucagggacaaccaaugggcaauuaugguccucgccccaacauguccaugcagccaaaucaggggcccaugaugcaccagcaaccuccaucacagcaguacaacaugccgcagggaggcggccaacauuaucaggggcagcagcccccuaugggaaugaugggucaagugaaucagggcaaccacaugauggggcagcgacaaaucccacccuaccguccuccacagcagggacccccgcagcaauauagcggccaggaggauuacuacggugaccaguauagucaugggggccagggaccuccagaaggcaugaaucaacaguacuaucccgaugggaacucucaguacggacagcaacaggacgcuuaucaggguccucccccacaacagggcuacccuccccagcagcaacaguauccagggcagcagggauacccgggccaacagcaggguuacgggccuucccagggcggacccggcccacaauaucccaauuacccucaggggcagggacagcaauaugguggcuacagaccaacccagcccgggccuccgcagccaccccaacagaggccuuauggauacgaucagauuaugccaaagaaacccgcagaggacgaaaacgauagcaagggcgucucggaggccucugguccucagaaugacgggaagcaacuccacccgcccggcaaagcuaacaucuccgagaagauaaauaaacggucaggaccaaagcgcggcaaacacgccuggacacauagacugagggaacggaagcagcuugugaucuaugaggaaauuagugauccugaggaggacgacgaauga

SEQ ID NO: 3588 - RNA, 1374 nt, Artificial Sequence
  derived and/or modified sequence opt4 from SYT-SSX-1__Homo_sapiens__BAF56182
augagcguggccuucgccgcccccagacagagaggcaagggcgagaucacccccgccgccauccagaagaugcuggacgacaacaaccaccugauccagugcaucauggacagccagaacaagggcaagaccagcgagugcagccaguaccagcagaugcugcacaccaaccugguguaccuggccaccaucgccgacagcaaccagaacaugcagagccugcugcccgccccccccacccagaacaugcccaugggccccggcggcaugaaccagagcggccccccccccccccccagaagccacaacaugcccagcgacggcauggugggcggcggcccccccgccccccacaugcagaaccagaugaacggccagaugcccggccccaaccacaugcccaugcagggccccggccccaaccagcugaacaugaccaacagcagcaugaacaugcccagcagcagccacggcagcaugggcggcuacaaccacagcgugcccagcagccagagcaugcccgugcagaaccagaugaccaugagccagggccagcccaugggcaacuacggccccagacccaacaugagcaugcagcccaaccagggccccaugaugcaccagcagccccccagccagcaguacaacaugccccagggcggcggccagcacuaccagggccagcagccccccaugggcaugaugggccaggugaaccagggcaaccacaugaugggccagagacagaucccccccuacagacccccccagcagggccccccccagcaguacagcggccaggaggacuacuacggcgaccaguacagccacggcggccagggcccccccgagggcaugaaccagcaguacuaccccgacggcaacagccaguacggccagcagcaggacgccuaccagggcccccccccccagcagggcuaccccccccagcagcagcaguaccccggccagcagggcuaccccggccagcagcagggcuacggccccagccagggcggccccggcccccaguaccccaacuacccccagggccagggccagcaguacggcggcuacagacccacccagcccggccccccccagcccccccagcagagacccuacggcuacgaccagaucaugcccaagaagcccgccgaggacgagaacgacagcaagggcgugagcgaggccagcggcccccagaacgacggcaagcagcugcacccccccggcaaggccaacaucagcgagaagaucaacaagagaagcggccccaagagaggcaagcacgccuggacccacagacugagagagagaaagcagcuggugaucuacgaggagaucagcgaccccgaggaggacgacgaguga

SEQ ID NO: 3589 - RNA, 1374 nt, Artificial Sequence
  derived and/or modified sequence opt5 from SYT-SSX-1__Homo_sapiens__BAF56182
augagcguggccuucgcugcccccagacagcggggcaagggggagaucaccccugcggcuauucagaaaaugcuggacgauaacaaucaccucauccaaugcauuauggacucccagaacaagggaaaaacaucugaauguagccaguaccaacagaugcugcauacgaaucuugucuaucuggccaccaucgccgauuccaaccagaauaugcagucucuccugccggcucccccuacacaaaacaugcccaugggcccugggggaaugaaucagagcgggcccccuccgcccccucgcucccacaacaugcccucugacggcaugguuggaggcggcccucccgccccgcauaugcagaaucagaugaacgggcaaaugccuggacccaaucacaugccuaugcagggccccgggcccaaccagcuuaauaugaccaacagcuccaugaauaugccuucuagcucccauggaagcaugggcggguacaaccacucugugccguccagccaaucuaugcccgugcagaaccagaugacaaugucccagggacaaccuaugggcaauuauggccccagaccuaacaugagcaugcagcccaaucaggggccgaugaugcaccagcaaccucccucccagcaguacaacaugccucagggaggcgggcaacauuaucagggacagcagcccccuaugggcaugauggggcaagucaaucagggaaaccacaugaugggccagcggcaaauucccccguaccgcccuccccagcaggggcccccucagcaauauucuggccaggaggauuacuacggagaccaguauagccauggcgggcagggaccgcccgaaggcaugaaucaacaguacuauccugaugggaacucccaguacggccagcaacaggacgcuuaucagggacccccuccccaacagggcuacccuccccagcagcaacaguauccggggcagcagggauacccuggccaacagcagggguacggacccagccagggcgggccuggcccccaauauccgaauuacccucagggacagggccagcaauaugggggauacagacccacccagccuggcccuccccagcccccgcaacagcggcccuauggguacgaucagaucaugccuaagaaacccgccgaggacgaaaacgauucuaagggaguguccgaggcgagcggcccucagaaugacgggaagcaacugcaucccccuggcaaagccaacaucucugagaagauuaauaaacgcagcggaccgaagagaggcaaacacgcuuggacacaccggcuccgcgaaagaaagcagcugguuaucuaugaggaaauuuccgaucccgaggaggacgacgaauga

SEQ ID NO: 3590 - protein, 488 aa, Artificial Sequence
  SYT-SSX-2__Homo_sapiens__A4PIV9
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQIMPKKPAEEGNDSEEVPEASGPQNDGKELCPPGKPTTSEKIHERSGPKRGEHAWTHRLRERKQLVIYEEISDPEEDDE

SEQ ID NO: 3591 - RNA, 1467 nt, Artificial Sequence
  SYT-SSX-2__Homo_sapiens__BAF56183
augucuguggcuuucgcggccccgaggcagcgaggcaagggggagaucacucccgcugcgauucagaagauguuggaugacaauaaccaucuuauucaguguauaauggacucucagaauaaaggaaagaccucagaguguucucaguaucagcagauguugcacacaaacuugguauaccuugcuacaauagcagauucuaaucaaaauaugcagucucuuuuaccagcaccacccacacagaauaugccuauggguccuggagggaugaaucagagcggcccucccccaccuccacgcucucacaacaugccuucagauggaaugguagguggggguccuccugcaccgcacaugcagaaccagaugaacggccagaugccugggccuaaccauaugccuaugcagggaccuggacccaaucaacucaauaugacaaacaguuccaugaauaugccuucaaguagccauggauccaugggagguuacaaccauucugugccaucaucgcagagcaugccaguacagaaucagaugacaaugagucagggacaaccaaugggaaacuauggucccagaccaaauaugaguaugcagccaaaccaagguccaaugaugcaucagcagccuccuucucagcaauacaauaugccacagggaggcggacagcauuaccaaggacagcagccaccuauggggaugaugggucaaguuaaccaaggcaaucauaugaugggucagagacagauuccucccuauagaccuccucaacagggcccaccacagcaguacucaggccaggaagacuauuacggggaccaauacagucaugguggacaagguccuccagaaggcaugaaccagcaauauuacccugauggucauaaugauuacgguuaucagcaaccgucguauccugaacaaggcuacgauaggccuuaugaggauuccucacaacauuacuacgaaggaggaaauucacaguauggccaacagcaagaugcauaccagggaccaccuccacaacagggauauccaccccagcagcagcaguacccagggcagcaagguuacccaggacagcagcagggcuacgguccuucacagggugguccagguccucaguauccuaacuacccacagggacaaggucagcaguauggaggauauagaccaacacagccuggaccaccacagccaccccagcagaggccuuauggauaugaccagaucaugcccaagaagccagcagaggaaggaaaugauucggaggaagugccagaagcaucuggcccacaaaaugaugggaaagagcugugccccccgggaaaaccaacuaccucugagaagauucacgagagaucuggacccaaaaggggggaacaugccuggacccacagacugcgugagagaaaacagcuggugauuuaugaagagaucagcgacccugaggaagaugacgaguaa

SEQ ID NO: 3592 - RNA, 1467 nt, Artificial Sequence
  derived and/or modified sequence opt1 from SYT-SSX-2__Homo_sapiens__BAF56183
augagcguggccuucgccgcgccccgccagcggggcaagggggagaucaccccggccgccauccagaagaugcuggacgacaacaaccaccucauccagugcaucauggacucccagaacaagggcaagaccagcgagugcucccaguaccagcagaugcugcacacgaaccuggucuaccucgccaccaucgccgacagcaaccagaacaugcagucccugcugcccgcgccccccacccagaacaugccgauggggcccggcgggaugaaccagagcggcccccccccgcccccccgcucccacaacaugcccagcgacggcaugguggggggcgggccgcccgccccccacaugcagaaccagaugaacggccagaugcccgggccgaaccacaugcccaugcagggccccggccccaaccagcucaacaugaccaacuccagcaugaacaugccguccagcucccacgggagcaugggcggguacaaccacuccgugcccagcucccagagcaugcccguccagaaccagaugacgaugucccagggccagcccaugggcaacuacgggccgcggcccaacaugagcaugcagcccaaccagggccccaugaugcaccagcagccgcccagccagcaguacaacaugccccaggggggcgggcagcacuaccagggccagcagccgcccaugggcaugauggggcaggugaaccagggcaaccacaugauggggcagcgccagaucccccccuaccggccgccccagcagggccccccccagcaguacuccgggcaggaggacuacuacggcgaccaguacagccacggcgggcagggcccgcccgaggggaugaaccagcaguacuaccccgacggccacaacgacuacggguaccagcagcccuccuacccggagcagggcuacgaccgccccuacgaggacagcucccagcacuacuacgagggcgggaacagccaguacggccagcagcaggacgccuaccaggggccccccccgcagcagggcuaccccccccagcagcagcaguaccccggccagcagggguacccgggccagcagcagggguacggccccucccaggggggccccggcccccaguacccgaacuacccccaggggcagggccagcaguacgggggcuaccggcccacccagccggggcccccccagcccccgcagcagcgccccuacggcuacgaccagaucaugcccaagaagcccgccgaggagggcaacgacagcgaggaggugccggaggcguccgggccccagaacgacggcaaggagcugugcccccccgggaagccgaccaccagcgagaagauccacgagcgguccggccccaagcgcggggagcacgccuggacgcaccggcugcgcgagcggaagcagcucgucaucuacgaggagaucagcgaccccgaggaggacgacgaguga

SEQ ID NO: 3593 - RNA, 1467 nt, Artificial Sequence
  derived and/or modified sequence opt2 from SYT-SSX-2__Homo_sapiens__BAF56183
auguccgucgccuucgccgccccccgccagcgcggcaagggcgagaucacccccgccgccauccagaagaugcucgacgacaacaaccaccucauccagugcaucauggacucccagaacaagggcaagaccuccgagugcucccaguaccagcagaugcuccacaccaaccucgucuaccucgccaccaucgccgacuccaaccagaacaugcagucccuccuccccgccccccccacccagaacaugcccaugggccccggcggcaugaaccaguccggcccccccccccccccccgcucccacaacaugcccuccgacggcauggucggcggcggcccccccgccccccacaugcagaaccagaugaacggccagaugcccggccccaaccacaugcccaugcagggccccggccccaaccagcucaacaugaccaacuccuccaugaacaugcccuccuccucccacggcuccaugggcggcuacaaccacuccguccccuccucccaguccaugcccguccagaaccagaugaccaugucccagggccagcccaugggcaacuacggcccccgccccaacauguccaugcagcccaaccagggccccaugaugcaccagcagccccccucccagcaguacaacaugccccagggcggcggccagcacuaccagggccagcagccccccaugggcaugaugggccaggucaaccagggcaaccacaugaugggccagcgccagaucccccccuaccgccccccccagcagggccccccccagcaguacuccggccaggaggacuacuacggcgaccaguacucccacggcggccagggcccccccgagggcaugaaccagcaguacuaccccgacggccacaacgacuacggcuaccagcagcccuccuaccccgagcagggcuacgaccgccccuacgaggacuccucccagcacuacuacgagggcggcaacucccaguacggccagcagcaggacgccuaccagggcccccccccccagcagggcuaccccccccagcagcagcaguaccccggccagcagggcuaccccggccagcagcagggcuacggccccucccagggcggccccggcccccaguaccccaacuacccccagggccagggccagcaguacggcggcuaccgccccacccagcccggccccccccagcccccccagcagcgccccuacggcuacgaccagaucaugcccaagaagcccgccgaggagggcaacgacuccgaggagguccccgaggccuccggcccccagaacgacggcaaggagcucugcccccccggcaagcccaccaccuccgagaagauccacgagcgcuccggccccaagcgcggcgagcacgccuggacccaccgccuccgcgagcgcaagcagcucgucaucuacgaggagaucuccgaccccgaggaggacgacgaguga

SEQ ID NO: 3594 - RNA, 1467 nt, Artificial Sequence
  derived and/or modified sequence opt3 from SYT-SSX-2__Homo_sapiens__BAF56183
augagcguggccuucgcugcacccagacagaggggcaagggggagaucaccccugccgcgauucagaaaaugcuggacgauaacaaucaccucauacaaugcaucauggacucccagaacaagggaaaaacaucugaaugcucacaguaccaacagaugcuucauacuaaucuggucuauuuggcuacgauugccgauaguaaccagaauaugcagagcuuacugccagcaccgcccacccaaaacaugccuauggguccaggcgggaugaaucaguccggacccccuccacccccucggucucacaacaugccaucggacggcaugguuggugggggaccgcccgccccucauaugcagaaucagaugaacggccaaaugccaggccccaaucacaugccuaugcaggggccaggacccaaccagcuaaauaugacaaacucaagcaugaauaugccgaguuccucucaugguagcaugggcggguacaaccacuccgugccuucaagucaaagcaugcccguacagaaccagaugacuaugucucagggacaaccaaugggcaauuaugguccucgccccaacauguccaugcagccaaaucaggggcccaugaugcaccagcaaccuccaucacagcaguacaacaugccgcagggaggcggccaacauuaucaggggcagcagcccccuaugggaaugaugggucaagugaaucagggcaaccacaugauggggcagcgacaaaucccacccuaccguccuccacagcagggacccccgcagcaauauagcggccaggaggauuacuacggugaccaguauagucaugggggccagggaccuccagaaggcaugaaucaacaguacuaucccgaugggcacaacgacuacggauaucagcagccuucuuaccccgagcaagguuaugauagaccauacgaagacuccagccagcacuacuaugagggcggaaauucgcaguacgggcaacagcaggaugcuuaucagggcccucccccacaacaggguuacccgccucagcagcaacaguaucccgggcagcagggcuacccaggacaacagcagggcuaugggcccucucagggagguccuggcccacaauaccccaacuacccucaggggcagggacaacaguauggcgguuacaggccgacccagccagggcccccucagccaccccaacagcggccuuauggcuacgaccagauuaugccgaagaaacccgcagaggaaggaaaugauuccgaggaagucccagaggccucaggcccucagaacgacgggaaggagcucugucccccaggaaagccuacaaccagugagaaaauccaugaacgcagcggccccaagagaggugaacacgcuuggacucauaggcugcgggagcgcaaacaacuugugauauaugaagagaucuccgacccagaggaagaugacgaguga

SEQ ID NO: 3595 - RNA, 1467 nt, Artificial Sequence
  derived and/or modified sequence opt4 from SYT-SSX-2__Homo_sapiens__BAF56183
augagcguggccuucgccgcccccagacagagaggcaagggcgagaucacccccgccgccauccagaagaugcuggacgacaacaaccaccugauccagugcaucauggacagccagaacaagggcaagaccagcgagugcagccaguaccagcagaugcugcacaccaaccugguguaccuggccaccaucgccgacagcaaccagaacaugcagagccugcugcccgccccccccacccagaacaugcccaugggccccggcggcaugaaccagagcggccccccccccccccccagaagccacaacaugcccagcgacggcauggugggcggcggcccccccgccccccacaugcagaaccagaugaacggccagaugcccggccccaaccacaugcccaugcagggccccggccccaaccagcugaacaugaccaacagcagcaugaacaugcccagcagcagccacggcagcaugggcggcuacaaccacagcgugcccagcagccagagcaugcccgugcagaaccagaugaccaugagccagggccagcccaugggcaacuacggccccagacccaacaugagcaugcagcccaaccagggccccaugaugcaccagcagccccccagccagcaguacaacaugccccagggcggcggccagcacuaccagggccagcagccccccaugggcaugaugggccaggugaaccagggcaaccacaugaugggccagagacagaucccccccuacagacccccccagcagggccccccccagcaguacagcggccaggaggacuacuacggcgaccaguacagccacggcggccagggcccccccgagggcaugaaccagcaguacuaccccgacggccacaacgacuacggcuaccagcagcccagcuaccccgagcagggcuacgacagacccuacgaggacagcagccagcacuacuacgagggcggcaacagccaguacggccagcagcaggacgccuaccagggcccccccccccagcagggcuaccccccccagcagcagcaguaccccggccagcagggcuaccccggccagcagcagggcuacggccccagccagggcggccccggcccccaguaccccaacuacccccagggccagggccagcaguacggcggcuacagacccacccagcccggccccccccagcccccccagcagagacccuacggcuacgaccagaucaugcccaagaagcccgccgaggagggcaacgacagcgaggaggugcccgaggccagcggcccccagaacgacggcaaggagcugugcccccccggcaagcccaccaccagcgagaagauccacgagagaagcggccccaagagaggcgagcacgccuggacccacagacugagagagagaaagcagcuggugaucuacgaggagaucagcgaccccgaggaggacgacgaguga

SEQ ID NO: 3596 - RNA, 1467 nt, Artificial Sequence
  derived and/or modified sequence opt5 from SYT-SSX-2__Homo_sapiens__BAF56183
augagcguggccuucgcugcccccagacagcggggcaagggggagaucaccccugcggcuauucagaaaaugcuggacgauaacaaucaccucauccaaugcauuauggacucccagaacaagggaaaaacaucugaauguagccaguaccaacagaugcugcauacgaaucuugucuaucuggccaccaucgccgauuccaaccagaauaugcagucucuccugccggcucccccuacacaaaacaugcccaugggcccugggggaaugaaucagagcgggcccccuccgcccccucgcucccacaacaugcccucugacgggaugguuggaggcggcccucccgccccgcauaugcagaaucagaugaacgggcaaaugccuggacccaaucacaugccuaugcagggccccgggcccaaccagcuuaauaugaccaacagcuccaugaauaugccuucuagcucccauggaagcaugggcggguacaaccacucugugccguccagccaaucuaugcccgugcagaaccagaugacaaugucccagggacaaccuaugggcaauuauggccccagaccuaacaugagcaugcagcccaaucaggggccgaugaugcaccagcaaccucccucccagcaguacaacaugccucagggaggcgggcaacauuaucagggacagcagcccccuaugggcaugauggggcaagucaaucagggaaaccacaugaugggccagcggcaaauucccccguaccgcccuccccagcaggggcccccucagcaauauucugggcaggaggauuacuacggagaccaguauagccauggcgggcagggaccgcccgaaggcaugaaucaacaguacuauccugaugggcacaacgacuacggcuaucagcagcccuccuacccugagcaaggauaugauagacccuacgaagacagcucucagcacuacuaugagggcggcaauucccaguacggacaacagcaggaugcuuaucagggcccucccccgcaacagggguacccuccccagcagcaacaguauccuggacagcagggcuaccccgggcaacagcagggcuauggaccgagccagggcgggccuggaccccaauacccuaacuacccccagggccaggggcaacaguauggaggcuaccggcccacccagccugggccgccccagccuccccaacagcgcccuuauggcuacgaccagaucaugcccaagaaaccugccgaggaaggaaaugauucugaggaagugccggaggcgagcggcccccagaacgacgggaaggagcugugcccucccggaaagccuacaaccuccgagaaaauccaugaaagaucuggccccaagcggggcgaacacgccuggacgcaucgccucagagagcggaaacaacugguuauuuaugaagagaucagcgacccggaggaagaugacgaguga

SEQ ID NO: 3597 - protein, 457 aa, Artificial Sequence
  SYT-SSX-2__Homo_sapiens__A4PIW0
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQIMPKKPAEEGNDSEEVPEASGPQNDGKELCPPGKPTTSEKIHERSGPKRGEHAWTHRLRERKQLVIYEEISDPEEDDE

SEQ ID NO: 3598 - RNA, 1374 nt, Artificial Sequence
  SYT-SSX-2__Homo_sapiens__BAF56184
augucuguggcuuucgcggccccgaggcagcgaggcaagggggagaucacucccgcugcgauucagaagauguuggaugacaauaaccaucuuauucaguguauaauggacucucagaauaaaggaaagaccucagaguguucucaguaucagcagauguugcacacaaacuugguauaccuugcuacaauagcagauucuaaucaaaauaugcagucucuuuuaccagcaccacccacacagaauaugccuauggguccuggagggaugaaucagagcggcccucccccaccuccacgcucucacaacaugccuucagauggaaugguagguggggguccuccugcaccgcacaugcagaaccagaugaacggccagaugccugggccuaaccauaugccuaugcagggaccuggacccaaucaacucaauaugacaaacaguuccaugaauaugccuucaaguagccauggauccaugggagguuacaaccauucugugccaucaucgcagagcaugccaguacagaaucagaugacaaugagucagggacaaccaaugggaaacuauggucccagaccaaauaugaguaugcagccaaaccaagguccaaugaugcaucagcagccuccuucucagcaauacaauaugccacagggaggcggacagcauuaccaaggacagcagccaccuauggggaugaugggucaaguuaaccaaggcaaucauaugaugggucagagacagauuccucccuauagaccuccucaacagggcccaccacagcaguacucaggccaggaagacuauuacggggaccaauacagucaugguggacaagguccuccagaaggcaugaaccagcaauauuacccugauggaaauucacaguauggccaacagcaagaugcauaccagggaccaccuccacaacagggauauccaccccagcagcagcaguacccagggcagcaagguuacccaggacagcagcagggcuacgguccuucacagggugguccagguccucaguauccuaacuacccacagggacaaggucagcaguauggaggauauagaccaacacagccuggaccaccacagccaccccagcagaggccuuauggauaugaccagaucaugcccaagaagccagcagaggaaggaaaugauucggaggaagugccagaagcaucuggcccacaaaaugaugggaaagagcugugccccccgggaaaaccaacuaccucugagaagauucacgagagaucuggacccaaaaggggggaacaugccuggacccacagacugcgugagagaaaacagcuggugauuuaugaagagaucagcgacccugaggaagaugacgaguaa

SEQ ID NO: 3599 - RNA, 1374 nt, Artificial Sequence
  derived and/or modified sequence opt1 from SYT-SSX-2__Homo_sapiens__BAF56184
augagcguggccuucgccgcgccccgccagcggggcaagggggagaucaccccggccgccauccagaagaugcuggacgacaacaaccaccucauccagugcaucauggacucccagaacaagggcaagaccagcgagugcucccaguaccagcagaugcugcacacgaaccuggucuaccucgccaccaucgccgacagcaaccagaacaugcagucccugcugcccgcgccccccacccagaacaugccgauggggcccggcgggaugaaccagagcggcccccccccgcccccccgcucccacaacaugcccagcgacggcaugguggggggcgggccgcccgccccccacaugcagaaccagaugaacggccagaugcccgggccgaaccacaugcccaugcagggccccggccccaaccagcucaacaugaccaacuccagcaugaacaugccguccagcucccacgggagcaugggcggguacaaccacuccgugcccagcucccagagcaugcccguccagaaccagaugacgaugucccagggccagcccaugggcaacuacgggccgcggcccaacaugagcaugcagcccaaccagggccccaugaugcaccagcagccgcccagccagcaguacaacaugccccaggggggcgggcagcacuaccagggccagcagccgcccaugggcaugauggggcaggugaaccagggcaaccacaugauggggcagcgccagaucccccccuaccggccgccccagcagggccccccccagcaguacuccgggcaggaggacuacuacggcgaccaguacagccacggcgggcagggcccgcccgaggggaugaaccagcaguacuaccccgacggcaacucccaguacgggcagcagcaggacgccuaccagggccccccgccccagcagggcuaccccccccagcagcagcaguacccggggcagcagggcuaccccgggcagcagcagggcuacggccccagccaggggggccccgggccgcaguaccccaacuacccccagggccaggggcagcaguacggcggcuaccgccccacccagccggggcccccccagccgccccagcagcggcccuacggcuacgaccagaucaugcccaagaagccggccgaggaggggaacgacuccgaggaggugcccgaggcgagcggcccccagaacgacgggaaggagcugugccccccgggcaagcccaccaccuccgagaagauccacgagcgcagcggccccaagcggggggagcacgccuggacgcaccgccugcgggagcgcaagcagcucgucaucuacgaggagaucuccgaccccgaggaggacgacgaguga

SEQ ID NO: 3600 - RNA, 1374 nt, Artificial Sequence
  derived and/or modified sequence opt2 from SYT-SSX-2__Homo_sapiens__BAF56184
auguccgucgccuucgccgccccccgccagcgcggcaagggcgagaucacccccgccgccauccagaagaugcucgacgacaacaaccaccucauccagugcaucauggacucccagaacaagggcaagaccuccgagugcucccaguaccagcagaugcuccacaccaaccucgucuaccucgccaccaucgccgacuccaaccagaacaugcagucccuccuccccgccccccccacccagaacaugcccaugggccccggcggcaugaaccaguccggcccccccccccccccccgcucccacaacaugcccuccgacggcauggucggcggcggcccccccgccccccacaugcagaaccagaugaacggccagaugcccggccccaaccacaugcccaugcagggccccggccccaaccagcucaacaugaccaacuccuccaugaacaugcccuccuccucccacggcuccaugggcggcuacaaccacuccguccccuccucccaguccaugcccguccagaaccagaugaccaugucccagggccagcccaugggcaacuacggcccccgccccaacauguccaugcagcccaaccagggccccaugaugcaccagcagccccccucccagcaguacaacaugccccagggcggcggccagcacuaccagggccagcagccccccaugggcaugaugggccaggucaaccagggcaaccacaugaugggccagcgccagaucccccccuaccgccccccccagcagggccccccccagcaguacuccggccaggaggacuacuacggcgaccaguacucccacggcggccagggcccccccgagggcaugaaccagcaguacuaccccgacggcaacucccaguacggccagcagcaggacgccuaccagggcccccccccccagcagggcuaccccccccagcagcagcaguaccccggccagcagggcuaccccggccagcagcagggcuacggccccucccagggcggccccggcccccaguaccccaacuacccccagggccagggccagcaguacggcggcuaccgccccacccagcccggccccccccagcccccccagcagcgccccuacggcuacgaccagaucaugcccaagaagcccgccgaggagggcaacgacuccgaggagguccccgaggccuccggcccccagaacgacggcaaggagcucugcccccccggcaagcccaccaccuccgagaagauccacgagcgcuccggccccaagcgcggcgagcacgccuggacccaccgccuccgcgagcgcaagcagcucgucaucuacgaggagaucuccgaccccgaggaggacgacgaguga

SEQ ID NO: 3601 - RNA, 1374 nt, Artificial Sequence
  derived and/or modified sequence opt3 from SYT-SSX-2__Homo_sapiens__BAF56184
augagcguggccuucgcugcacccagacagaggggcaagggggagaucaccccugccgcgauucagaaaaugcuggacgauaacaaucaccucauacaaugcaucauggacucccagaacaagggaaaaacaucugaaugcucacaguaccaacagaugcuucauacuaaucuggucuauuuggcuacgauugccgauaguaaccagaauaugcagagcuuacugccagcaccgcccacccaaaacaugccuauggguccaggcgggaugaaucaguccggacccccuccacccccucggucucacaacaugccaucggacggcaugguuggugggggaccgcccgccccucauaugcagaaucagaugaacggccaaaugccaggccccaaucacaugccuaugcaggggccaggacccaaccagcuaaauaugacaaacucaagcaugaauaugccgaguuccucucaugguagcaugggcggguacaaccacuccgugccuucaagucaaagcaugcccguacagaaccagaugacuaugucucagggacaaccaaugggcaauuaugguccucgccccaacauguccaugcagccaaaucaggggcccaugaugcaccagcaaccuccaucacagcaguacaacaugccgcagggaggcggccaacauuaucaggggcagcagcccccuaugggaaugaugggucaagugaaucagggcaaccacaugauggggcagcgacaaaucccacccuaccguccuccacagcagggacccccgcagcaauauagcggccaggaggauuacuacggugaccaguauagucaugggggccagggaccuccagaaggcaugaaucaacaguacuaucccgaugggaacucucaguacggacagcaacaggacgcuuaucaggguccucccccacaacagggcuacccuccccagcagcaacaguauccagggcagcagggauacccgggccaacagcaggguuacgggccuucccagggcggacccggcccacaauaucccaauuacccucaggggcagggacagcaauaugguggcuacagaccaacccagcccgggccuccgcagccaccccaacagaggccuuauggauacgaucagauuaugccaaagaaacccgcagaggaaggcaacgacagcgaggaggucccugaagccucggguccgcagaaugaugggaaggagcucugucccccaggcaagccuacaaccucugagaaaauccacgaacgguccggacccaagcgcggcgagcacgcuuggacucauagacugagggaacggaaacaacuugugauauaugaggaaaucucagacccagaggaagaugacgaguga

SEQ ID NO: 3602 - RNA, 1374 nt, Artificial Sequence
  derived and/or modified sequence opt4 from SYT-SSX-2__Homo_sapiens__BAF56184
augagcguggccuucgccgcccccagacagagaggcaagggcgagaucacccccgccgccauccagaagaugcuggacgacaacaaccaccugauccagugcaucauggacagccagaacaagggcaagaccagcgagugcagccaguaccagcagaugcugcacaccaaccugguguaccuggccaccaucgccgacagcaaccagaacaugcagagccugcugcccgccccccccacccagaacaugcccaugggccccggcggcaugaaccagagcggccccccccccccccccagaagccacaacaugcccagcgacggcauggugggcggcggcccccccgccccccacaugcagaaccagaugaacggccagaugcccggccccaaccacaugcccaugcagggccccggccccaaccagcugaacaugaccaacagcagcaugaacaugcccagcagcagccacggcagcaugggcggcuacaaccacagcgugcccagcagccagagcaugcccgugcagaaccagaugaccaugagccagggccagcccaugggcaacuacggccccagacccaacaugagcaugcagcccaaccagggccccaugaugcaccagcagccccccagccagcaguacaacaugccccagggcggcggccagcacuaccagggccagcagccccccaugggcaugaugggccaggugaaccagggcaaccacaugaugggccagagacagaucccccccuacagacccccccagcagggccccccccagcaguacagcggccaggaggacuacuacggcgaccaguacagccacggcggccagggcccccccgagggcaugaaccagcaguacuaccccgacggcaacagccaguacggccagcagcaggacgccuaccagggcccccccccccagcagggcuaccccccccagcagcagcaguaccccggccagcagggcuaccccggccagcagcagggcuacggccccagccagggcggccccggcccccaguaccccaacuacccccagggccagggccagcaguacggcggcuacagacccacccagcccggccccccccagcccccccagcagagacccuacggcuacgaccagaucaugcccaagaagcccgccgaggagggcaacgacagcgaggaggugcccgaggccagcggcccccagaacgacggcaaggagcugugcccccccggcaagcccaccaccagcgagaagauccacgagagaagcggccccaagagaggcgagcacgccuggacccacagacugagagagagaaagcagcuggugaucuacgaggagaucagcgaccccgaggaggacgacgaguga

SEQ ID NO: 3603 - RNA, 1374 nt, Artificial Sequence
  derived and/or modified sequence opt5 from SYT-SSX-2__Homo_sapiens__BAF56184
augagcguggccuucgcugcccccagacagcggggcaagggggagaucaccccugcggcuauucagaaaaugcuggacgauaacaaucaccucauccaaugcauuauggacucccagaacaagggaaaaacaucugaauguagccaguaccaacagaugcugcauacgaaucuugucuaucuggccaccaucgccgauuccaaccagaauaugcagucucuccugccggcucccccuacacaaaacaugcccaugggcccugggggaaugaaucagagcgggcccccuccgcccccucgcucccacaacaugcccucugacggcaugguuggaggcggcccucccgccccgcauaugcagaaucagaugaacgggcaaaugccuggacccaaucacaugccuaugcagggccccgggcccaaccagcuuaauaugaccaacagcuccaugaauaugccuucuagcucccauggaagcaugggcggguacaaccacucugugccguccagccaaucuaugcccgugcagaaccagaugacaaugucccagggacaaccuaugggcaauuauggccccagaccuaacaugagcaugcagcccaaucaggggccgaugaugcaccagcaaccucccucccagcaguacaacaugccucagggaggcgggcaacauuaucagggacagcagcccccuaugggcaugauggggcaagucaaucagggaaaccacaugaugggccagcggcaaauucccccguaccgcccuccccagcaggggcccccucagcaauauucuggccaggaggauuacuacggagaccaguauagccauggcgggcagggaccgcccgaaggcaugaaucaacaguacuauccugaugggaacucccaguacggccagcaacaggacgcuuaucagggacccccuccccaacagggcuacccuccccagcagcaacaguauccggggcagcagggauacccuggccaacagcagggguacggacccagccagggcgggccuggcccccaauauccgaauuacccucagggacagggccagcaauaugggggauacagacccacccagccuggcccuccccagcccccgcaacagcggcccuauggguacgaucagaucaugccuaagaaacccgccgaggaaggaaacgacucugaggaggugccugaagcguccggcccccagaaugaugggaaggagcugugcccuccgggcaagcccacaaccagcgagaaaauccacgaacgcucuggaccuaagagaggcgagcacgccuggacgcaucggcuccgcgaaagaaaacaacugguuauuuaugaggaaaucagcgaccccgaggaagaugacgaguga

SEQ ID NO: 3604 - protein, 111 aa, Artificial Sequence
  TARP__Homo_sapiens__Q0VGM3
MKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 3605 - RNA, 336 nt, Artificial Sequence
  TARP__Homo_sapiens__AAI05590
augaagacuaacgacacauacaugaaauuuagcugguuaacggugccagaaaagucacuggacaaagaacacagauguaucgucagacaugagaauaauaaaaacggaguugaucaagaaauuaucuuuccuccaauaaagacagaugucaucacaauggaucccaaagacaauuguucaaaagaugcaaaugauacacuacugcugcagcucacaaacaccucugcauauuacauguaccuccuccugcuccucaagaguguggucuauuuugccaucaucaccugcugucugcuuagaagaacggcuuucugcugcaauggagagaaaucauaa

SEQ ID NO: 3606 - RNA, 336 nt, Artificial Sequence
  derived and/or modified sequence opt1 from TARP__Homo_sapiens__AAI05590
augaagaccaacgacaccuacaugaaguucagcuggcugaccgugcccgagaagucccucgacaaggagcaccgcugcaucguccggcacgagaacaacaagaacggcguggaccaggagaucaucuucccgcccaucaagaccgacgugaucaccauggaccccaaggacaacugcagcaaggacgccaacgacacccugcugcuccagcugacgaacaccuccgccuacuacauguaccugcuccugcugcucaagagcgucguguacuucgcgaucaucacgugcugccugcugcgccggaccgccuucugcugcaacggggagaaguccuga

SEQ ID NO: 3607 - RNA, 336 nt, Artificial Sequence
  derived and/or modified sequence opt2 from TARP__Homo_sapiens__AAI05590
augaagaccaacgacaccuacaugaaguucuccuggcucaccguccccgagaagucccucgacaaggagcaccgcugcaucguccgccacgagaacaacaagaacggcgucgaccaggagaucaucuucccccccaucaagaccgacgucaucaccauggaccccaaggacaacugcuccaaggacgccaacgacacccuccuccuccagcucaccaacaccuccgccuacuacauguaccuccuccuccuccucaaguccgucgucuacuucgccaucaucaccugcugccuccuccgccgcaccgccuucugcugcaacggcgagaaguccuga

SEQ ID NO: 3608 - RNA, 336 nt, Artificial Sequence
  derived and/or modified sequence opt3 from TARP__Homo_sapiens__AAI05590
augaagaccaacgacacauacaugaaauucagcuggcugacugugcccgagaagucccucgauaaagagcacagaugcaucgucaggcaugagaauaacaagaauggcguugaccaggaaauuauauuuccuccaaucaaaacggaugugauuaccauggacccgaaggauaacuguucuaaggacgccaaugauacacuucuguugcaauuaacuaacaccucagcuuauuacauguaucugcuacuccugcuuaaaaguguaguguacuucgcaaucauuacaugcugucuguugcggcgcaccgccuuuugcuguaauggggaaaagagcuga

SEQ ID NO: 3609 - RNA, 336 nt, Artificial Sequence
  derived and/or modified sequence opt4 from TARP__Homo_sapiens__AAI05590
augaagaccaacgacaccuacaugaaguucagcuggcugaccgugcccgagaagagccuggacaaggagcacagaugcaucgugagacacgagaacaacaagaacggcguggaccaggagaucaucuucccccccaucaagaccgacgugaucaccauggaccccaaggacaacugcagcaaggacgccaacgacacccugcugcugcagcugaccaacaccagcgccuacuacauguaccugcugcugcugcugaagagcgugguguacuucgccaucaucaccugcugccugcugagaagaaccgccuucugcugcaacggcgagaagagcuga

SEQ ID NO: 3610 - RNA, 336 nt, Artificial Sequence
  derived and/or modified sequence opt5 from TARP__Homo_sapiens__AAI05590
augaagaccaacgacacauacaugaaauucagcuggcugacggugcccgagaagucccucgauaaagaacacagaugcaucguccggcaugagaauaacaagaauggcguugaccaggaaauuaucuuuccuccgauuaaaaccgaugugaucacaauggaccccaaggauaacuguucuaaggacgccaaugauacccugcuucugcaacucacaaacaccagcgcuuauuacauguaucugcuucugcuccugaaauccguggucuacuucgccauuaucacaugcugucugcuccgcagaaccgcguuuugcuguaauggggagaagucuuga

SEQ ID NO: 3611 - protein, 58 aa, Artificial Sequence
  TCRg__Homo_sapiens__A2JGV3
MQMFPPSPLFFFLQLLKQSSRRLEHTFVFLRNFSLMLLRYIGKKRRATRFWDPRRGTP

SEQ ID NO: 3612 - RNA, 177 nt, Artificial Sequence
  TCRg__Homo_sapiens__AAG29337
augcagauguuucccccaagcccacuauuuuucuuccuucaauugcugaaacaaagcuccagaaggcuggaacauaccuuugucuucuugagaaauuuuucccugauguuauuaagauacauuggcaagaaaagaagagcaacacgauucugggaucccaggaggggaacaccauga

SEQ ID NO: 3613 - RNA, 177 nt, Artificial Sequence
  derived and/or modified sequence opt1 from TCRg__Homo_sapiens__AAG29337
augcagauguucccgcccagcccccuguucuucuuccuccagcugcugaagcaguccagccgccggcucgagcacaccuucguguuccugcgcaacuucucccugaugcuccugcgguacaucggcaagaagcgccgggccacccgcuucugggacccccggcgcgggacgcccuga

SEQ ID NO: 3614 - RNA, 177 nt, Artificial Sequence
  derived and/or modified sequence opt2 from TCRg__Homo_sapiens__AAG29337
augcagauguucccccccuccccccucuucuucuuccuccagcuccucaagcaguccucccgccgccucgagcacaccuucgucuuccuccgcaacuucucccucaugcuccuccgcuacaucggcaagaagcgccgcgccacccgcuucugggacccccgccgcggcacccccuga

SEQ ID NO: 3615 - RNA, 177 nt, Artificial Sequence
  derived and/or modified sequence opt3 from TCRg__Homo_sapiens__AAG29337
augcagauguuucccccuagcccacuguucuucuuucuccaacuucugaagcaguccucuagaagguuggagcacaccuucguguuuuuacggaacuucucacugaugcuacuccgcuacaucggcaaaaagcgacgugccacaagauuuugggacccgaggcgggggacucccuga

SEQ ID NO: 3616 - RNA, 177 nt, Artificial Sequence
  derived and/or modified sequence opt4 from TCRg__Homo_sapiens__AAG29337
augcagauguucccccccagcccccuguucuucuuccugcagcugcugaagcagagcagcagaagacuggagcacaccuucguguuccugagaaacuucagccugaugcugcugagauacaucggcaagaagagaagagccaccagauucugggaccccagaagaggcacccccuga

SEQ ID NO: 3617 - RNA, 177 nt, Artificial Sequence
  derived and/or modified sequence opt5 from TCRg__Homo_sapiens__AAG29337
augcagauguuucccccuagcccgcuguucuucuuucuccaacugcuuaagcaguccucuagacggcuggagcacaccuucguguuucuccgcaacuucagccugaugcuucugagauacaucggcaaaaagcggcgcgccacaagauuuugggacccccggcgcgggacgccuuga

SEQ ID NO: 3618 - protein, 376 aa, Artificial Sequence
  TF2AA__Homo_sapiens__P52655
MANSANTNTVPKLYRSVIEDVINDVRDIFLDDGVDEQVLMELKTLWENKLMQSRAVDGFHSEEQQLLLQVQQQHQPQQQQHHHHHHHQQAQPQQTVPQQAQTQQVLIPASQQATAPQVIVPDSKLIQHMNASNMSAAATAATLALPAGVTPVQQILTNSGQLLQVVRAANGAQYIFQPQQSVVLQQQVIPQMQPGGVQAPVIQQVLAPLPGGISPQTGVIIQPQQILFTGNKTQVIPTTVAAPTPAQAQITATGQQQPQAQPAQTQAPLVLQVDGTGDTSSEEDEDEEEDYDDDEEEDKEKDGAEDGQVEEEPLNSEDDVSDEEGQELFDTENVVVCQYDKIHRSKNKWKFHLKDGIMNLNGRDYIFSKAIGDAEW

SEQ ID NO: 3619 - RNA, 1131 nt, Artificial Sequence
  TF2AA__Homo_sapiens__AAF26776
auggcgaacucggcaaauacaaacaccgugccuaaauuauacagaucugugauugaagaugucauuaaugaugugagagacaucuuucuggaugauggaguggaugaacaaguacugauggaacuaaaaacuuuaugggaaaacaaacuaaugcaguccagggcaguagauggauuucauucagaagagcagcagcuucuacugcaaguucaacagcagcaucaaccccagcagcagcagcaucaccaccaucaccaucaucagcaagcucagccucagcagacaguaccucagcaagcgcagacccagcagguucuuauuccugcaucacagcaagccacagcaccacaaguuauuguuccagauucuaaguugauacagcauaugaaugcaucaaacaugagugcugcugcuacagcugcuaccuuagcacucccugcaggugugacuccuguucagcagauauuaacaaauucaggccagcuucuucagguggucagagcagccaauggugcccaauauaucuuucagccucagcagucagugguucuacaacaacagguuauaccacaaaugcagccugguggaguacaagcuccuguuauacagcaggugcuggcuccucuuccuggagggauuucaccacagacaggugucaucauccagccucagcaaaucuuauuuacaggaaauaagacucaaguuauaccuacgacaguggcagcaccuacaccagcccaagcacagauaacugcaacuggccagcagcaaccgcaggcccagccugcucaaacacaagcuccauuggucuuacaaguugauggaacuggggauacaucaucugaagaagaugaagaugaagaagaagacuaugaugaugaugaggaggaagacaaagagaaagauggagcugaagaugggcagguggaagaagagccccucaauagugaagaugaugugagugaugaggaaggacaggaacucuuugacacagaaaauguuguuguaugccaauaugauaagauacacagaaguaaaaacaaauggaaauuucaucucaaggauggcauuaugaaucuuaauggaagagauuauauauuuuccaaagccauuggagaugcagaaugguga

SEQ ID NO: 3620 - RNA, 1131 nt, Artificial Sequence
  derived and/or modified sequence opt1 from TF2AA__Homo_sapiens__AAF26776
auggccaacagcgccaacaccaacaccgugcccaagcuguaccgcuccgucaucgaggacgugaucaacgacgugcgggacaucuuccucgacgacggcgucgacgagcagguccugauggagcugaagacgcucugggagaacaagcugaugcagagccgcgcgguggacggguuccacuccgaggagcagcagcugcuccuccaggugcagcagcagcaccagccgcagcagcagcagcaccaccaccaccaccaccaccagcaggcccagccccagcagaccgugccccagcaggcccagacccagcagguccugauccccgccagccagcaggccaccgcgccccaggugaucgugccggacuccaagcugauccagcacaugaacgccagcaacauguccgccgccgcgacggccgccacccuggcccugcccgccggcgugacccccguccagcagauccucaccaacagcgggcagcugcuccagguggugcgggcggccaacggcgcccaguacaucuuccagccgcagcaguccgucgugcugcagcagcaggucaucccccagaugcagcccgggggcgugcaggcccccgugauccagcagguccuggccccgcugcccggcgggaucagcccccagacgggcgugaucauccagccccagcagauccucuucaccgggaacaagacccaggugaucccgaccacgguggcggcccccacccccgcccaggcccagaucaccgccaccggccagcagcagccccaggcgcagccggcccagacgcaggcgccccugguccuccagguggacgggaccggcgacaccuccagcgaggaggacgaggacgaggaggaggacuacgacgacgacgaggaggaggacaaggagaaggacggcgccgaggacgggcaggucgaggaggagccccugaacuccgaggacgacgugagcgacgaggagggccaggagcuguucgacaccgagaacguggucgugugccaguacgacaagauccaccgcuccaagaacaaguggaaguuccaccugaaggacgggaucaugaaccucaacggccgggacuacaucuucagcaaggccaucggcgacgccgagugguga

SEQ ID NO: 3621 - RNA, 1131 nt, Artificial Sequence
  derived and/or modified sequence opt2 from TF2AA__Homo_sapiens__AAF26776
auggccaacuccgccaacaccaacaccguccccaagcucuaccgcuccgucaucgaggacgucaucaacgacguccgcgacaucuuccucgacgacggcgucgacgagcagguccucauggagcucaagacccucugggagaacaagcucaugcagucccgcgccgucgacggcuuccacuccgaggagcagcagcuccuccuccagguccagcagcagcaccagccccagcagcagcagcaccaccaccaccaccaccaccagcaggcccagccccagcagaccgucccccagcaggcccagacccagcagguccucauccccgccucccagcaggccaccgccccccaggucaucguccccgacuccaagcucauccagcacaugaacgccuccaacauguccgccgccgccaccgccgccacccucgcccuccccgccggcgucacccccguccagcagauccucaccaacuccggccagcuccuccaggucguccgcgccgccaacggcgcccaguacaucuuccagccccagcaguccgucguccuccagcagcaggucaucccccagaugcagcccggcggcguccaggcccccgucauccagcagguccucgccccccuccccggcggcaucuccccccagaccggcgucaucauccagccccagcagauccucuucaccggcaacaagacccaggucauccccaccaccgucgccgcccccacccccgcccaggcccagaucaccgccaccggccagcagcagccccaggcccagcccgcccagacccaggccccccucguccuccaggucgacggcaccggcgacaccuccuccgaggaggacgaggacgaggaggaggacuacgacgacgacgaggaggaggacaaggagaaggacggcgccgaggacggccaggucgaggaggagccccucaacuccgaggacgacgucuccgacgaggagggccaggagcucuucgacaccgagaacgucgucgucugccaguacgacaagauccaccgcuccaagaacaaguggaaguuccaccucaaggacggcaucaugaaccucaacggccgcgacuacaucuucuccaaggccaucggcgacgccgagugguga

SEQ ID NO: 3622 - RNA, 1131 nt, Artificial Sequence
  derived and/or modified sequence opt3 from TF2AA__Homo_sapiens__AAF26776
auggccaacagcgcuaauaccaacacagugcccaagcuguacagauccgucaucgaggacguuauuaaugaugugagggacauauuccucgaugacggcguagaugaacaggugcuuauggagcugaaaacuuugugggaaaacaaguuaaugcaaucucgggcagucgacggguuucacucagaggaacagcagcugcuacuccaggugcaacagcagcaucagccucaacagcagcagcaccaucaccaucaccaccaucaacaggcccagccacaacagacgguuccgcagcaggcgcaaacccaacaggugcugauccccgcuagucagcaggccacagcaccucaggucauugugccagauagcaaacuuauccagcacaugaaugccuccaacaugucugcugcagccacugcugccacccuggcguugcccgcaggaguaacaccuguucagcaaauucucaccaauucgggucagcugcuccaggugguccgcgccgcuaacggcgcccaguauaucuuccaaccacagcagucaguggugcuccaacagcaggucauaccccagaugcaaccugggggaguucaggcaccagugauccagcagguauuagcuccgcugcccggcgguauuagcccucaaacuggggugaucauucagccacagcagauccuuuuuacaggaaauaagacccaagucauacccacgacuguggccgcgccuaccccagcccaggcacagauuacagcuacuggccaacagcagccccaggcccaaccggcucagacccaggccccuuugguucuacagguggacggcacaggggauaccaguuccgaggaggacgaagaugaggaagaggacuacgaugacgacgaggaagaggauaaagaaaaggacggagcagaggauggucaagucgaagaggagccccugaacucugaagacgaugugagcgacgaggaaggccaggagcuguucgauacggaaaauguaguugugugccaguaugacaagauccaucgauccaaaaacaaguggaaauuucaccugaaggaugggauuaugaaucuuaacggacgugacuacaucuucucaaaagccaucggcgaugcugagugguga

SEQ ID NO: 3623 - RNA, 1131 nt, Artificial Sequence
  derived and/or modified sequence opt4 from TF2AA__Homo_sapiens__AAF26776
auggccaacagcgccaacaccaacaccgugcccaagcuguacagaagcgugaucgaggacgugaucaacgacgugagagacaucuuccuggacgacggcguggacgagcaggugcugauggagcugaagacccugugggagaacaagcugaugcagagcagagccguggacggcuuccacagcgaggagcagcagcugcugcugcaggugcagcagcagcaccagccccagcagcagcagcaccaccaccaccaccaccaccagcaggcccagccccagcagaccgugccccagcaggcccagacccagcaggugcugauccccgccagccagcaggccaccgccccccaggugaucgugcccgacagcaagcugauccagcacaugaacgccagcaacaugagcgccgccgccaccgccgccacccuggcccugcccgccggcgugacccccgugcagcagauccugaccaacagcggccagcugcugcagguggugagagccgccaacggcgcccaguacaucuuccagccccagcagagcguggugcugcagcagcaggugaucccccagaugcagcccggcggcgugcaggcccccgugauccagcaggugcuggccccccugcccggcggcaucagcccccagaccggcgugaucauccagccccagcagauccuguucaccggcaacaagacccaggugauccccaccaccguggccgcccccacccccgcccaggcccagaucaccgccaccggccagcagcagccccaggcccagcccgcccagacccaggccccccuggugcugcagguggacggcaccggcgacaccagcagcgaggaggacgaggacgaggaggaggacuacgacgacgacgaggaggaggacaaggagaaggacggcgccgaggacggccagguggaggaggagccccugaacagcgaggacgacgugagcgacgaggagggccaggagcuguucgacaccgagaacgugguggugugccaguacgacaagauccacagaagcaagaacaaguggaaguuccaccugaaggacggcaucaugaaccugaacggcagagacuacaucuucagcaaggccaucggcgacgccgagugguga

SEQ ID NO: 3624 - RNA, 1131 nt, Artificial Sequence
  derived and/or modified sequence opt5 from TF2AA__Homo_sapiens__AAF26776
auggccaacagcgcuaauaccaacacagugcccaagcuguacagauccgucaucgaggacguuauuaaugaugugcgggacaucuuccucgaugacggcguggaugaacagguccugauggagcuuaaaacgcugugggaaaacaagcucaugcaaucucgcgccguggacggguuucacagcgaggaacagcagcugcuucugcagguucaacagcagcaucagccucaacagcagcagcaccaucaccaucaccaccaucaacaggcgcagccgcaacagaccgugccccagcaggcucaaacacagcagguccucauuccugccucccagcaagccaccgcuccccaggugaucguuccugauucuaaacugauucagcacaugaaugccagcaacauguccgcugccgcgacagccgcuacccuggcccuccccgcuggagugacaccuguccagcaaauccugaccaauucuggccagcuucuccagguggugagagccgcgaacggggcccaguauaucuuccaaccgcagcagagcgucguucuccaacaacaggugauuccccagaugcagccuggaggcgugcaggcucccgucauccaacaggugcuggccccucuucccgggggaauuuccccgcagacgggcguuaucauucagccucagcagauccuguuuaccggcaauaagacacaagugauucccaccacagucgcugccccuacccccgcccaggcucagaucacggcgacagggcaacagcagccccaggcccaaccugcucagacccaggccccgcucgugcugcagguugacggaacaggcgauaccagcucugaggaggacgaagaugaggaagaggacuacgaugacgacgaggaagaggauaaagaaaaggacggggccgaggauggacaaguggaagaggagccccugaacuccgaagacgaugucagcgacgaggaaggccaggagcuguucgauaccgaaaauguggucgugugccaguaugacaagauccaucggucuaaaaacaaguggaaauuucaccugaaggaugggauuaugaaucuuaacggacgcgacuacaucuucuccaaagcuauuggcgaugccgagugguga

SEQ ID NO: 3625 - protein, 567 aa, Artificial Sequence
  TGFR2__Homo_sapiens__P37173
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 3626 - RNA, 1704 nt, Artificial Sequence
  TGFR2__Homo_sapiens__AAT70724
augggucgggggcugcucaggggccuguggccgcugcacaucguccuguggacgcguaucgccagcacgaucccaccgcacguucagaagucgguuaauaacgacaugauagucacugacaacaacggugcagucaaguuuccacaacuguguaaauuuugugaugugagauuuuccaccugugacaaccagaaauccugcaugagcaacugcagcaucaccuccaucugugagaagccacaggaagucuguguggcuguauggagaaagaaugacgagaacauaacacuagagacaguuugccaugaccccaagcuccccuaccaugacuuuauucuggaagaugcugcuucuccaaagugcauuaugaaggaaaaaaaaaagccuggugagacuuucuucauguguuccuguagcucugaugagugcaaugacaacaucaucuucucagaagaauauaacaccagcaauccugacuuguugcuagucauauuucaagugacaggcaucagccuccugccaccacugggaguugccauaucugucaucaucaucuucuacugcuaccgcguuaaccggcagcagaagcugaguucaaccugggaaaccggcaagacgcggaagcucauggaguucagcgagcacugugccaucauccuggaagaugaccgcucugacaucagcuccacgugugccaacaacaucaaccacaacacagagcugcugcccauugagcuggacacccugguggggaaaggucgcuuugcugaggucuauaaggccaagcugaagcagaacacuucagagcaguuugagacaguggcagucaagaucuuucccuaugaggaguaugccucuuggaagacagagaaggacaucuucucagacaucaaucugaagcaugagaacauacuccaguuccugacggcugaggagcggaagacggaguuggggaaacaauacuggcugaucaccgccuuccacgccaagggcaaccuacaggaguaccugacgcggcaugucaucagcugggaggaccugcgcaagcugggcagcucccucgcccgggggauugcucaccuccacagugaucacacuccaugugggaggcccaagaugcccaucgugcacagggaccucaagagcuccaauauccucgugaagaacgaccuaaccugcugccugugugacuuugggcuuucccugcgucuggacccuacucugucuguggaugaccuggcuaacagugggcaggugggaacugcaagauacauggcuccagaaguccuagaauccaggaugaauuuggagaauguugaguccuucaagcagaccgaugucuacuccauggcucuggugcucugggaaaugacaucucgcuguaaugcagugggagaaguaaaagauuaugagccuccauuugguuccaaggugcgggagcaccccugugucgaaagcaugaaggacaacguguugagagaucgagggcgaccagaaauucccagcuucuggcucaaccaccagggcauccagauggugugugagacguugacugagugcugggaccacgacccagaggcccgucucacagcccaguguguggcagaacgcuucagugagcuggagcaucuggacaggcucucggggaggagcugcucggaggagaagauuccugaagacggcucccuaaacacuaccaaauag

SEQ ID NO: 3627 - RNA, 1704 nt, Artificial Sequence
  derived and/or modified sequence opt1 from TGFR2__Homo_sapiens__AAT70724
augggccgcgggcugcuccggggccuguggccccugcacaucgugcucuggacccgcaucgccagcaccaucccgccccacguccagaaguccgugaacaacgacaugaucgugacggacaacaacggggccgucaaguucccccagcugugcaaguucugcgacgugcgguucagcacgugcgacaaccagaaguccugcaugagcaacugcuccaucaccagcaucugcgagaagccccaggaggugugcgucgcgguguggcgcaagaacgacgagaacaucacccuggagaccgugugccacgacccgaagcuccccuaccacgacuucauccuggaggacgccgccucccccaagugcaucaugaaggagaagaagaagcccggcgagaccuucuucaugugcagcugcuccagcgacgagugcaacgacaacaucaucuucuccgaggaguacaacaccagcaacccggaccugcuccuggucaucuuccaggugaccgggaucucccugcucccgccccugggcguggccaucagcgucaucaucaucuucuacugcuaccgggugaaccgccagcagaagcuguccagcacgugggagaccggcaagacccggaagcucauggaguucuccgagcacugcgccaucauccuggaggacgaccgcagcgacaucuccagcacgugcgcgaacaacaucaaccacaacaccgagcugcuccccaucgagcuggacacccugguggggaagggccgguucgccgaggucuacaaggccaagcucaagcagaacaccagcgagcaguucgagaccguggccgugaagaucuuccccuacgaggaguacgcguccuggaagacggagaaggacaucuucagcgacaucaaccugaagcacgagaacauccugcaguuccucaccgccgaggagcgcaagaccgagcuggggaagcaguacuggcugaucaccgccuuccacgccaagggcaaccuccaggaguaccugacgcggcacgucaucuccugggaggaccugcgcaagcucgggagcucccuggcccggggcaucgcgcaccuccacagcgaccacacccccugcggccgccccaagaugcccaucgugcaccgggaccugaaguccagcaacauccuggugaagaacgaccugaccugcugccucugcgacuucgggcugucccugcgccucgacccgacccugagcgucgacgaccuggccaacuccggccagguggggacggcccgguacauggcccccgaggugcucgagagccgcaugaaccuggagaacgucgaguccuucaagcagaccgacguguacagcauggcccugguccucugggagaugaccucccggugcaacgcggugggcgaggugaaggacuacgagccgcccuucggcagcaagguccgcgagcaccccugcguggaguccaugaaggacaacgugcugcgggaccgcgggcgccccgagauccccagcuucuggcugaaccaccagggcauccagauggucugcgagacccucacggagugcugggaccacgaccccgaggcccggcugaccgcccagugcguggccgagcgcuucuccgagcuggagcaccuggaccggcucagcgggcgcagcugcuccgaggagaagaucccggaggacggcagccugaacaccaccaaguga

SEQ ID NO: 3628 - RNA, 1704 nt, Artificial Sequence
  derived and/or modified sequence opt2 from TGFR2__Homo_sapiens__AAT70724
augggccgcggccuccuccgcggccucuggccccuccacaucguccucuggacccgcaucgccuccaccauccccccccacguccagaaguccgucaacaacgacaugaucgucaccgacaacaacggcgccgucaaguucccccagcucugcaaguucugcgacguccgcuucuccaccugcgacaaccagaaguccugcauguccaacugcuccaucaccuccaucugcgagaagccccaggaggucugcgucgccgucuggcgcaagaacgacgagaacaucacccucgagaccgucugccacgaccccaagcuccccuaccacgacuucauccucgaggacgccgccucccccaagugcaucaugaaggagaagaagaagcccggcgagaccuucuucaugugcuccugcuccuccgacgagugcaacgacaacaucaucuucuccgaggaguacaacaccuccaaccccgaccuccuccucgucaucuuccaggucaccggcaucucccuccuccccccccucggcgucgccaucuccgucaucaucaucuucuacugcuaccgcgucaaccgccagcagaagcucuccuccaccugggagaccggcaagacccgcaagcucauggaguucuccgagcacugcgccaucauccucgaggacgaccgcuccgacaucuccuccaccugcgccaacaacaucaaccacaacaccgagcuccuccccaucgagcucgacacccucgucggcaagggccgcuucgccgaggucuacaaggccaagcucaagcagaacaccuccgagcaguucgagaccgucgccgucaagaucuuccccuacgaggaguacgccuccuggaagaccgagaaggacaucuucuccgacaucaaccucaagcacgagaacauccuccaguuccucaccgccgaggagcgcaagaccgagcucggcaagcaguacuggcucaucaccgccuuccacgccaagggcaaccuccaggaguaccucacccgccacgucaucuccugggaggaccuccgcaagcucggcuccucccucgcccgcggcaucgcccaccuccacuccgaccacacccccugcggccgccccaagaugcccaucguccaccgcgaccucaaguccuccaacauccucgucaagaacgaccucaccugcugccucugcgacuucggccucucccuccgccucgaccccacccucuccgucgacgaccucgccaacuccggccaggucggcaccgcccgcuacauggcccccgagguccucgagucccgcaugaaccucgagaacgucgaguccuucaagcagaccgacgucuacuccauggcccucguccucugggagaugaccucccgcugcaacgccgucggcgaggucaaggacuacgagccccccuucggcuccaagguccgcgagcaccccugcgucgaguccaugaaggacaacguccuccgcgaccgcggccgccccgagauccccuccuucuggcucaaccaccagggcauccagauggucugcgagacccucaccgagugcugggaccacgaccccgaggcccgccucaccgcccagugcgucgccgagcgcuucuccgagcucgagcaccucgaccgccucuccggccgcuccugcuccgaggagaagauccccgaggacggcucccucaacaccaccaaguga

SEQ ID NO: 3629 - RNA, 1704 nt, Artificial Sequence
  derived and/or modified sequence opt3 from TGFR2__Homo_sapiens__AAT70724
augggcagagggcugcucaggggacuuuggccccugcacaucguguuguggacccggauugccagcacaauaccuccacauguccagaaguccguuaacaaugacaugaucgugacugauaacaauggugcuguaaaauucccgcaauuaugcaaguuuugugacgugcgcuucucuacgugcgauaaccagaaaucauguaugaguaauugcagcauuaccuccaucugugagaagccccaggaagucugcguggcaguuuggcguaaaaacgacgagaauauuacacuggaaacugugugucacgauccuaagcuaccauaccaugacuuuauccucgaggaugccgcgucucccaagugcauaaugaaagaaaagaaaaagccuggcgagaccuucuuuauguguucgugcucaagcgacgaguguaacgauaauaucauuuucagugaagaguauaacacauccaauccagaccugcuucuggucaucuuucaggugaccgggauuucuuugcugcccccucucggaguagcuaucagcguuauaauuaucuucuacugcuaucgagugaacagacaacagaaacuguccucaacuugggaaacaggcaagaccaggaagcucauggaguuuagugagcacugcgccauuaucuuagaagaugaccggagcgauaucucuuccacgugugcaaauaacauuaaucauaacacugagcugcuuccaauagaauuggacacccuggucgguaaagggcgcuucgccgagguguacaaggcuaaacuaaagcagaacacaucagaacaguuugagacuguggcagucaaaaucuucccguaugaggaauacgccagcuggaagaccgagaaagacauuuuuagugauaucaaucucaagcacgaaaacauacugcaauuccuuacagcugaggaaagaaagaccgagcugggaaaacaguauugguugauuacggccuuccacgcgaagggcaaucuccaggaguaccugacuaggcauguuaucucuugggaagacuuacggaaacugggcuccagccucgcacgcgggaucgcccaccuucauucggaucacacacccugcggacgaccuaagaugccaauugugcacagagaccugaaaucuuccaacaucuugguaaagaaugaucuaaccuguugccugugugacuuuggucucucacugaggcuugaucccacucugaguguggacgauuuggcuaacagcggccaggucgggacagcccgguacauggcaccugaggugcucgaaucccguaugaaucuggagaacguugaaucuuucaagcaaaccgacguguauagcauggcuuuaguccugugggagaugacgucacgcugcaaugccgugggagagguaaaagauuacgaaccacccuuuggcaguaagguuagagagcauccguguguggaauccaugaaagacaacguccuaagggaccggggucgaccugagauucccagcuucuggcucaaucaccaggggauacagauggugugcgagacccugacagaauguugggaucaugacccagaggcgcgccuuacugcccaaugcgucgcagaaagauuuucugaguuggaacaccuggauaggcucucaggacggaguuguagcgaggagaagaucccugaagacggcucccugaacaccacaaaauga

SEQ ID NO: 3630 - RNA, 1704 nt, Artificial Sequence
  derived and/or modified sequence opt4 from TGFR2__Homo_sapiens__AAT70724
augggcagaggccugcugagaggccuguggccccugcacaucgugcuguggaccagaaucgccagcaccauccccccccacgugcagaagagcgugaacaacgacaugaucgugaccgacaacaacggcgccgugaaguucccccagcugugcaaguucugcgacgugagauucagcaccugcgacaaccagaagagcugcaugagcaacugcagcaucaccagcaucugcgagaagccccaggaggugugcguggccguguggagaaagaacgacgagaacaucacccuggagaccgugugccacgaccccaagcugcccuaccacgacuucauccuggaggacgccgccagccccaagugcaucaugaaggagaagaagaagcccggcgagaccuucuucaugugcagcugcagcagcgacgagugcaacgacaacaucaucuucagcgaggaguacaacaccagcaaccccgaccugcugcuggugaucuuccaggugaccggcaucagccugcugcccccccugggcguggccaucagcgugaucaucaucuucuacugcuacagagugaacagacagcagaagcugagcagcaccugggagaccggcaagaccagaaagcugauggaguucagcgagcacugcgccaucauccuggaggacgacagaagcgacaucagcagcaccugcgccaacaacaucaaccacaacaccgagcugcugcccaucgagcuggacacccuggugggcaagggcagauucgccgagguguacaaggccaagcugaagcagaacaccagcgagcaguucgagaccguggccgugaagaucuuccccuacgaggaguacgccagcuggaagaccgagaaggacaucuucagcgacaucaaccugaagcacgagaacauccugcaguuccugaccgccgaggagagaaagaccgagcugggcaagcaguacuggcugaucaccgccuuccacgccaagggcaaccugcaggaguaccugaccagacacgugaucagcugggaggaccugagaaagcugggcagcagccuggccagaggcaucgcccaccugcacagcgaccacacccccugcggcagacccaagaugcccaucgugcacagagaccugaagagcagcaacauccuggugaagaacgaccugaccugcugccugugcgacuucggccugagccugagacuggaccccacccugagcguggacgaccuggccaacagcggccaggugggcaccgccagauacauggcccccgaggugcuggagagcagaaugaaccuggagaacguggagagcuucaagcagaccgacguguacagcauggcccuggugcugugggagaugaccagcagaugcaacgccgugggcgaggugaaggacuacgagccccccuucggcagcaaggugagagagcaccccugcguggagagcaugaaggacaacgugcugagagacagaggcagacccgagauccccagcuucuggcugaaccaccagggcauccagauggugugcgagacccugaccgagugcugggaccacgaccccgaggccagacugaccgcccagugcguggccgagagauucagcgagcuggagcaccuggacagacugagcggcagaagcugcagcgaggagaagauccccgaggacggcagccugaacaccaccaaguga

SEQ ID NO: 3631 - RNA, 1704 nt, Artificial Sequence
  derived and/or modified sequence opt5 from TGFR2__Homo_sapiens__AAT70724
augggcagagggcugcuccggggacuguggccccuucacaucgugcuguggacccgcauugccagcacaaucccuccgcauguccagaaguccguuaacaaugacaugauugugacggauaacaauggcgcugugaaauucccccaacucugcaaguuuugugacgucagauucucuaccugcgauaaccagaaaagcuguauguccaauugcucuaucacaagcauuugugagaagccucaggaagugugcguugccguguggcggaaaaacgacgagaauaucacccuggaaacagucugucacgaucccaagcugccuuaccaugacuuuauccuggaggaugcggcuucccccaagugcauuaugaaagaaaagaaaaagccuggggagaccuucuuuauguguucuugcagcuccgacgaguguaacgauaauaucauuuucagcgaagaguauaacacaucuaauccggaccuccugcuggugaucuuucagguuaccggaauuucccuccugcccccucuuggcguggccaucagcgucauuaucaucuucuacugcuaucgcgugaacagacaacagaaacugucuuccacgugggaaaccgggaagacacggaagcucauggaguuuagcgagcacugcgccauuauccuggaagaugaccgcucugauauuuccagcaccugugcuaauaacaucaaucauaacacagagcuucugcccauugaacucgacacccuggugggaaaaggcagauucgccgaggucuacaaggcuaaacugaagcagaacacguccgaacaguuugagacaguugccgugaaaaucuucccuuaugaggaauacgcgucuuggaagaccgagaaagacaucuuuagcgauauuaaucucaagcacgaaaacauccugcaauuccuuacagccgaggaacggaagaccgagcugggcaaacaguauuggcucauuaccgcuuuccacgccaaggggaaucugcaggaguaccuuacacgccaugugaucuccugggaagaccugagaaaacucggaagcucucuggcucggggcauugcccaccuucauuccgaucacacgcccugcgggcgcccgaagaugccuaucguccacagagaccucaaaagcucuaacauccuggugaagaaugaucuuaccuguugccugugugacuuuggacucagccugcggcuugaucccacacuguccguugacgaucucgcgaacucuggccagguggggaccgcccgcuacauggcuccugagguccuggaaagcagaaugaaucuggagaacguggaauccuucaagcaaacagacguuuauagcauggcccucgugcugugggagaugaccucucggugcaaugcugucggagaggugaaagauuacgaaccucccuuuggcuccaaggucagagagcaucccuguguggaaagcaugaaagacaacguucuucgcgaccggggcagaccggagauucccucuuucuggcugaaucaccaggggauccagauggugugcgagacgcucacagaauguugggaucaugacccugaggcccgccugaccgcccaaugcgucgcugaacgguuuuccgagcuggaacaccuugauagacucagcggacgcuccuguucugaggagaagauucccgaagacggcagccugaacaccacaaaauga

SEQ ID NO: 3632 - protein, 684 aa, Artificial Sequence [sequence omitted]

SEQ ID NO: 3633 - RNA, 2055 nt, Artificial Sequence
  TGM-4__Homo_sapiens__BAG35778
augauggaugcaucaaaagagcugcaaguucuccacauugacuucuugaaucaggacaacgccguuucucaccacacaugggaguuccaaacgagcaguccuguguuccggcgaggacagguguuucaccugcggcuggugcugaaccagcccccacaauccuaccaccaacugaaacuggaauucagcacagggccgaauccuagcaucgccaaacacacccugguggugcucgacccgaggacgcccucagaccacuacaacuggcaggcaacccuucaaaaugagucuggcaaagaggucacaguggcugucaccaguucccccaaugccauccugggcaaguaccaacuaaacgugaaaacuggaaaccacauccuuaagucugaagaaaacauccuauaccuucucuucaacccaugguguaaagaggacaugguuuucaugccugaugaggacgagcgcaaagaguacauccucaaugacacgggcugccauuacgugggggcugccagaaguaucaaaugcaaacccuggaacuuuggucaguuugagaaaaauguccuggacugcugcauuucccugcugacugagagcucccucaagcccacagauaggagggaccccgugcuggugugcagggccaugugugcuaugaugagcuuugagaaaggccagggcgugcucauugggaauuggacuggggacuacgaagguggcacagccccauacaaguggacaggcagugccccgauccugcagcaguacuacaacacgaagcaggcugugugcuuuggccagugcuggguguuugcugggauccugacuacagugcugagagcguugggcaucccagcacgcagugugacaggcuucgauucagcucacgacacagaaaggaaccucacgguggacaccuaugugaaugagaauggcgagaaaaucaccaguaugacccacgacucugucuggaauuuccauguguggacggaugccuggaugaagcgaccggaucugcccaagggcuacgacggcuggcaggcuguggacgcaacgccgcaggagcgaagccagggugucuucugcugugggccaucaccacugaccgccauccgcaaaggugacaucuuuauugucuaugacaccagauucgucuucucagaagugaauggugacaggcucaucugguuggugaagauggugaaugggcaggaggaguuacacguaauuucaauggagaccacaagcaucgggaaaaacaucagcaccaaggcagugggccaagacaggcggagagauaucaccuaugaguacaaguauccagaaggcuccucugaggagaggcaggucauggaucaugccuuccuccuucucaguucugagagggagcacagacgaccuguaaaagagaacuuucuucacaugucgguacaaucagaugaugugcugcugggaaacucuguuaauuucaccgugauucuuaaaaggaagaccgcugcccuacagaaugucaacaucuugggcuccuuugaacuacaguuguacacuggcaagaagauggcaaaacugugugaccucaauaagaccucgcagauccaaggucaaguaucagaagugacucugaccuuggacuccaagaccuacaucaacagccuggcuauauuagaugaugagccaguuaucagagguuucaucauugcggaaauuguggagucuaaggaaaucauggccucugaaguauucacgucuuuccaguacccugaguucucuauagaguugccuaacacaggcagaauuggccagcuacuugucugcaauuguaucuucaagaauacccuggccaucccuuugacugacgucaaguucucuuuggaaagccugggcaucuccucacuacagaccucugaccaugggacggugcagccuggugagaccauccaaucccaaauaaaaugcaccccaauaaaaacuggacccaagaaauuuaucgucaaguuaaguuccaaacaagugaaagagauuaaugcucagaagauuguucucaucaccaaguag

SEQ ID NO: 3634 - RNA, 2055 nt, Artificial Sequence
  derived and/or modified sequence opt1 from TGM-4__Homo_sapiens__BAG35778
augauggacgccagcaaggagcuccaggugcuccacaucgacuuccugaaccaggacaacgccgucucccaccacaccugggaguuccagaccagcucccccguguuccgccggggccagguguuccaccuccgccugguccugaaccagccgccccagagcuaccaccagcugaagcucgaguucuccacggggcccaaccccagcaucgcgaagcacacccugguggugcuggacccgcggacccccuccgaccacuacaacuggcaggccacccuccagaacgagagcggcaaggaggucacgguggccgugaccuccagccccaacgccauccuggggaaguaccagcugaacgucaagaccggcaaccacauccucaaguccgaggagaacauccuguaccugcuguucaaccccuggugcaaggaggacaugguguucaugccggacgaggacgagcgcaaggaguacauccugaacgacaccgggugccacuacgugggcgccgcgcggagcaucaagugcaagcccuggaacuucggccaguucgagaagaacguccuggacugcugcaucucccuccugacggagagcucccugaagcccaccgaccgccgggaccccgugcucgugugccgcgccaugugcgccaugaugagcuucgagaaggggcagggcguccugaucgggaacuggaccggcgacuacgagggcgggaccgccccguacaaguggacgggcuccgcgcccauccugcagcaguacuacaacaccaagcaggccgugugcuucgggcagugcuggguguucgccggcauccucaccaccguccugcgggcccuggggauccccgcccgcagcgugacgggcuucgacuccgcgcacgacaccgagcggaaccucaccguggacaccuacgucaacgagaacggcgagaagaucacgagcaugacccacgacagcguguggaacuuccacguguggaccgacgccuggaugaagcgccccgaccugccgaagggguacgacggcuggcaggccgucgacgccacgccccaggagcggucccaggggguguucugcugcggccccagcccccugaccgccauccgcaagggggacaucuucaucgucuacgacacccgguucguguucuccgaggugaacggcgaccgccucaucuggcuggucaagauggugaacggccaggaggagcugcacgugaucagcauggagaccaccuccaucgggaagaacaucagcacgaaggcggucggccaggaccggcgccgggacaucaccuacgaguacaaguacccggagggguccagcgaggagcgccaggugauggaccacgccuuccuccugcuguccagcgagcgggagcaccgccgccccgugaaggagaacuuccuccacauguccguccagagcgacgacgugcugcugggcaacuccgugaacuucaccgucauccucaagcggaagaccgccgcccugcagaacgugaacauccuggggagcuucgagcuccagcuguacacgggcaagaagauggccaagcugugcgaccucaacaagaccucccagauccagggccaggugagcgaggucacccugacccuggacuccaagacguacaucaacagccucgcgauccuggacgacgagcccgugauccgcggguucaucaucgccgagaucguggaguccaaggagaucauggccagcgaggucuucaccagcuuccaguaccccgaguucuccaucgagcugccgaacaccggccggaucgggcagcugcucgugugcaacugcaucuucaagaacacccuggccaucccccugaccgacgugaaguucagccucgagucccugggcaucagcucccugcagacgagcgaccacgggaccguccagcccggcgagaccauccagucccagaucaagugcacccccaucaagacgggcccgaagaaguucaucgugaagcucagcuccaagcaggucaaggagaucaacgcccagaagaucgugcugaucaccaaguga

SEQ ID NO: 3635 - RNA, 2055 nt, Artificial Sequence
  derived and/or modified sequence opt2 from TGM-4__Homo_sapiens__BAG35778
augauggacgccuccaaggagcuccagguccuccacaucgacuuccucaaccaggacaacgccgucucccaccacaccugggaguuccagaccuccucccccgucuuccgccgcggccaggucuuccaccuccgccucguccucaaccagcccccccaguccuaccaccagcucaagcucgaguucuccaccggccccaaccccuccaucgccaagcacacccucgucguccucgacccccgcacccccuccgaccacuacaacuggcaggccacccuccagaacgaguccggcaaggaggucaccgucgccgucaccuccucccccaacgccauccucggcaaguaccagcucaacgucaagaccggcaaccacauccucaaguccgaggagaacauccucuaccuccucuucaaccccuggugcaaggaggacauggucuucaugcccgacgaggacgagcgcaaggaguacauccucaacgacaccggcugccacuacgucggcgccgcccgcuccaucaagugcaagcccuggaacuucggccaguucgagaagaacguccucgacugcugcaucucccuccucaccgaguccucccucaagcccaccgaccgccgcgaccccguccucgucugccgcgccaugugcgccaugauguccuucgagaagggccagggcguccucaucggcaacuggaccggcgacuacgagggcggcaccgcccccuacaaguggaccggcuccgcccccauccuccagcaguacuacaacaccaagcaggccgucugcuucggccagugcugggucuucgccggcauccucaccaccguccuccgcgcccucggcauccccgcccgcuccgucaccggcuucgacuccgcccacgacaccgagcgcaaccucaccgucgacaccuacgucaacgagaacggcgagaagaucaccuccaugacccacgacuccgucuggaacuuccacgucuggaccgacgccuggaugaagcgccccgaccuccccaagggcuacgacggcuggcaggccgucgacgccaccccccaggagcgcucccagggcgucuucugcugcggccccuccccccucaccgccauccgcaagggcgacaucuucaucgucuacgacacccgcuucgucuucuccgaggucaacggcgaccgccucaucuggcucgucaagauggucaacggccaggaggagcuccacgucaucuccauggagaccaccuccaucggcaagaacaucuccaccaaggccgucggccaggaccgccgccgcgacaucaccuacgaguacaaguaccccgagggcuccuccgaggagcgccaggucauggaccacgccuuccuccuccucuccuccgagcgcgagcaccgccgccccgucaaggagaacuuccuccacauguccguccaguccgacgacguccuccucggcaacuccgucaacuucaccgucauccucaagcgcaagaccgccgcccuccagaacgucaacauccucggcuccuucgagcuccagcucuacaccggcaagaagauggccaagcucugcgaccucaacaagaccucccagauccagggccaggucuccgaggucacccucacccucgacuccaagaccuacaucaacucccucgccauccucgacgacgagcccgucauccgcggcuucaucaucgccgagaucgucgaguccaaggagaucauggccuccgaggucuucaccuccuuccaguaccccgaguucuccaucgagcuccccaacaccggccgcaucggccagcuccucgucugcaacugcaucuucaagaacacccucgccaucccccucaccgacgucaaguucucccucgagucccucggcaucuccucccuccagaccuccgaccacggcaccguccagcccggcgagaccauccagucccagaucaagugcacccccaucaagaccggccccaagaaguucaucgucaagcucuccuccaagcaggucaaggagaucaacgcccagaagaucguccucaucaccaaguga

SEQ ID NO: 3636 - RNA, 2055 nt, Artificial Sequence
  derived and/or modified sequence opt3 from TGM-4__Homo_sapiens__BAG35778
augauggacgccagcaaggagcugcaagugcuccacaucgauuuccuuaaccaagacaaugcugucucccaucacaccugggaauuucagacaucuucacccguuuucagaaggggccagguguuucaucugcgguugguauuaaaccagccuccacaaaguuaccaccagcugaaacuagaguucagcacugggccgaaucccuccauugcaaagcauacgcucgugguccuggauccucgcaccccaucugaccacuauaacuggcaggccacacuucagaaugaaucgggaaaagaggugacuguugcggugaccucaagccccaacgcuauacuggguaaguaccaauugaaugucaaaacaggcaaccacauccucaagagugaagagaauauucuguaucugcucuuuaacccuuggugcaaggaggauaugguguucaugccagacgaagaugagcgaaaagaauacaucuuaaaugacaccgggugucauuauguaggagccgcacguuccauuaagugcaaacccuggaacuuuggccaguucgagaagaauguucuggauuguugcaucucucuuuugacugagagcucccugaaaccuacagacagaagggauccagugcuagucugucgggccaugugcgcuaugaugucauuugaaaagggucagggggugcucauaggaaacuggaccggcgacuacgagggcgggacggcaccguauaaguggacuggaagugcccccauccugcagcaauacuacaauaccaaacaggcuguguguuucggucagugcugggucuuugccggcauucuuacaacuguucugcgcgcguuggggaucccugcaagaagcgugaccggauucgauucugcccacgacacagaaaggaaccucaccguagacacguaugugaacgagaauggcgaaaagauuacuuccaugacacaugauucagucuggaacuuucacguguggaccgacgcuuggaugaaacggccagaucugcccaaggguuacgacggguggcaagccguugaugcaacuccucaggagcgcagccagggaguguucuguugcggcccaagucccuuaacagcuauccgaaaaggcgacauauucauugucuaugauaccagauuuguguucucugagguaaauggggacaggcugaucuggcucguuaagauggugaacggacaggaggaacuucacgucauuuccauggaaacgaccagcaucgguaaaaauaucucgacaaaggccgugggccaagaucggcgucgcgacauuacuuacgaguauaaguacccggaagggucuuccgaggagagacaggucauggaucaugcguuucuguugcuaucaagugaaagggagcaccggcgaccugugaaagaaaacuuccugcauaugagcguucaguccgacgacgugcuccugggaaauucuguaaacuuuaccgucauacuuaagcgcaaaacagccgcacugcagaaugugaacaucuugggcagcuucgagcuccaacuguauacugguaagaaaauggcuaaguuaugugaucugaauaagaccucacagauucaggggcagguuagugaagugacacuaacccucgacuccaaaacuuacaucaacagccuggccauacuugaugacgagcccgucauuagaggcuuuaucaucgcugagauuguggaaucuaaggagaucauggccucagaaguauucacgaguuuucaauacccagaguucagcauugaguugccuaauacaggaaggauaggccagcugcucgugugcaacugcaucuuuaaaaauacccuggcaauuccccuuacugauguuaaguucucccuggaaucuuuggggaucucgagccuccagaccuccgaccacggaacaguccagccaggugagaccauccaaucacagauuaaauguacucccauaaagacaggcccuaagaaauuuaucgugaagcugaguucuaaacaggugaaggaaauuaacgcccagaaaaucgucuuaauuacgaaguga

SEQ ID NO: 3637 - RNA, 2055 nt, Artificial Sequence
  derived and/or modified sequence opt4 from TGM-4__Homo_sapiens__BAG35778
augauggacgccagcaaggagcugcaggugcugcacaucgacuuccugaaccaggacaacgccgugagccaccacaccugggaguuccagaccagcagccccguguucagaagaggccagguguuccaccugagacuggugcugaaccagcccccccagagcuaccaccagcugaagcuggaguucagcaccggccccaaccccagcaucgccaagcacacccugguggugcuggaccccagaacccccagcgaccacuacaacuggcaggccacccugcagaacgagagcggcaaggaggugaccguggccgugaccagcagccccaacgccauccugggcaaguaccagcugaacgugaagaccggcaaccacauccugaagagcgaggagaacauccuguaccugcuguucaaccccuggugcaaggaggacaugguguucaugcccgacgaggacgagagaaaggaguacauccugaacgacaccggcugccacuacgugggcgccgccagaagcaucaagugcaagcccuggaacuucggccaguucgagaagaacgugcuggacugcugcaucagccugcugaccgagagcagccugaagcccaccgacagaagagaccccgugcuggugugcagagccaugugcgccaugaugagcuucgagaagggccagggcgugcugaucggcaacuggaccggcgacuacgagggcggcaccgcccccuacaaguggaccggcagcgcccccauccugcagcaguacuacaacaccaagcaggccgugugcuucggccagugcuggguguucgccggcauccugaccaccgugcugagagcccugggcauccccgccagaagcgugaccggcuucgacagcgcccacgacaccgagagaaaccugaccguggacaccuacgugaacgagaacggcgagaagaucaccagcaugacccacgacagcguguggaacuuccacguguggaccgacgccuggaugaagagacccgaccugcccaagggcuacgacggcuggcaggccguggacgccaccccccaggagagaagccagggcguguucugcugcggccccagcccccugaccgccaucagaaagggcgacaucuucaucguguacgacaccagauucguguucagcgaggugaacggcgacagacugaucuggcuggugaagauggugaacggccaggaggagcugcacgugaucagcauggagaccaccagcaucggcaagaacaucagcaccaaggccgugggccaggacagaagaagagacaucaccuacgaguacaaguaccccgagggcagcagcgaggagagacaggugauggaccacgccuuccugcugcugagcagcgagagagagcacagaagacccgugaaggagaacuuccugcacaugagcgugcagagcgacgacgugcugcugggcaacagcgugaacuucaccgugauccugaagagaaagaccgccgcccugcagaacgugaacauccugggcagcuucgagcugcagcuguacaccggcaagaagauggccaagcugugcgaccugaacaagaccagccagauccagggccaggugagcgaggugacccugacccuggacagcaagaccuacaucaacagccuggccauccuggacgacgagcccgugaucagaggcuucaucaucgccgagaucguggagagcaaggagaucauggccagcgagguguucaccagcuuccaguaccccgaguucagcaucgagcugcccaacaccggcagaaucggccagcugcuggugugcaacugcaucuucaagaacacccuggccaucccccugaccgacgugaaguucagccuggagagccugggcaucagcagccugcagaccagcgaccacggcaccgugcagcccggcgagaccauccagagccagaucaagugcacccccaucaagaccggccccaagaaguucaucgugaagcugagcagcaagcaggugaaggagaucaacgcccagaagaucgugcugaucaccaaguga

SEQ ID NO: 3638 - RNA, 2055 nt, Artificial Sequence
  derived and/or modified sequence opt5 from TGM-4__Homo_sapiens__BAG35778
augauggacgccagcaaggagcuccaggugcugcacaucgauuuccugaaccaagacaaugcugucucccaucacaccugggaauuucagacaucuagccccguuuucagacggggccagguguuucaucuucgccuggugcucaaccagccuccgcaauccuaccaccagcugaaacuugaguucucuacggggcccaauccuagcauugccaagcauacccuggucgugcucgaucccagaacaccuuccgaccacuauaacuggcaggcgacccugcagaaugaaucuggaaaagagguuacaguggcugucaccagcucccccaacgccauccugggcaaguaccaacucaaugugaaaacagggaaccacauucugaaaagcgaagagaauauccuuuaucugcucuuuaacccuuggugcaaggaggauaugguuuucaugccggacgaagaugagcggaaagaauacauucugaaugacaccggaugucauuaugugggcgccgcucgcucuaucaagugcaaacccuggaacuuugggcaguucgagaagaauguccuugauuguugcaucucccugcucacggagagcucucugaaaccuaccgacagacgggaucccgugcuggugugucgcgccaugugcgcuaugauguccuuugaaaagggacagggcguccucauuggcaacuggacaggggacuacgagggaggcaccgccccuuauaaguggacagggagcgcgcccauccugcagcaauacuacaauaccaaacaggccguuuguuucggacagugcuggguguuugcuggcauucuuacgacagugcugagagcccucgggaucccggcucggucugucaccggauucgauuccgcccacgacacagaacgcaaccugaccguggacaccuauguuaacgagaauggcgaaaagauuacaagcaugacgcaugauuccguguggaacuuucacgucuggaccgacgcguggaugaaaagaccugaucuucccaagggcuacgacggguggcaagccguggaugcuacaccucaggagcggucucagggaguuuucuguugcggccccagcccccugaccgccauccgcaaaggggacauuuucaucguguaugauacaagauuugucuucuccgaggugaauggagaccggcucaucuggcuggucaagauggugaacggccaggaggaacugcacguuauuagcauggaaaccacgucuaucgggaaaaauauuuccacaaaggcugugggacaagaucgcagacgggacaucaccuacgaguauaaguacccugaaggcagcucugaggagagacaggucauggaucaugccuuucuccugcuuagcuccgaacgcgagcaccggagaccggugaaagaaaacuuccugcauaugucuguucagagcgacgacgugcuccugggcaauuccgucaacuuuaccgugauucuuaagcgcaaaacagccgcucugcagaaugugaacauccucgggagcuucgagcugcaacuguauaccggaaagaaaauggcgaagcucugugaucugaauaagacaucucagauccagggccagguuuccgaagucacgcuuacccuggacagcaaaacauacauuaacucucucgccauccuggaugacgagcccgugauucggggguuuaucauugcugagaucguggaauccaaggagaucauggccagcgaagucuucaccuccuuucaauacccugaguucucuauugagcugcccaauacaggaagaaucggccagcuucucgugugcaacugcauuuuuaaaaauacccuggccaucccucugacggauguuaaguucagccucgaaucccuggggauuucuagccuucagaccuccgaccacggcacagugcagcccggagagaccauccaaagccagauuaaauguacaccgaucaagaccggcccuaagaaauuuaucgucaagcugucuuccaaacaggugaaggaaauuaacgcucaaaagaucguucucauuacgaaguga

SEQ ID NO: 3639 - protein, 1124 aa, Artificial Sequence
  TIE2__Homo_sapiens__Q02763
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 3640 - RNA, 3375 nt, Artificial Sequence
  TIE2__Homo_sapiens__CCDS6519.1
auggacucuuuagccagcuuaguucucuguggagucagcuugcuccuuucuggaacuguggaaggugccauggacuugaucuugaucaauucccuaccucuuguaucugaugcugaaacaucucucaccugcauugccucuggguggcgcccccaugagcccaucaccauaggaagggacuuugaagccuuaaugaaccagcaccaggauccgcuggaaguuacucaagaugugaccagagaaugggcuaaaaaaguuguuuggaagagagaaaaggcuaguaagaucaauggugcuuauuucugugaagggcgaguucgaggagaggcaaucaggauacgaaccaugaagaugcgucaacaagcuuccuuccuaccagcuacuuuaacuaugacuguggacaagggagauaacgugaacauaucuuucaaaaagguauugauuaaagaagaagaugcagugauuuacaaaaaugguuccuucauccauucagugccccggcaugaaguaccugauauucuagaaguacaccugccucaugcucagccccaggaugcuggaguguacucggccagguauauaggaggaaaccucuucaccucggccuucaccaggcugauaguccggagaugugaagcccagaaguggggaccugaaugcaaccaucucuguacugcuuguaugaacaauggugucugccaugaagauacuggagaaugcauuugcccuccuggguuuaugggaaggacgugugagaaggcuugugaacugcacacguuuggcagaacuuguaaagaaaggugcaguggacaagagggaugcaagucuuauguguucugucucccugaccccuauggguguuccugugccacaggcuggaagggucugcagugcaaugaagcaugccacccugguuuuuacgggccagauuguaagcuuaggugcagcugcaacaauggggagaugugugaucgcuuccaaggaugucucugcucuccaggauggcaggggcuccagugugagagagaaggcauacagaggaugaccccaaagauaguggauuugccagaucauauagaaguaaacagugguaaauuuaaucccauuugcaaagcuucuggcuggccgcuaccuacuaaugaagaaaugacccuggugaagccggaugggacagugcuccauccaaaagacuuuaaccauacggaucauuucucaguagccauauucaccauccaccggauccuccccccugacucaggaguuugggucugcagugugaacacaguggcugggaugguggaaaagcccuucaacauuucuguuaaaguucuuccaaagccccugaaugccccaaacgugauugacacuggacauaacuuugcugucaucaacaucagcucugagccuuacuuuggggauggaccaaucaaauccaagaagcuucuauacaaacccguuaaucacuaugaggcuuggcaacauauucaagugacaaaugagauuguuacacucaacuauuuggaaccucggacagaauaugaacucugugugcaacugguccgucguggagaggguggggaagggcauccuggaccugugagacgcuucacaacagcuucuaucggacucccuccuccaagaggucuaaaucuccugccuaaaagucagaccacucuaaauuugaccuggcaaccaauauuuccaagcucggaagaugacuuuuauguugaaguggagagaaggucugugcaaaaaagugaucagcagaauauuaaaguuccaggcaacuugacuucggugcuacuuaacaacuuacaucccagggagcaguacgugguccgagcuagagucaacaccaaggcccagggggaauggagugaagaucucacugcuuggacccuuagugacauucuuccuccucaaccagaaaacaucaagauuuccaacauuacacacuccucagcugugauuucuuggacaauauuggauggcuauucuauuucuucuauuacuauccguuacaagguucaaggcaagaaugaagaccagcacguugaugugaagauaaagaaugccaccaucacucaguaucagcucaagggccuagagccugaaacagcauaccagguggacauuuuugcagagaacaacauagggucaagcaacccagccuuuucucaugaacuggugacccucccagaaucucaagcaccagcggaccucggaggggggaagaugcugcuuauagccauccuuggcucugcuggaaugaccugccugacugugcuguuggccuuucugaucauauugcaauugaagagggcaaaugugcaaaggagaauggcccaagccuuccaaaacgugagggaagaaccagcugugcaguucaacucagggacucuggcccuaaacaggaaggucaaaaacaacccagauccuacaauuuauccagugcuugacuggaaugacaucaaauuucaagaugugauuggggagggcaauuuuggccaaguucuuaaggcgcgcaucaagaaggauggguuacggauggaugcugccaucaaaagaaugaaagaauaugccuccaaagaugaucacagggacuuugcaggagaacuggaaguucuuuguaaacuuggacaccauccaaacaucaucaaucucuuaggagcaugugaacaucgaggcuacuuguaccuggccauugaguacgcgccccauggaaaccuucuggacuuccuucgcaagagccgugugcuggagacggacccagcauuugccauugccaauagcaccgcguccacacuguccucccagcagcuccuucacuucgcugccgacguggcccggggcauggacuacuugagccaaaaacaguuuauccacagggaucuggcugccagaaacauuuuaguuggugaaaacuauguggcaaaaauagcagauuuuggauugucccgaggucaagagguguaugugaaaaagacaaugggaaggcucccagugcgcuggauggccaucgagucacugaauuacaguguguacacaaccaacagugauguaugguccuaugguguguuacuaugggagauuguuagcuuaggaggcacacccuacugcgggaugacuugugcagaacucuacgagaagcugccccagggcuacagacuggagaagccccugaacugugaugaugagguguaugaucuaaugagacaaugcuggcgggagaagccuuaugagaggccaucauuugcccagauauugguguccuuaaacagaauguuagaggagcgaaagaccuacgugaauaccacgcuuuaugagaaguuuacuuaugcaggaauugacuguucugcugaagaagcggccuag

SEQ ID NO: 3641 - RNA, 3375 nt, Artificial Sequence
  derived and/or modified sequence opt1 from TIE2__Homo_sapiens__CCDS6519.1
auggacagccuggccucccucgugcugugcggcgucagccugcuccuguccgggaccguggagggcgccauggaccugauccucaucaacagccugccccugguguccgacgcggagaccagccucacgugcaucgccuccggguggcgcccgcacgagcccaucaccaucggccgggacuucgaggcccugaugaaccagcaccaggacccccuggaggucacccaggacgugacccgcgagugggccaagaagguggucuggaagcgggagaaggccagcaagaucaacggggcguacuucugcgagggccgcgugcggggcgaggccauccgcauccggacgaugaagaugcgccagcaggccuccuuccuccccgccacccugaccaugaccguggacaagggggacaacgucaacaucagcuucaagaaggugcugaucaaggaggaggacgcggugaucuacaagaacggcuccuucauccacagcgucccgcggcacgaggugcccgacauccucgaggugcaccucccccacgcccagccccaggacgccggggucuacuccgcccgcuacaucggcgggaaccuguucacgagcgccuucacccggcucaucgugcgccggugcgaggcgcagaaguggggcccggagugcaaccaccugugcaccgccugcaugaacaacggcgugugccacgaggacaccggggagugcaucugcccgcccggcuucauggggcgcacgugcgagaaggccugcgagcugcacaccuucggccggaccugcaaggagcgcugcuccggccaggaggggugcaagagcuacgucuucugccuccccgaccccuacggcugcuccugcgccaccggguggaagggccugcagugcaacgaggccugccaccccggguucuacggccccgacugcaagcugcggugcagcugcaacaacggcgagaugugcgaccgcuuccaggggugccucugcucccccggcuggcaggggcugcagugcgagcgggagggcauccagcgcaugacgccgaagaucguggaccugcccgaccacaucgaggugaacagcgggaaguucaaccccaucugcaaggcgagcggcuggccccucccgaccaacgaggagaugacccuggucaagcccgacggcaccgugcugcaccccaaggacuucaaccacacggaccacuucuccguggccaucuucaccauccaccggauccugcccccggacagcggggucugggugugcuccgucaacaccguggccggcaugguggagaagcccuucaacaucagcgucaaggugcugcccaagccccugaacgccccgaacgugaucgacaccgggcacaacuucgccgucaucaacaucuccagcgagcccuacuucggcgacgggcccaucaaguccaagaagcuccuguacaagccggugaaccacuacgaggcguggcagcacauccaggugacgaacgagaucgucacccugaacuaccucgagccccgcaccgaguacgagcugugcgugcagcuggugcgccggggcgagggcggggagggccaccccgggcccguccgccgguucaccacggccagcaucggccucccgccgccccgcggccugaaccugcuccccaagucccagaccacccugaaccugaccuggcagcccaucuuccccagcuccgaggacgacuucuacguggagguggagcggcgcagcguccagaaguccgaccagcagaacaucaaggugcccgggaaccucacgagcgugcugcugaacaaccuccacccccgggagcaguacgucgugcgcgcccgggugaacaccaaggcccagggcgagugguccgaggaccugaccgccuggacccugagcgacauccugccgccccagcccgagaacaucaagaucuccaacaucacgcacagcuccgcggucaucagcuggaccauccucgacggguacagcaucuccagcaucaccauccgcuacaaggugcagggcaagaacgaggaccagcacguggacgucaagaucaagaacgccaccaucacccaguaccagcugaaggggcuggagcccgagacggccuaccagguggacaucuucgccgagaacaacaucggcuccagcaacccggcguucucccacgagcucgugacccugcccgagagccaggcccccgccgaccugggcgggggcaagaugcuccugaucgccauccugggguccgccggcaugaccugccucaccguccugcuggcguuccucaucauccugcagcugaagcgggccaacgugcagcgccggauggcccaggccuuccagaacgugcgcgaggagcccgccguccaguucaacagcgggacgcucgcgcugaaccggaaggugaagaacaacccggaccccaccaucuaccccgugcuggacuggaacgacaucaaguuccaggacgucaucggcgagggcaacuucggccaggugcucaaggcccgcaucaagaaggacgggcugcggauggacgccgccaucaagcgcaugaaggaguacgccuccaaggacgaccaccgggacuucgcgggggagcuggaggugcucugcaagcugggccaccaccccaacaucaucaaccugcucggggccugcgagcaccgcggcuaccuguaccuggccaucgaguacgccccgcacggcaaccuccuggacuuccugcgcaagagccggguccucgagaccgaccccgcguucgccaucgccaacuccaccgccagcacgcuguccagccagcagcugcuccacuucgccgcggacguggcccgcgggauggacuaccugucccagaagcaguucauccaccgggaccuggccgcccgcaacauccucgugggcgagaacuacgucgccaagaucgcggacuucgggcugagccggggccaggagguguacgugaagaagaccauggggcgccugcccguccgguggauggccaucgagucccucaacuacagcguguacaccaccaacagcgacgugugguccuacggcguccugcugugggagaucgugagccucggcgggacgccguacugcggcaugaccugcgccgagcuguacgagaagcugccccagggguaccgccucgagaagccccugaacugcgacgacgagguguacgaccugaugcggcagugcuggcgcgagaagcccuacgagcggccguccuucgcccagauccucgucagccugaaccgcaugcuggaggagcggaagaccuacgugaacaccacgcucuacgagaaguucaccuacgccggcaucgacugcuccgcggaggaggccgccuga

SEQ ID NO: 3642 - RNA, 3375 nt, Artificial Sequence
  derived and/or modified sequence opt2 from TIE2__Homo_sapiens__CCDS6519.1
auggacucccucgccucccucguccucugcggcgucucccuccuccucuccggcaccgucgagggcgccauggaccucauccucaucaacucccucccccucgucuccgacgccgagaccucccucaccugcaucgccuccggcuggcgcccccacgagcccaucaccaucggccgcgacuucgaggcccucaugaaccagcaccaggacccccucgaggucacccaggacgucacccgcgagugggccaagaaggucgucuggaagcgcgagaaggccuccaagaucaacggcgccuacuucugcgagggccgcguccgcggcgaggccauccgcauccgcaccaugaagaugcgccagcaggccuccuuccuccccgccacccucaccaugaccgucgacaagggcgacaacgucaacaucuccuucaagaagguccucaucaaggaggaggacgccgucaucuacaagaacggcuccuucauccacuccgucccccgccacgagguccccgacauccucgagguccaccucccccacgcccagccccaggacgccggcgucuacuccgcccgcuacaucggcggcaaccucuucaccuccgccuucacccgccucaucguccgccgcugcgaggcccagaaguggggccccgagugcaaccaccucugcaccgccugcaugaacaacggcgucugccacgaggacaccggcgagugcaucugcccccccggcuucaugggccgcaccugcgagaaggccugcgagcuccacaccuucggccgcaccugcaaggagcgcugcuccggccaggagggcugcaaguccuacgucuucugccuccccgaccccuacggcugcuccugcgccaccggcuggaagggccuccagugcaacgaggccugccaccccggcuucuacggccccgacugcaagcuccgcugcuccugcaacaacggcgagaugugcgaccgcuuccagggcugccucugcucccccggcuggcagggccuccagugcgagcgcgagggcauccagcgcaugacccccaagaucgucgaccuccccgaccacaucgaggucaacuccggcaaguucaaccccaucugcaaggccuccggcuggccccuccccaccaacgaggagaugacccucgucaagcccgacggcaccguccuccaccccaaggacuucaaccacaccgaccacuucuccgucgccaucuucaccauccaccgcauccucccccccgacuccggcgucugggucugcuccgucaacaccgucgccggcauggucgagaagcccuucaacaucuccgucaagguccuccccaagccccucaacgcccccaacgucaucgacaccggccacaacuucgccgucaucaacaucuccuccgagcccuacuucggcgacggccccaucaaguccaagaagcuccucuacaagcccgucaaccacuacgaggccuggcagcacauccaggucaccaacgagaucgucacccucaacuaccucgagccccgcaccgaguacgagcucugcguccagcucguccgccgcggcgagggcggcgagggccaccccggccccguccgccgcuucaccaccgccuccaucggccucccccccccccgcggccucaaccuccuccccaagucccagaccacccucaaccucaccuggcagcccaucuuccccuccuccgaggacgacuucuacgucgaggucgagcgccgcuccguccagaaguccgaccagcagaacaucaagguccccggcaaccucaccuccguccuccucaacaaccuccacccccgcgagcaguacgucguccgcgcccgcgucaacaccaaggcccagggcgagugguccgaggaccucaccgccuggacccucuccgacauccuccccccccagcccgagaacaucaagaucuccaacaucacccacuccuccgccgucaucuccuggaccauccucgacggcuacuccaucuccuccaucaccauccgcuacaagguccagggcaagaacgaggaccagcacgucgacgucaagaucaagaacgccaccaucacccaguaccagcucaagggccucgagcccgagaccgccuaccaggucgacaucuucgccgagaacaacaucggcuccuccaaccccgccuucucccacgagcucgucacccuccccgagucccaggcccccgccgaccucggcggcggcaagaugcuccucaucgccauccucggcuccgccggcaugaccugccucaccguccuccucgccuuccucaucauccuccagcucaagcgcgccaacguccagcgccgcauggcccaggccuuccagaacguccgcgaggagcccgccguccaguucaacuccggcacccucgcccucaaccgcaaggucaagaacaaccccgaccccaccaucuaccccguccucgacuggaacgacaucaaguuccaggacgucaucggcgagggcaacuucggccagguccucaaggcccgcaucaagaaggacggccuccgcauggacgccgccaucaagcgcaugaaggaguacgccuccaaggacgaccaccgcgacuucgccggcgagcucgagguccucugcaagcucggccaccaccccaacaucaucaaccuccucggcgccugcgagcaccgcggcuaccucuaccucgccaucgaguacgccccccacggcaaccuccucgacuuccuccgcaagucccgcguccucgagaccgaccccgccuucgccaucgccaacuccaccgccuccacccucuccucccagcagcuccuccacuucgccgccgacgucgcccgcggcauggacuaccucucccagaagcaguucauccaccgcgaccucgccgcccgcaacauccucgucggcgagaacuacgucgccaagaucgccgacuucggccucucccgcggccaggaggucuacgucaagaagaccaugggccgccuccccguccgcuggauggccaucgagucccucaacuacuccgucuacaccaccaacuccgacgucugguccuacggcguccuccucugggagaucgucucccucggcggcacccccuacugcggcaugaccugcgccgagcucuacgagaagcucccccagggcuaccgccucgagaagccccucaacugcgacgacgaggucuacgaccucaugcgccagugcuggcgcgagaagcccuacgagcgccccuccuucgcccagauccucgucucccucaaccgcaugcucgaggagcgcaagaccuacgucaacaccacccucuacgagaaguucaccuacgccggcaucgacugcuccgccgaggaggccgccuga

SEQ ID NO: 3643 - RNA, 3375 nt, Artificial Sequence
  derived and/or modified sequence opt3 from TIE2__Homo_sapiens__CCDS6519.1
auggacagccuggccucccucgugcuuugcggcgucucucuguuguuaucagggaccguugagggagcuauggaucugauccuaauuaacagucucccccuggugagcgacgcagaaacaucccuuacuuguauagccucugguuggagaccucacgagccaaucacgauuggcagggauuucgaagcgcugaugaaucagcaucaagacccguuggagguaacccaggaugugacacgggaaugggcuaagaaagucguguggaagcgcgagaaagccucgaagaucaacggggcauacuuuugcgagggacgaguucguggcgaagccauuagaaucaggacuaugaaaaugcggcagcaggcuucauuccuccccgcaacccugacaaugaccguggacaagggugauaaugucaacaucagcuuuaagaaagugcugauaaaggaggaagacgccguaauuuauaaaaaugggaguuucauccacuccguuccucgccaugaggugccagauauucucgagguccacuuaccccaugcucaaccucaggacgccggaguguacucugcgagauauaucggcggcaaccuguuuacuagcgcauucacaaggcuuauagugcggcgcugugaagcccagaagugggggccagagugcaaucacuuguguaccgcuugcaugaacaauggagucugucacgaagauacgggugagugcauuugucccccuggcuuuauggggcgaacuugcgaaaaagccugugagcugcauaccuucggaagaacaugcaaggagaggugcuccggccaggaagguuguaagucauacguguuuugccuaccagacccguauggguguaguugcgcaacuggauggaaaggccuccaauguaacgaggcuugccaccccggcuucuacgggccugauuguaagcugcggugcagcuguaauaacggagaaaugugcgaccguuuucaggguugucuuugcucuccaggcuggcaggggcugcagugcgagcgcgaaggaauccaaagaaugacccccaaaauuguugacuugccugaucauaucgagguaaauuccggcaaguucaacccaaucuguaaagccucagguuggccccucccgacaaaugaggaaaugacccuggugaagccugacgggacggucuuacaccccaaagauuuuaaccacacugaccauuucagcguggcgauuuucacaauacacaggauccugccaccugauaguggcguuugggugugcucugucaacaccguggccggaaugguagagaagcccuuuaauauuuccguuaaggugcucccaaaaccccuuaacgcaccuaaugucaucgacacuggccauaacuucgcugugauaaauauuagcucggaaccauauuuuggggauggaccgaucaagucuaaaaagcuguuguacaaacccgucaaccacuacgaggccuggcagcauauccaggugacaaaugaaauuguuacccuaaacuaucuggagccucggacggaguacgaacucugugugcaacugguacgacgcggugagggcggggaaggacacccaggccccgucagaagguucaccacagcuuccaucggucuuccuccaccccgggggcugaauuugcucccgaagucacagacuacccugaacuuaacauggcagccuauuuuuccaaguagcgaggacgauuucuauguggagguugaacgcagauccgugcagaagucugaccaacagaauauaaaaguccccggcaaccugacuagcgugcuacucaauaaccugcacccuagggagcaguacguagugcgugcccggguuaauaccaaggcacagggagaauggucagaggaucuuacagccuggaccuugagugacauccugcccccacaaccugaaaacauuaaaaucuccaacaucacucauagcucugcugucauuucauggacgauacucgacggcuauaguaucagcuccauuacaauccgauacaaggugcaggggaaaaaugaggaucagcacguggacgucaagauuaagaacgcgaccaucacucaguaucaacugaaaggacuugagcccgaaaccgcauaccagguugauauauuugccgagaauaacaucgguucuucgaauccagcuuucagccaugaacuggugacauugccggagucccaggccccugcagaccucggcgggggaaagaugcuguuaauugccauccugggcucagcugguaugaccugccuaacugugcuccuggccuuucuuauuaucuugcagcugaaaagagcaaacguacaaaggcgcauggcgcaggcuuuccagaauguccgggaagaacccgccgugcaauuuaacagugggacacucgcacugaauagaaagguuaaaaacaauccagaucccacgauauacccuguguuagacuggaacgauauuaaguuccaggacgucaucggcgagggaaauuuuggccaggugcugaaggccaggauuaaaaaggaugggcuucgcauggacgcugccaucaaacgaaugaaggaauaugcaucuaaagaugaccaccgggauuucgcuggagaguuggaaguucucuguaagcugggccaccauccaaacauaaucaaucuacugggugccugcgagcaccguggguaccucuaucuggcgauugaauacgcuccccauggaaaccuuuuggacuuccugagaaaaagcaggguguuagagaccgacccugccuuugcaaucgccaacuccacugcuucaacacucagcucucagcaacugcuucacuucgccgcagauguagcgcgcggcauggacuaucugucccagaagcaguuuauucaucgggauuuggccgcuagaaauauccucgucggugagaacuacguggccaagauagcagacuucggccugaguagggggcaggaaguguaugucaaaaagaccaugggacgacuaccgguucgcuggauggcuauugagagccugaauuacucuguguacacaacuaacuccgauguauggucauauggcgugcuccugugggaaaucgucagucuugggggaaccccauacuguggcaugacgugcgccgaguuguaugagaaacugccccaagguuaccgguuagaaaagccucucaauugugacgaugagguguaugaccugaugagacagugcuggagggaaaaaccauacgagcgucccagcuuugcacagauccuuguuucgcugaaccgcaugcuagaggagcggaagaccuaugugaauacaacucucuacgagaaguucaccuacgccgggauugauuguuccgcugaagaggcggccuga

SEQ ID NO: 3644 - RNA, 3375 nt, Artificial Sequence
  derived and/or modified sequence opt4 from TIE2__Homo_sapiens__CCDS6519.1
auggacagccuggccagccuggugcugugcggcgugagccugcugcugagcggcaccguggagggcgccauggaccugauccugaucaacagccugccccuggugagcgacgccgagaccagccugaccugcaucgccagcggcuggagaccccacgagcccaucaccaucggcagagacuucgaggcccugaugaaccagcaccaggacccccuggaggugacccaggacgugaccagagagugggccaagaaggugguguggaagagagagaaggccagcaagaucaacggcgccuacuucugcgagggcagagugagaggcgaggccaucagaaucagaaccaugaagaugagacagcaggccagcuuccugcccgccacccugaccaugaccguggacaagggcgacaacgugaacaucagcuucaagaaggugcugaucaaggaggaggacgccgugaucuacaagaacggcagcuucauccacagcgugcccagacacgaggugcccgacauccuggaggugcaccugccccacgcccagccccaggacgccggcguguacagcgccagauacaucggcggcaaccuguucaccagcgccuucaccagacugaucgugagaagaugcgaggcccagaaguggggccccgagugcaaccaccugugcaccgccugcaugaacaacggcgugugccacgaggacaccggcgagugcaucugcccccccggcuucaugggcagaaccugcgagaaggccugcgagcugcacaccuucggcagaaccugcaaggagagaugcagcggccaggagggcugcaagagcuacguguucugccugcccgaccccuacggcugcagcugcgccaccggcuggaagggccugcagugcaacgaggccugccaccccggcuucuacggccccgacugcaagcugagaugcagcugcaacaacggcgagaugugcgacagauuccagggcugccugugcagccccggcuggcagggccugcagugcgagagagagggcauccagagaaugacccccaagaucguggaccugcccgaccacaucgaggugaacagcggcaaguucaaccccaucugcaaggccagcggcuggccccugcccaccaacgaggagaugacccuggugaagcccgacggcaccgugcugcaccccaaggacuucaaccacaccgaccacuucagcguggccaucuucaccauccacagaauccugccccccgacagcggcgugugggugugcagcgugaacaccguggccggcaugguggagaagcccuucaacaucagcgugaaggugcugcccaagccccugaacgcccccaacgugaucgacaccggccacaacuucgccgugaucaacaucagcagcgagcccuacuucggcgacggccccaucaagagcaagaagcugcuguacaagcccgugaaccacuacgaggccuggcagcacauccaggugaccaacgagaucgugacccugaacuaccuggagcccagaaccgaguacgagcugugcgugcagcuggugagaagaggcgagggcggcgagggccaccccggccccgugagaagauucaccaccgccagcaucggccugcccccccccagaggccugaaccugcugcccaagagccagaccacccugaaccugaccuggcagcccaucuuccccagcagcgaggacgacuucuacguggagguggagagaagaagcgugcagaagagcgaccagcagaacaucaaggugcccggcaaccugaccagcgugcugcugaacaaccugcaccccagagagcaguacguggugagagccagagugaacaccaaggcccagggcgaguggagcgaggaccugaccgccuggacccugagcgacauccugcccccccagcccgagaacaucaagaucagcaacaucacccacagcagcgccgugaucagcuggaccauccuggacggcuacagcaucagcagcaucaccaucagauacaaggugcagggcaagaacgaggaccagcacguggacgugaagaucaagaacgccaccaucacccaguaccagcugaagggccuggagcccgagaccgccuaccagguggacaucuucgccgagaacaacaucggcagcagcaaccccgccuucagccacgagcuggugacccugcccgagagccaggcccccgccgaccugggcggcggcaagaugcugcugaucgccauccugggcagcgccggcaugaccugccugaccgugcugcuggccuuccugaucauccugcagcugaagagagccaacgugcagagaagaauggcccaggccuuccagaacgugagagaggagcccgccgugcaguucaacagcggcacccuggcccugaacagaaaggugaagaacaaccccgaccccaccaucuaccccgugcuggacuggaacgacaucaaguuccaggacgugaucggcgagggcaacuucggccaggugcugaaggccagaaucaagaaggacggccugagaauggacgccgccaucaagagaaugaaggaguacgccagcaaggacgaccacagagacuucgccggcgagcuggaggugcugugcaagcugggccaccaccccaacaucaucaaccugcugggcgccugcgagcacagaggcuaccuguaccuggccaucgaguacgccccccacggcaaccugcuggacuuccugagaaagagcagagugcuggagaccgaccccgccuucgccaucgccaacagcaccgccagcacccugagcagccagcagcugcugcacuucgccgccgacguggccagaggcauggacuaccugagccagaagcaguucauccacagagaccuggccgccagaaacauccuggugggcgagaacuacguggccaagaucgccgacuucggccugagcagaggccaggagguguacgugaagaagaccaugggcagacugcccgugagauggauggccaucgagagccugaacuacagcguguacaccaccaacagcgacguguggagcuacggcgugcugcugugggagaucgugagccugggcggcacccccuacugcggcaugaccugcgccgagcuguacgagaagcugccccagggcuacagacuggagaagccccugaacugcgacgacgagguguacgaccugaugagacagugcuggagagagaagcccuacgagagacccagcuucgcccagauccuggugagccugaacagaaugcuggaggagagaaagaccuacgugaacaccacccuguacgagaaguucaccuacgccggcaucgacugcagcgccgaggaggccgccuga

SEQ ID NO: 3645 - RNA, 3375 nt, Artificial Sequence
  derived and/or modified sequence opt5 from TIE2__Homo_sapiens__CCDS6519.1
auggacagccuggccucccucgugcugugcggcgucucucuucugcucagcgggaccguugagggagcuauggaucugauccuuauuaacucccugccccucgugucugacgccgaaacaagccugacguguaucgcguccggcuggagaccucacgagccgauuaccaucgggcgggauuucgaagcucugaugaaucagcaucaagacccccucgaggugacacaggaugucacccgcgaaugggccaagaaagugguuuggaagagagagaaagccucuaagauuaacggagcuuacuuuugcgagggccgggugcgcggggaagccaucagaauccggacaaugaaaaugcgccagcaggcuagcuuccugccugccacccuuacaaugaccgucgacaagggagauaaugugaacauuuccuuuaagaaaguucugaucaaggaggaagacgcggugauuuauaaaaauggcagcuucauccacucuguccccagacaugaggugccugauauucucgaggugcaucugccccacgcccaaccucaggacgcuggcgucuacuccgcccgguauaucgggggaaaccuuuuuacgagcgcuuucacccgccugauuguuagacggugugaagcccagaaguggggcccggagugcaaucaccucuguacagcgugcaugaacaauggggugugucacgaagauaccggagagugcaucugucccccuggcuuuauggggcgcacaugcgaaaaagccugugagcugcauaccuucggaagaacgugcaaggagcggugcucuggccaggaaggcuguaaguccuacguguuuugccugcccgacccuuauggguguagcugcgcuacaggauggaaaggccuccaauguaacgaggccugccaccccggguucuacggaccggauuguaagcugcgcugcucuuguaauaacggcgaaaugugcgacagauuucaggggugucuuugcuccccuggauggcagggccugcagugcgagcgggaaggcauccaaagaaugacccccaaaauugucgaccucccugaucauaucgaggugaauagcgggaaguucaaccccauuuguaaggcuuccggauggccccugccuacaaaugaggaaaugacccuuguuaaaccggacggcaccgugcugcaccccaaagauuuuaaccacacagaccauuucucugucgccaucuucacgauucaccgcauccucccucccgauagcgggguguggguuugcuccgugaacaccgucgccggaaugguggagaagccuuuuaauaucagcgucaaggugcugcccaaaccgcugaacgcuccuaauguuauugacacaggccauaacuucgcggugaucaauauuucuuccgaacccuauuuuggggauggcccuaucaagagcaaaaagcuccuguacaaacccgucaaccacuacgaggccuggcagcauauucaggugaccaaugaaaucguuacacuuaacuaucuggagccucggaccgaguacgaacucugugugcaacuggucagacgcggagagggcggggaaggacaccccggcccggugcggagauucacgacagcuucuaucgggcuuccuccuccccgcggacugaaucuccugcccaagagccagaccacccugaaccucacauggcagccgauuuuucccuccucugaggacgauuucuauguggagguugaacggagaagcguccagaaguccgaccaacagaauaucaaagugccuggcaaccugaccagcgugcuucugaauaaccuccacccccgcgagcaguacgucgugcgggccagaguuaauacaaaggcccagggggaauggucugaggaucugacggcuuggacccuguccgacauucuuccuccccaaccugaaaacaucaaaauuagcaacaucacacauucuuccgccgugauuagcuggaccauccucgacggcuauuccaucucuagcauuacaauccgcuacaagguccagggcaaaaaugaggaucagcacguggacguuaagauuaagaacgcgaccaucacgcaguaucaacugaaaggacuggagcccgaaaccgcuuaccagguggauauuuuugccgagaauaacaucggguccucuaauccggccuucagccaugaacucgucacacugccugagucccaggcucccgccgaccuuggaggcgggaagaugcugcucaucgcuauucugggaagcgccggcaugaccugccugacagugcuucucgcguuucugaucauucugcagcucaaacgggccaacguucaaagacggauggcucaggccuuccagaaugugcgcgaggaaccugcuguccaauuuaacucugggacccuggcccuuaauagaaaggugaaaaacaaucccgauccgacgaucuacccugugcuggacuggaacgauauuaaguuccaggacgucaucggcgagggaaauuuuggccagguucucaaggcgcggaucaaaaaggaugggcugagaauggacgccgcuauuaaacgcaugaaggaauaugccuccaaagaugaccaccgggauuucgcuggagagcuggaagugcuuuguaagcucggccaccaucccaacaucauuaaucugcugggggccugcgagcacagaggauaccucuaucuggccaucgaauacgcuccucauggcaaccuucuggacuuccuccgcaaaagcagagugcuggagacagaccccgcguuugccauugcuaacucuaccgccuccacacugagcucucagcaacuucuccacuucgccgcugaugucgcccgggggauggacuaucugagccagaagcaguuuauccaucgcgaucuggcggcuagaaauauccucgugggcgagaacuacguugccaagauugccgacuucggacugucccggggccaggaaguguaugucaaaaagaccauggggcgccuucccgugagauggauggcuaucgagagccugaauuacucuguuuacaccacaaacuccgauguguggagcuauggaguccuccugugggaaauugugucccugggcgggacgccuuacuguggaaugaccugcgccgagcuuuaugagaaacugccgcaaggcuaccggcucgaaaagccccugaauugugacgaugagguuuaugaccucaugcgccagugcuggagagaaaaaccuuacgagcggcccucuuuugcgcagauccuggugagccuuaaccgcaugcuggaagagagaaagacauaugucaauaccacacucuacgagaaguucaccuacgcuggcauugauuguuccgccgaagaggccgcuuga

SEQ ID NO: 3646 - protein, 596 aa, Artificial Sequence
  TKTL1__Homo_sapiens__P51854
MADAEARAEFPEEARPDRGTLQVLQDMASRLRIHSIRATCSTSSGHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 3647 - RNA, 1791 nt, Artificial Sequence
  TKTL1__Homo_sapiens__BAF84950
auggcggaugcugaggcgagggcugaguucccggaggaggccagaccugacaggggcaccuugcagguguugcaagauauggccagccgcuugcgaauccauuccaucagggccacaugcuccacgagcuccggccacccuacaucauguagcaguucuucugagaucaugucugugcuguucuucuacaucaugagguacaagcagucagauccagagaauccggacaacgaccgauuuguccucgcaaagagacugucguuuguggauguggcaacaggauggcucggacaaggacugggaguugcauguggaauggcauauacuggcaaguacuucgacagggccagcuaccggguguucugccucaugagugauggcgaguccucagaaggcucugucugggaggcaauggccuuugcuuccuacuacagucuggacaaucuuguggcaaucuuugaugugaaccgccugggacacaguggugcauugcccgccgagcacugcauaaacaucuaucagaggcgcugcgaagccuuuggguggaacacuuaugugguggacggccgggacguggaggcacugugccagguauucuggcaggcuucucaggugaagcacaagcccacugcugugguggccaagaccuucaagggccggggcaccccaaguauugaggaugcagaaaguuggcaugcaaagccaaugccgagagaaagagcagaugccauuaucaaauuaauugagagccagauacagaccagcaggaaucuugacccacagccccccauugaggacucaccugaagucaacaucacagauguaaggaugaccucuccaccugauuacagaguuggugacaagauagcuacucggaaagcaugcggucuggcucuggcuaagcugggcuacgcgaacaacagagucguugugcuggauggugacaccagguacucuacuuucucugagauauucaacaaggaguacccugagcgcuucaucgagugcuuuauggcugaacaaaacauggugagcguggcucugggcugugccucccguggacggaccauugcuuuugcuagcaccuuugcugccuuucugacucgagcauuugaucacauccggauaggaggccucgcugagagcaacaucaacauuauugguucccacugugggguaucuguuggugacgauggugcuucccagauggcccuggaggauauagccauguuccgaaccauucccaagugcacgaucuucuacccaacugaugccgucuccacggagcaugcuguugcucuggcagccaaugccaaggggaugugcuucauucggaccacccgaccagaaacuaugguuauuuacaccccacaagaacgcuuugagaucggacaggccaagguccuccgccacugugucagugacaaggucacaguuauuggagcuggaauuacuguguaugaagccuuagcagcugcugaugagcuuucgaaacaagauauuuuuauccgugucaucgaccuguuuaccauuaaaccucuggaugucgccaccaucgucuccagugcaaaagccacagagggccggaucauuacaguggaggaucacuacccgcaagguggcaucggggaagcugucugcgcagccgucuccauggauccugacauucagguucauucgcuggcagugucgggagugccccagagugggaaguccgaggaauugcuggauauguauggaauuagugccagacauaucauaguggccgugaaaugcauguugcugaacuaa

SEQ ID NO: 3648 - RNA, 1791 nt, Artificial Sequence
  derived and/or modified sequence opt1 from TKTL1__Homo_sapiens__BAF84950
auggccgacgccgaggcgcgcgccgaguuccccgaggaggcccggccggaccgcggcacccuccaggugcugcaggacauggccagccggcugcgcauccacuccauccgggcgaccugcagcacguccagcgggcaccccaccuccugcagcuccagcuccgagaucaugagcguccuguucuucuacaucaugcgcuacaagcaguccgaccccgagaaccccgacaacgaccgguucgugcucgccaagcgccugagcuucguggacgucgccaccggcuggcuggggcagggccucgggguggccugcggcauggccuacaccggcaaguacuucgaccgggcguccuaccgcguguucugccugaugagcgacggggaguccagcgagggcuccgucugggaggccauggccuucgccagcuacuacucccuggacaaccucguggccaucuucgacgugaaccggcuggggcacagcggcgcgcugccggccgagcacugcaucaacaucuaccagcgccggugcgaggccuucggguggaacacguacgucguggacggccgcgacguggaggcccucugccaggucuucuggcaggccagccaggugaagcacaagcccaccgcgguggucgccaagaccuucaagggccgggggacccccuccaucgaggacgccgagagcuggcacgccaagcccaugccgcgcgagcgggccgacgcgaucaucaagcugaucgagucccagauccagacgagccgcaaccuggacccccagccgcccaucgaggacucccccgaggugaacaucaccgacgugcggaugaccagcccgcccgacuaccgcgucggcgacaagaucgccacccggaaggccugcgggcucgcccuggccaagcugggcuacgcgaacaaccgcguggugguccucgacggcgacacgcgcuacuccaccuucagcgagaucuucaacaaggaguaccccgagcgguucaucgagugcuucauggccgagcagaacaugguguccguggcccuggggugcgccagccgcggccggaccaucgcguucgccuccaccuucgccgccuuccugacgcgcgccuucgaccacauccggaucgggggccucgcggagagcaacaucaacaucaucgggucccacugcggcgucagcgugggcgacgacggggccucccagauggcccuggaggacaucgccauguuccgcaccauccccaagugcaccaucuucuaccccaccgacgccgucagcacggagcacgcgguggcccuggccgccaacgccaagggcaugugcuucauccggaccacccgccccgagaccauggugaucuacacgccccaggagcgguucgagaucgggcaggcgaagguccuccgccacugcguguccgacaaggugaccgucaucggcgccgggaucaccguguacgaggcccuggccgcggccgacgagcugagcaagcaggacaucuucauccgggugaucgaccucuucaccaucaagccgcuggacgucgccacgaucguguccagcgccaaggccaccgagggccgcaucaucaccguggaggaccacuacccccagggcgggaucggcgaggcggucugcgccgccgugagcauggaccccgacauccaggugcacucccuggccgucagcggggugccccaguccggcaagagcgaggagcuccuggacauguacgggaucuccgcccggcacaucaucguggcggucaagugcaugcugcucaacuga

SEQ ID NO: 3649 - RNA, 1791 nt, Artificial Sequence
  derived and/or modified sequence opt2 from TKTL1__Homo_sapiens__BAF84950
auggccgacgccgaggcccgcgccgaguuccccgaggaggcccgccccgaccgcggcacccuccagguccuccaggacauggccucccgccuccgcauccacuccauccgcgccaccugcuccaccuccuccggccaccccaccuccugcuccuccuccuccgagaucauguccguccucuucuucuacaucaugcgcuacaagcaguccgaccccgagaaccccgacaacgaccgcuucguccucgccaagcgccucuccuucgucgacgucgccaccggcuggcucggccagggccucggcgucgccugcggcauggccuacaccggcaaguacuucgaccgcgccuccuaccgcgucuucugccucauguccgacggcgaguccuccgagggcuccgucugggaggccauggccuucgccuccuacuacucccucgacaaccucgucgccaucuucgacgucaaccgccucggccacuccggcgcccuccccgccgagcacugcaucaacaucuaccagcgccgcugcgaggccuucggcuggaacaccuacgucgucgacggccgcgacgucgaggcccucugccaggucuucuggcaggccucccaggucaagcacaagcccaccgccgucgucgccaagaccuucaagggccgcggcacccccuccaucgaggacgccgaguccuggcacgccaagcccaugccccgcgagcgcgccgacgccaucaucaagcucaucgagucccagauccagaccucccgcaaccucgacccccagccccccaucgaggacucccccgaggucaacaucaccgacguccgcaugaccuccccccccgacuaccgcgucggcgacaagaucgccacccgcaaggccugcggccucgcccucgccaagcucggcuacgccaacaaccgcgucgucguccucgacggcgacacccgcuacuccaccuucuccgagaucuucaacaaggaguaccccgagcgcuucaucgagugcuucauggccgagcagaacauggucuccgucgcccucggcugcgccucccgcggccgcaccaucgccuucgccuccaccuucgccgccuuccucacccgcgccuucgaccacauccgcaucggcggccucgccgaguccaacaucaacaucaucggcucccacugcggcgucuccgucggcgacgacggcgccucccagauggcccucgaggacaucgccauguuccgcaccauccccaagugcaccaucuucuaccccaccgacgccgucuccaccgagcacgccgucgcccucgccgccaacgccaagggcaugugcuucauccgcaccacccgccccgagaccauggucaucuacaccccccaggagcgcuucgagaucggccaggccaagguccuccgccacugcgucuccgacaaggucaccgucaucggcgccggcaucaccgucuacgaggcccucgccgccgccgacgagcucuccaagcaggacaucuucauccgcgucaucgaccucuucaccaucaagccccucgacgucgccaccaucgucuccuccgccaaggccaccgagggccgcaucaucaccgucgaggaccacuacccccagggcggcaucggcgaggccgucugcgccgccgucuccauggaccccgacauccagguccacucccucgccgucuccggcgucccccaguccggcaaguccgaggagcuccucgacauguacggcaucuccgcccgccacaucaucgucgccgucaagugcaugcuccucaacuga

SEQ ID NO: 3650 - RNA, 1791 nt, Artificial Sequence
  derived and/or modified sequence opt3 from TKTL1__Homo_sapiens__BAF84950
auggccgacgcugaggcaagagccgaguuccccgaggaagcgaggccugaucggggcacccuccaggugcugcaagacauggcuagccgccuucgaauccacuccauucgugccacaugcucuacuucaagugggcauccaacgagcuguuccucuucgucagagauaaugagcguccuguuuuucuacaucaugagauauaagcagagugauccggaaaaccccgacaaugauagguuuguuuuggcaaaacgguuauccuucguggacguagccaccggauggcugggucagggccuagggguggcuugcggaauggcauacacaggcaaguauuuugaucgcgccucuuacagagucuucugucucaugagcgacggugaguccucagaggggagugugugggaagcuauggccuuugcgagcuauuacucucuggauaaccuuguugcaauuuucgacgugaauaggcugggacacuccggcgccuugccugcugagcauugcaucaacauuuaucagcggcgcugugaagccuuuggcuggaauacuuacgucguggaugggcgagacguagaggcacucugccaaguuuucuggcaggcuucacaggugaaacacaagccaaccgccgucguggcgaaaacauuuaagggaagagguacccccagcaucgaggaugccgaaaguuggcaugcaaagccuaugccaagggagcgggcugacgccauaaucaaacugauugaaucucagauccaaacuucccguaaccuggacccccagccuccaauugaggauagcccggaagugaauaucacagacguccgcaugaccucgcccccugauuacagaguuggcgacaagauagcuacgaggaaagccugugggcucgcauuagccaagcugggauaugcuaacaaucgggugguagugcuugauggcgacacucgauacucuaccuucuccgagauuuuuaacaaagaguauccagaacgcuucaucgagugcuucauggcggaacagaauauggucucaguggcauuggguugugccaguagagggaggacaauugcuuuugccagcacuuucgcagccuuucugacccgggcuuucgaucacauccgcaucggaggccuagccgaguccaacauuaauauaaucggcucucacugcgggguuagcgugggagacgauggugcaucacagauggcgcucgaagacauugcuauguuuagaacaauccccaaguguaccauauucuacccuacggaugccgucaguacugagcaugcaguggcccuggcugccaacgcaaagggcaugugcuuuauuaggacaacccguccagagacuaugguaaucuauacaccccaagaacgguucgagaucgggcaggcuaaaguucuucgacacugcguguccgacaaggucaccgugauuggagccggcaucacggucuacgaagcgcuggccgcugcagacgaguugagcaaacaggauauuuuuauaagagugaucgaccucuucaccauuaagccgcuggauguugccacaaucgugucuucagcuaaagccacugaagguaggaucauuaccguagaggaccauuauccucaagggggcauaggagaggcagucugugcggccgugaguauggaucccgacauccagguucacagcuuagcuguguccggcgucccacagucugggaagucggaagaacugcucgauauguacggaauuagcgcccgccacaucauuguggcaguaaaaugcaugcuucugaauuga

SEQ ID NO: 3651 - RNA, 1791 nt, Artificial Sequence
  derived and/or modified sequence opt4 from TKTL1__Homo_sapiens__BAF84950
auggccgacgccgaggccagagccgaguuccccgaggaggccagacccgacagaggcacccugcaggugcugcaggacauggccagcagacugagaauccacagcaucagagccaccugcagcaccagcagcggccaccccaccagcugcagcagcagcagcgagaucaugagcgugcuguucuucuacaucaugagauacaagcagagcgaccccgagaaccccgacaacgacagauucgugcuggccaagagacugagcuucguggacguggccaccggcuggcugggccagggccugggcguggccugcggcauggccuacaccggcaaguacuucgacagagccagcuacagaguguucugccugaugagcgacggcgagagcagcgagggcagcgugugggaggccauggccuucgccagcuacuacagccuggacaaccugguggccaucuucgacgugaacagacugggccacagcggcgcccugcccgccgagcacugcaucaacaucuaccagagaagaugcgaggccuucggcuggaacaccuacgugguggacggcagagacguggaggcccugugccagguguucuggcaggccagccaggugaagcacaagcccaccgccgugguggccaagaccuucaagggcagaggcacccccagcaucgaggacgccgagagcuggcacgccaagcccaugcccagagagagagccgacgccaucaucaagcugaucgagagccagauccagaccagcagaaaccuggacccccagccccccaucgaggacagccccgaggugaacaucaccgacgugagaaugaccagcccccccgacuacagagugggcgacaagaucgccaccagaaaggccugcggccuggcccuggccaagcugggcuacgccaacaacagagugguggugcuggacggcgacaccagauacagcaccuucagcgagaucuucaacaaggaguaccccgagagauucaucgagugcuucauggccgagcagaacauggugagcguggcccugggcugcgccagcagaggcagaaccaucgccuucgccagcaccuucgccgccuuccugaccagagccuucgaccacaucagaaucggcggccuggccgagagcaacaucaacaucaucggcagccacugcggcgugagcgugggcgacgacggcgccagccagauggcccuggaggacaucgccauguucagaaccauccccaagugcaccaucuucuaccccaccgacgccgugagcaccgagcacgccguggcccuggccgccaacgccaagggcaugugcuucaucagaaccaccagacccgagaccauggugaucuacaccccccaggagagauucgagaucggccaggccaaggugcugagacacugcgugagcgacaaggugaccgugaucggcgccggcaucaccguguacgaggcccuggccgccgccgacgagcugagcaagcaggacaucuucaucagagugaucgaccuguucaccaucaagccccuggacguggccaccaucgugagcagcgccaaggccaccgagggcagaaucaucaccguggaggaccacuacccccagggcggcaucggcgaggccgugugcgccgccgugagcauggaccccgacauccaggugcacagccuggccgugagcggcgugccccagagcggcaagagcgaggagcugcuggacauguacggcaucagcgccagacacaucaucguggccgugaagugcaugcugcugaacuga

SEQ ID NO: 3652 - RNA, 1791 nt, Artificial Sequence
  derived and/or modified sequence opt5 from TKTL1__Homo_sapiens__BAF84950
auggccgacgcugaggccagagcggaauuucccgaggaagcucggccugaucgcggcacccuucaggugcuccaagacauggccagcagacugcggauccacuccauucgcgccacaugcucuacgagcuccgggcauccgaccucuuguagcuccucuagcgagaucauguccguccuuuucuucuacauuaugagauauaagcagagcgaucccgaaaacccugacaaugaucgguuuguucuggcuaaacgccucucuuucguggacguggccacaggauggcugggccaggggcuuggagucgcuugcggcauggccuacaccgggaaguauuuugauagagcguccuaccggguguucugucugaugagcgacggagagucuuccgagggcagcguuugggaagccauggcuuuugccucuuauuacucccucgauaaccugguggcuaucuucgacgucaaucgccugggccacagcggggcccuccccgcggagcauugcauuaacaucuaucagagacggugugaagccuuuggauggaauacauacgugguugauggccgcgacguggaggcucugugccaagucuucuggcaggccucccaggugaaacacaagccuaccgcuguggucgccaaaacauuuaaggggagaggaacccccucuaucgaggaugccgaaagcuggcaugcuaagccuaugccgcgggagcgcgcggacgccauuaucaaacuuauugaaucccagauccaaacgagcagaaaccuggacccccagccucccauugaggauucuccugaaguuaauaucaccgacgugcggaugacauccccgcccgauuacagagugggcgacaagauugcuacccgcaaagccugugggcucgcccuggcuaagcugggauaugccaacaaucgggucgugguucuggauggcgacacaagauacagcaccuucucugagaucuuuaacaaagaguauccugaacgcuucaucgagugcuucauggcggaacagaauauggugagcgucgcucucggcugugccucccgggggagaacgauugccuuugcuucuacauucgccgcuuuucugacccgcgccuucgaucacauccggauuggaggccuggcggagagcaacaucaauauuaucgggucccacugcggagugagcguuggcgacgauggggccucucagauggcucucgaagacaucgccauguuuagaacaauucccaaguguaccaucuucuacccuaccgaugcuguguccacagagcaugccgucgcgcuggccgcuaacgccaagggaaugugcuuuauucgcacgacccggcccgagacaauggugaucuauacaccccaagaaagauucgagauuggccaggcuaaaguccuucgccacugcgugagcgacaagguuaccgugaucggcgccgggaucaccgucuacgaagcccuggcugcggccgacgagcucucuaaacaggauauuuuuauccgggugauugaccuguucacgaucaagccucuugauguugcuacaauuguguccagcgccaaagccaccgaaggaagaaucauuaccgucgaggaccauuauccgcaaggcgggaucggagaggcugugugugccgcgguguccauggaucccgacauccagguucacucucuggcugucagcggcgugccucaguccgggaagucugaggaacuccuggauauguacggcauuagcgcccggcacaucauuguggccgucaaaugcaugcugcucaauuga

SEQ ID NO: 3653 - protein, 286 aa, Artificial Sequence
  TPI/m__Homo_sapiens__P60174
MAEDGEEAEFHFAALYISGQWPRLRADTDLQRLGSSAMAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 3654 - RNA, 861 nt, Artificial Sequence
  TPI/m__Homo_sapiens__EAW88722
auggcggaggacggcgaggaggcggaguuccacuucgcggcgcucuauauaagugggcaguggccgcgacugcgcgcagacacugaccuucagcgccucggcuccagcgccauggcgcccuccaggaaguucuucguugggggaaacuggaagaugaacgggcggaagcagagucugggggagcucaucggcacucugaacgcggccaaggugccggccgacaccgaggugguuugugcucccccuacugccuauaucgacuucgcccggcagaagcuagaucccaagauugcuguggcugcgcagaacugcuacaaagugacuaauggggcuuuuacuggggagaucagcccuggcaugaucaaagacugcggagccacgugggugguccuggggcacucagagagaaggcaugucuuuggggagucagaugagcugauugggcagaaaguggcccaugcucuggcagagggacucggaguaaucgccugcauuggggagaagcuagaugaaagggaagcuggcaucacugagaagguuguuuucgagcagacaaaggucaucgcagauaacgugaaggacuggagcaaggucguccuggccuaugagccugugugggccauugguacuggcaagacugcaacaccccaacaggcccaggaaguacacgagaagcuccgaggauggcugaaguccaacgucucugaugcgguggcucagagcacccguaucauuuauggaggcucugugacuggggcaaccugcaaggagcuggccagccagccugauguggauggcuuccuuguggguggugcuucccucaagcccgaauucguggacaucaucaaugccaaacaauga

SEQ ID NO: 3655 - RNA, 861 nt, Artificial Sequence
  derived and/or modified sequence opt1 from TPI/m__Homo_sapiens__EAW88722
auggccgaggacggcgaggaggccgaguuccacuucgcggcccuguacaucagcgggcaguggccccgccuccgggccgacaccgaccugcagcgccugggcuccagcgccauggccccgucccggaaguucuucgucgggggcaacuggaagaugaacgggcgcaagcagagccucggcgagcugaucggcacccugaacgcggccaaggugcccgccgacacggagguggugugcgccccgcccaccgcguacaucgacuucgcccggcagaagcucgaccccaagaucgccgucgccgcccagaacugcuacaaggugaccaacggggcguucaccggcgagaucucccccgggaugaucaaggacugcggcgccacgugggugguccuggggcacagcgagcgccggcacguguucggcgaguccgacgagcugaucggccagaagguggcccacgcccucgccgaggggcugggcgucaucgcgugcaucggggagaagcuggacgagcgcgaggccggcaucaccgagaaggugguguucgagcagaccaaggucaucgccgacaacgugaaggacuggagcaaggugguccucgccuacgagcccgugugggccaucggcaccgggaagacggcgaccccgcagcaggcccaggaggugcacgagaagcugcggggcuggcugaaguccaacgucagcgacgccguggcccaguccacccgcaucaucuacgggggcagcgugaccggggccacgugcaaggagcucgcgucccagcccgacgucgacggcuuccuggugggcggggccagccugaagcccgaguucguggacaucaucaacgccaagcaguga

SEQ ID NO: 3656 - RNA, 861 nt, Artificial Sequence
  derived and/or modified sequence opt2 from TPI/m__Homo_sapiens__EAW88722
auggccgaggacggcgaggaggccgaguuccacuucgccgcccucuacaucuccggccaguggccccgccuccgcgccgacaccgaccuccagcgccucggcuccuccgccauggcccccucccgcaaguucuucgucggcggcaacuggaagaugaacggccgcaagcagucccucggcgagcucaucggcacccucaacgccgccaagguccccgccgacaccgaggucgucugcgccccccccaccgccuacaucgacuucgcccgccagaagcucgaccccaagaucgccgucgccgcccagaacugcuacaaggucaccaacggcgccuucaccggcgagaucucccccggcaugaucaaggacugcggcgccaccugggucguccucggccacuccgagcgccgccacgucuucggcgaguccgacgagcucaucggccagaaggucgcccacgcccucgccgagggccucggcgucaucgccugcaucggcgagaagcucgacgagcgcgaggccggcaucaccgagaaggucgucuucgagcagaccaaggucaucgccgacaacgucaaggacugguccaaggucguccucgccuacgagcccgucugggccaucggcaccggcaagaccgccaccccccagcaggcccaggagguccacgagaagcuccgcggcuggcucaaguccaacgucuccgacgccgucgcccaguccacccgcaucaucuacggcggcuccgucaccggcgccaccugcaaggagcucgccucccagcccgacgucgacggcuuccucgucggcggcgccucccucaagcccgaguucgucgacaucaucaacgccaagcaguga

SEQ ID NO: 3657 - RNA, 861 nt, Artificial Sequence
  derived and/or modified sequence opt3 from TPI/m__Homo_sapiens__EAW88722
auggccgaggacggcgaagaggcugaguuccacuuugcagcccuguacaucagcgggcaguggcccagacucagggcggauaccgaccuucaacggcugggauccucugcuauggccccuucacgcaaguucuuuguggguggcaacuggaaaaugaaugggcgaaagcagaguuugggagaauuaauuggcacacugaacgcagccaaagucccagcugauacugaaguugugugcgcaccgcccacggccuauauagacuucgcucgucagaagcuagauccuaaaaucgccguagcggcacagaauuguuacaaggugaccaacggugccuuuacaggggagauuagcccaggaaugaucaaggacugcggcgcuacuugggucgugcucggccauuccgagagaaggcacguuuucggggaaucugaugagcugauuggacaaaaaguggcccaugcacuugcugaaggucugggcgucaucgccuguauaggggagaaguuggacgagcgggaagcgggaaucaccgagaaagugguauuugaacagacaaagguuauugccgauaaugugaaagacuggucgaaggucgugcucgcauaugagcccgugugggcuaucggcaccgguaagacugccacaccucagcaggcucaagaaguccacgagaaacugcgcggguggcugaagucaaacguuagcgaugccguggcacagaguaccagaauuaucuacggaggcuccguaacgggcgccacuugcaaagagcucgcuucucagccagacguggauggguucuuagucggaggugcgagccugaagcccgaauuuguggacauaauuaaugcaaaacaguga

SEQ ID NO: 3658 - RNA, 861 nt, Artificial Sequence
  derived and/or modified sequence opt4 from TPI/m__Homo_sapiens__EAW88722
auggccgaggacggcgaggaggccgaguuccacuucgccgcccuguacaucagcggccaguggcccagacugagagccgacaccgaccugcagagacugggcagcagcgccauggcccccagcagaaaguucuucgugggcggcaacuggaagaugaacggcagaaagcagagccugggcgagcugaucggcacccugaacgccgccaaggugcccgccgacaccgagguggugugcgccccccccaccgccuacaucgacuucgccagacagaagcuggaccccaagaucgccguggccgcccagaacugcuacaaggugaccaacggcgccuucaccggcgagaucagccccggcaugaucaaggacugcggcgccaccuggguggugcugggccacagcgagagaagacacguguucggcgagagcgacgagcugaucggccagaagguggcccacgcccuggccgagggccugggcgugaucgccugcaucggcgagaagcuggacgagagagaggccggcaucaccgagaaggugguguucgagcagaccaaggugaucgccgacaacgugaaggacuggagcaagguggugcuggccuacgagcccgugugggccaucggcaccggcaagaccgccaccccccagcaggcccaggaggugcacgagaagcugagaggcuggcugaagagcaacgugagcgacgccguggcccagagcaccagaaucaucuacggcggcagcgugaccggcgccaccugcaaggagcuggccagccagcccgacguggacggcuuccuggugggcggcgccagccugaagcccgaguucguggacaucaucaacgccaagcaguga

SEQ ID NO: 3659 - RNA, 861 nt, Artificial Sequence
  derived and/or modified sequence opt5 from TPI/m__Homo_sapiens__EAW88722
auggccgaggacggcgaagaggcugaguuccacuuugccgcgcuguacaucagcgggcaguggcccagacuccgggcugauaccgaccugcaacgccuuggauccucugccauggccccuagcagaaaguucuuugugggcgggaacuggaaaaugaauggacggaagcagucccugggcgaacucauugggacacugaacgcugccaaagucccggcugauacggaaguugugugcgcgcccccuaccgccuauaucgacuucgcccgccagaagcuggaucccaaaauugcuguggccgcucagaauuguuacaaggucacaaacggagccuuuaccggcgagaucucuccuggcaugauuaaggacugcggggcgacaugggugguucugggacauagcgagagacggcacguguucggcgaauccgaugagcucaucgggcaaaaagucgcccaugcucuggccgaaggacugggcgugaucgcuuguauuggggagaagcucgacgagcgcgaagccggaaucaccgagaaaguuguguuugaacagacaaaggucauugccgauaaugugaaagacuggucuaaggugguccuggcuuaugagcccguuugggcgaucggcaccggcaagacggccaccccucagcaggcucaagaagugcacgagaaacuuagaggguggcuuaagagcaacguguccgaugccgucgcccagagcacacggauuaucuacggaggcucugugaccggggcuacaugcaaagagcucgccucccagccggacguugauggauuccuggugggcggggcgagccuuaagcccgaauuugucgacauuaucaaugcuaaacaguga

SEQ ID NO: 3660 - protein, 119 aa, Artificial Sequence
  TRGV11__Homo_sapiens__Q99601
MPLVVAVIFFSLWVFALGQLEQPEISISRPANKSAHISWKASIQGFSSKIIHWYWQKPNKGLEYLLHVFLTISAQDCSGGKTKKLEVSKNAHTSTSTLKIKFLEKEDEVVYHCACWIRH

SEQ ID NO: 3661 - RNA, 357 nt, Artificial Sequence
  TRGV11__Homo_sapiens__CAA72108
augccacugguaguagcuguuaucuucuucucccucuggguuuuugcacuugggcaguuggaacaaccugaaauaucuauuuccagaccagcaaauaagagugcccacauaucuuggaaggcauccauccaaggcuuuagcaguaaaaucauacacugguacuggcagaaaccaaacaaaggcuuagaauauuuauuacaugucuucuugacaaucucugcucaagauugcucaggugggaagacuaagaaacuugagguaaguaaaaaugcucacacuuccacuuccacuuugaaaauaaaguucuuagagaaagaagaugaggugguguaccacugugccugcuggauuaggcac

SEQ ID NO: 3662 - RNA, 357 nt, Artificial Sequence
  derived and/or modified sequence opt1 from TRGV11__Homo_sapiens__CAA72108
augccccugguggucgccgugaucuucuucagccucuggguguucgcccugggccagcuggagcagccggagaucuccaucagccgccccgcgaacaaguccgcccacaucagcuggaaggccuccauccagggguucagcuccaagaucauccacugguacuggcagaagcccaacaagggccucgaguaccugcugcacgucuuccucaccaucagcgcccaggacugcuccgggggcaagaccaagaagcuggaggugagcaagaacgcccacacguccaccagcacccugaagaucaaguuccucgagaaggaggacgagguggucuaccacugcgcgugcuggauccggcac

SEQ ID NO: 3663 - RNA, 357 nt, Artificial Sequence
  derived and/or modified sequence opt2 from TRGV11__Homo_sapiens__CAA72108
augccccucgucgucgccgucaucuucuucucccucugggucuucgcccucggccagcucgagcagcccgagaucuccaucucccgccccgccaacaaguccgcccacaucuccuggaaggccuccauccagggcuucuccuccaagaucauccacugguacuggcagaagcccaacaagggccucgaguaccuccuccacgucuuccucaccaucuccgcccaggacugcuccggcggcaagaccaagaagcucgaggucuccaagaacgcccacaccuccaccuccacccucaagaucaaguuccucgagaaggaggacgaggucgucuaccacugcgccugcuggauccgccac

SEQ ID NO: 3664 - RNA, 357 nt, Artificial Sequence
  derived and/or modified sequence opt3 from TRGV11__Homo_sapiens__CAA72108
augccccugguggucgccguuaucuucuuuagccucuggguguucgcucuuggccagcuggagcaaccugaaauuuccauaucuagaccagcaaacaagucagcccacaucaguuggaaagcgagcauucagggguuuuccucuaagaucauucauugguacuggcagaaaccgaauaagggauuggaguauuuacugcacguauuccuaaccaucucggcucaggacugcucagguggcaaaacaaagaagcucgaagugagcaaaaacgcccauacgaguacuuccacccugaagauaaaauuucuugagaaggaagaugaggucguguaccacugugcaugcuggaucaggcau

SEQ ID NO: 3665 - RNA, 357 nt, Artificial Sequence
  derived and/or modified sequence opt4 from TRGV11__Homo_sapiens__CAA72108
augccccuggugguggccgugaucuucuucagccuguggguguucgcccugggccagcuggagcagcccgagaucagcaucagcagacccgccaacaagagcgcccacaucagcuggaaggccagcauccagggcuucagcagcaagaucauccacugguacuggcagaagcccaacaagggccuggaguaccugcugcacguguuccugaccaucagcgcccaggacugcagcggcggcaagaccaagaagcuggaggugagcaagaacgcccacaccagcaccagcacccugaagaucaaguuccuggagaaggaggacgaggugguguaccacugcgccugcuggaucagacac

SEQ ID NO: 3666 - RNA, 357 nt, Artificial Sequence
  derived and/or modified sequence opt5 from TRGV11__Homo_sapiens__CAA72108
augccccugguggucgccguuaucuucuuuagccucuggguguucgcucugggccagcuugagcaaccugaaauuuccaucucuagaccggccaacaagagcgcgcacauuuccuggaaggcuucuauccagggguuuagcuccaaaauuauccauugguacuggcagaaacccaauaagggacuggaguaucuccugcacguguuccuuaccaucucugcccaggacugcagcggcgggaaaacaaagaagcuggaagucuccaaaaacgcccauacgagcaccucuacacucaagauuaaauuucuggagaaggaagaugaggugguuuaccacugugcuugcuggauccggcau

SEQ ID NO: 3667 - protein, 137 aa, Artificial Sequence
  TRGV9__Homo_sapiens__A4D1X2
MLSLLHTSTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVHSSRQFEPSHSINVY

SEQ ID NO: 3668 - RNA, 414 nt, Artificial Sequence
  TRGV9__Homo_sapiens__EAL23985
augcugucacugcuccacacaucaacgcuggcaguccuuggggcucuguguguauauggugcaggucaccuagagcaaccucaaauuuccaguacuaaaacgcugucaaaaacagcccgccuggaauguguggugucuggaauaacaauuucugcaacaucuguauauugguaucgagagagaccuggugaagucauacaguuccugguguccauuucauaugacggcacugucagaaaggaauccggcauuccgucaggcaaauuugagguggauaggauaccugaaacgucuacauccacucucaccauucacaauguagagaaacaggacauagcuaccuacuacugugccuugugggaggugcacagcagcagacaguuugagccaucccauucaauaaauguuuauuga

SEQ ID NO: 3669 - RNA, 414 nt, Artificial Sequence
  derived and/or modified sequence opt1 from TRGV9__Homo_sapiens__EAL23985
augcugagccuccugcacaccuccacccuggccgugcucggcgcccugugcgucuacggggcgggccaccuggagcagccccagaucagcuccacgaagacccucagcaagaccgcccgccuggagugcgugguguccgggaucaccaucagcgccacguccgucuacugguaccgggagcgcccgggcgaggugauccaguuccuggugagcaucuccuacgacgggaccguccggaaggagagcggcauccccuccggcaaguucgagguggaccgcauccccgagaccagcaccuccacgcucaccauccacaacguggagaagcaggacaucgccaccuacuacugcgcccugugggagguccacagcucccggcaguucgagcccagccacuccaucaacguguacuga

SEQ ID NO: 3670 - RNA, 414 nt, Artificial Sequence
  derived and/or modified sequence opt2 from TRGV9__Homo_sapiens__EAL23985
augcucucccuccuccacaccuccacccucgccguccucggcgcccucugcgucuacggcgccggccaccucgagcagccccagaucuccuccaccaagacccucuccaagaccgcccgccucgagugcgucgucuccggcaucaccaucuccgccaccuccgucuacugguaccgcgagcgccccggcgaggucauccaguuccucgucuccaucuccuacgacggcaccguccgcaaggaguccggcauccccuccggcaaguucgaggucgaccgcauccccgagaccuccaccuccacccucaccauccacaacgucgagaagcaggacaucgccaccuacuacugcgcccucugggagguccacuccucccgccaguucgagcccucccacuccaucaacgucuacuga

SEQ ID NO: 3671 - RNA, 414 nt, Artificial Sequence
  derived and/or modified sequence opt3 from TRGV9__Homo_sapiens__EAL23985
augcugagccuccuucacaccuccacacuggccguguugggcgcuuuaugcgucuacggggcaggacaucuggagcagccccaaaucucuucaacuaagacgcuaaguaaaaccgccagacucgaauguguugugagcgguauuacaauauccgcgacuucuguauauugguacagggagcggccuggcgaagugauccaguuccuggucucgauuucauaugacgggaccgugcgcaaggagagcggaaucccaaguggcaaauuugaaguugaucguauuccggagacauccaccucuacucuuacaauccacaacguggagaagcaggacauagcuaccuacuauugcgcccugugggaaguccauagcucccgacaguucgagcccucacacaguaucaauguguacuga

SEQ ID NO: 3672 - RNA, 414 nt, Artificial Sequence
  derived and/or modified sequence opt4 from TRGV9__Homo_sapiens__EAL23985
augcugagccugcugcacaccagcacccuggccgugcugggcgcccugugcguguacggcgccggccaccuggagcagccccagaucagcagcaccaagacccugagcaagaccgccagacuggagugcguggugagcggcaucaccaucagcgccaccagcguguacugguacagagagagacccggcgaggugauccaguuccuggugagcaucagcuacgacggcaccgugagaaaggagagcggcauccccagcggcaaguucgagguggacagaauccccgagaccagcaccagcacccugaccauccacaacguggagaagcaggacaucgccaccuacuacugcgcccugugggaggugcacagcagcagacaguucgagcccagccacagcaucaacguguacuga

SEQ ID NO: 3673 - RNA, 414 nt, Artificial Sequence
  derived and/or modified sequence opt5 from TRGV9__Homo_sapiens__EAL23985
augcugagccuccugcacaccuccacacuugccgugcugggcgcucucugcgucuacggggccggacaucuggagcagccccaaaucucuagcacgaagacccuuuccaaaacagcgagacuggaauguguugugucuggcauuaccaucagcgcuacauccguguauugguaccgggagcgcccuggggaagucauucaguuccucgugucuaucagcuaugacggaaccguuagaaaggaguccggcauuccgagcgggaaauuugaaguggaucggauccccgagacaucuaccuccacgcugaccauccacaacgucgagaagcaggacauugccacauacuauugcgcccugugggaagugcauagcucucgccaguucgagccuucccacagcaucaauguuuacuga

SEQ ID NO: 3674 - protein, 122 aa, Artificial Sequence
  TRGV9__Homo_sapiens__Q99603
MLSLLHTSTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEV

SEQ ID NO: 3675 - RNA, 366 nt, Artificial Sequence
  TRGV9__Homo_sapiens__CAA30181
augcugucacugcuccacacaucaacgcuggcaguccuuggggcucuguguguauauggugcaggucaccuagagcaaccucaaauuuccaguacuaaaacgcugucaaaaacagcccgccuggaauguguggugucuggaauaacaauuucugcaacaucuguauauugguaucgagagagaccuggugaagucauacaguuccugguguccauuucauaugacggcacugucagaaaggaauccggcauuccgucaggcaaauuugagguggauaggauaccugaaacgucuacauccacucucaccauucacaauguagagaaacaggacauagcuaccuacuacugugccuugugggaggug

SEQ ID NO: 3676 - RNA, 366 nt, Artificial Sequence
  derived and/or modified sequence opt1 from TRGV9__Homo_sapiens__CAA30181
augcugagccuccugcacaccuccacccuggccgugcucggcgcccugugcgucuacggggcgggccaccuggagcagccccagaucagcuccacgaagacccucagcaagaccgcccgccuggagugcgugguguccgggaucaccaucagcgccacguccgucuacugguaccgggagcgcccgggcgaggugauccaguuccuggugagcaucuccuacgacgggaccguccggaaggagagcggcauccccuccggcaaguucgagguggaccgcauccccgagaccagcaccuccacgcucaccauccacaacguggagaagcaggacaucgccaccuacuacugcgcccugugggagguc

SEQ ID NO: 3677 - RNA, 366 nt, Artificial Sequence
  derived and/or modified sequence opt2 from TRGV9__Homo_sapiens__CAA30181
augcucucccuccuccacaccuccacccucgccguccucggcgcccucugcgucuacggcgccggccaccucgagcagccccagaucuccuccaccaagacccucuccaagaccgcccgccucgagugcgucgucuccggcaucaccaucuccgccaccuccgucuacugguaccgcgagcgccccggcgaggucauccaguuccucgucuccaucuccuacgacggcaccguccgcaaggaguccggcauccccuccggcaaguucgaggucgaccgcauccccgagaccuccaccuccacccucaccauccacaacgucgagaagcaggacaucgccaccuacuacugcgcccucugggagguc

SEQ ID NO: 3678 - RNA, 366 nt, Artificial Sequence
  derived and/or modified sequence opt3 from TRGV9__Homo_sapiens__CAA30181
augcugagccuccuucacaccuccacacuggccguguugggcgcuuuaugcgucuacggggcaggacaucuggagcagccccaaaucucuucaacuaagacgcuaaguaaaaccgccagacucgaauguguugugagcgguauuacaauauccgcgacuucuguauauugguacagggagcggccuggcgaagugauccaguuccuggucucgauuucauaugacgggaccgugcgcaaggagagcggaaucccaaguggcaaauuugaaguugaucgaaucccggagacauccaccucuacucuuacaauucacaacguggagaagcaggacauagcuaccuacuauugcgcccugugggaaguc

SEQ ID NO: 3679 - RNA, 366 nt, Artificial Sequence
  derived and/or modified sequence opt4 from TRGV9__Homo_sapiens__CAA30181
augcugagccugcugcacaccagcacccuggccgugcugggcgcccugugcguguacggcgccggccaccuggagcagccccagaucagcagcaccaagacccugagcaagaccgccagacuggagugcguggugagcggcaucaccaucagcgccaccagcguguacugguacagagagagacccggcgaggugauccaguuccuggugagcaucagcuacgacggcaccgugagaaaggagagcggcauccccagcggcaaguucgagguggacagaauccccgagaccagcaccagcacccugaccauccacaacguggagaagcaggacaucgccaccuacuacugcgcccugugggaggug

SEQ ID NO: 3680 - RNA, 366 nt, Artificial Sequence
  derived and/or modified sequence opt5 from TRGV9__Homo_sapiens__CAA30181
augcugagccuccugcacaccuccacacuugccgugcugggcgcucucugcgucuacggggccggacaucuggagcagccccaaaucucuagcacgaagacccuuuccaaaacagcgagacuggaauguguugugucuggcauuaccaucagcgcuacauccguguauugguaccgggagcgcccuggggaagucauucaguuccucgugucuaucagcuaugacggaaccguuagaaaggaguccggcauuccgagcgggaaauuugaaguggaucggauccccgagacaucuaccuccacgcugaccauccacaacgucgagaagcaggacauugccacauacuauugcgcccugugggaagug

SEQ ID NO: 3681 - protein, 122 aa, Artificial Sequence
  TRGV9__Homo_sapiens__Q99604
MLSLLHTSTLAVLGALCVYGAGHLEQPQISSTKTLSKTARLECVVSGIKISATSVYWYRERPGEVIQFLVSISYDGTVRKESGIPSGKFEVDRIPETSTSTLTIHNVEKQDIATYYCALWEV

SEQ ID NO: 3682 - RNA, 366 nt, Artificial Sequence
  TRGV9__Homo_sapiens__CAA33345
augcugucacugcuccacacaucaacgcuggcaguccuuggggcucuguguguauauggugcaggucaccuagagcaaccucaaauuuccaguacuaaaacgcugucaaaaacagcccgccuggaauguguggugucuggaauaaaaauuucugcaacaucuguauauugguaucgagagagaccuggugaagucauacaguuccugguguccauuucauaugacggcacugucagaaaggaaucuggcauuccgucaggcaaauuugagguggauaggauaccugaaacgucuacauccacucucaccauucacaauguagagaaacaggacauagcuaccuacuacugugccuugugggaggug

SEQ ID NO: 3683 - RNA, 366 nt, Artificial Sequence
  derived and/or modified sequence opt1 from TRGV9__Homo_sapiens__CAA33345
augcugagccuccugcacaccuccacccuggccgugcucggcgcccugugcgucuacggggcgggccaccuggagcagccccagaucagcuccacgaagacccucagcaagaccgcccgccuggagugcgugguguccgggaucaagaucagcgccaccuccgucuacugguaccgggagcgcccgggcgaggugauccaguuccuggugagcaucuccuacgacgggacgguccggaaggagagcggcauccccuccggcaaguucgagguggaccgcauccccgagaccagcaccuccacccucacgauccacaacguggagaagcaggacaucgccaccuacuacugcgcccugugggagguc

SEQ ID NO: 3684 - RNA, 366 nt, Artificial Sequence
  derived and/or modified sequence opt2 from TRGV9__Homo_sapiens__CAA33345
augcucucccuccuccacaccuccacccucgccguccucggcgcccucugcgucuacggcgccggccaccucgagcagccccagaucuccuccaccaagacccucuccaagaccgcccgccucgagugcgucgucuccggcaucaagaucuccgccaccuccgucuacugguaccgcgagcgccccggcgaggucauccaguuccucgucuccaucuccuacgacggcaccguccgcaaggaguccggcauccccuccggcaaguucgaggucgaccgcauccccgagaccuccaccuccacccucaccauccacaacgucgagaagcaggacaucgccaccuacuacugcgcccucugggagguc

SEQ ID NO: 3685 - RNA, 366 nt, Artificial Sequence
  derived and/or modified sequence opt3 from TRGV9__Homo_sapiens__CAA33345
augcugagccuccuucacaccuccacacuggccguguugggcgcuuuaugcgucuacggggcaggacaucuggagcagccccaaaucucuucaacuaagacgcuaaguaaaaccgccagacucgaauguguugugagcgguauuaagauauccgcgacaucuguauauugguacagggagcggccuggcgaagugauccaguuccuggucucgauuucauaugacgggacugugcgcaaagagagcggaaucccaaguggcaaguuugaaguugaucgaaucccggagaccuccacaucuacccuuacuauucacaacguggagaaacaggacauagcuacauacuauugcgcccugugggaaguc

SEQ ID NO: 3686 - RNA, 366 nt, Artificial Sequence
  derived and/or modified sequence opt4 from TRGV9__Homo_sapiens__CAA33345
augcugagccugcugcacaccagcacccuggccgugcugggcgcccugugcguguacggcgccggccaccuggagcagccccagaucagcagcaccaagacccugagcaagaccgccagacuggagugcguggugagcggcaucaagaucagcgccaccagcguguacugguacagagagagacccggcgaggugauccaguuccuggugagcaucagcuacgacggcaccgugagaaaggagagcggcauccccagcggcaaguucgagguggacagaauccccgagaccagcaccagcacccugaccauccacaacguggagaagcaggacaucgccaccuacuacugcgcccugugggaggug

SEQ ID NO: 3687 - RNA, 366 nt, Artificial Sequence
  derived and/or modified sequence opt5 from TRGV9__Homo_sapiens__CAA33345
augcugagccuccugcacaccuccacacuugccgugcugggcgcucucugcgucuacggggccggacaucuggagcagccccaaaucucuagcacgaagacccuuuccaaaacagcgagacuggaauguguugugucuggcauuaagaucagcgcuaccuccguguauugguaccgggagcgcccuggggaagucauucaguuccucgugucuaucagcuaugacggaacaguuagaaaagaguccggcauuccgagcgggaaguuugaaguggaucggauccccgagaccucuacauccacccugacgauccacaacgucgagaaacaggacauugccaccuacuauugcgcccugugggaagug

SEQ ID NO: 3688 - protein, 793 aa, Artificial Sequence
  TRPC1__Homo_sapiens__P48995
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQSADALLVAIDSEVVGAVDILLNHRPKRSSRPTIVKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 3689 - RNA, 2382 nt, Artificial Sequence
  TRPC1__Homo_sapiens__AAA93251
augauggcggcccuguacccgagcacggaccucucgggcgccuccuccuccucccugccuuccucuccauccucuuccucgccgaacgaggugauggcgcugaaggaugugcgggaggugaaggaggagaauacgcugaaugagaagcuuuucuugcuggcgugcgacaagggugacuauuauaugguuaaaaagauuuuggaggaaaacaguucaggugacuugaacauaaauugcguagaugugcuugggagaaaugcuguuaccauaacuauugaaaacgaaaacuuggauauacugcagcuucuuuuggacuacgguugucagucugcagaugcacuuuugguggcaaucgacucugaaguagugggagcuguugauauacuacuuaaucaucgaccaaaacgaucaucaagaccaacuauaguaaaacuaauggaacgaauucagaauccugaguauucaacaacuauggauguugcaccugucauuuuagcugcucaucguaacaacuaugaaauucuuacaaugcucuuaaaacaggauguaucucuacccaagccccaugcaguuggcugugaaugcacauuguguucugcaaaaaacaaaaaggauagccuccggcauuccagguuucgucuugauauauaucgauguuuggccaguccagcucuaauaauguuaacagaggaggauccaauucugagagcauuugaacuuagugcugauuuaaaagaacuaagucuuguggagguggaauucaggaaugauuaugaggaacuagcccggcaauguaaaauguuugcuaaggauuuacuugcacaagcccggaauucucgugaauuggaaguuauucuaaaccauacgucuagugacgagccucuugacaaacggggauuauuagaagaaagaaugaauuuaagucgucuaaaacuugcuaucaaauauaaccagaaagaguuugucucccagucuaacugccagcaguuccugaacacuguuugguuuggacagaugucggguuaccgacgcaagcccaccuguaagaagauaaugacuguuuugacaguaggcaucuuuuggccaguuuugucacuuuguuauuugauagcucccaaaucucaguuuggcagaaucauucacacaccuuuuaugaaauuuaucauucauggagcaucauauuucacauuucugcuguugcuuaaucuauacucucuugucuacaaugaggauaagaaaaacacaauggggccagcccuugaaagaauagacuaucuucuuauucuguggauuauugggaugauuuggucagacauuaaaagacucugguaugaaggguuggaagacuuuuuagaagaaucucguaaucaacucaguuuugucaugaauucucuuuauuuggcaaccuuugcccucaaagugguugcucacaacaaguuucaugauuuugcugaucggaaggauugggaugcauuccauccuacacugguggcagaagggcuuuuugcauuugcaaauguucuaaguuaucuucgucucuuuuuuauguauacaaccagcucuaucuuggguccauuacagauuucaaugggacagauguuacaagauuuuggaaaauuucuugggauguuucuucuuguuuuguuuucuuucacaauuggacugacacaacuguaugauaaaggauauacuucaaaggagcagaaggacuguguaggcaucuucugugaacagcaaagcaaugauaccuuccauucguucauuggcaccugcuuugcuuuguucugguauauuuucuccuuagcgcauguggcaaucuuugucacaagauuuagcuauggagaagaacugcaguccuuugugggagcugucauuguugguacauacaaugucgugguugugauugugcuuaccaaacugcugguggcaaugcuucauaaaagcuuucaguugauagcaaaucaugaagacaaagaauggaaguuugcucgagcaaaauuauggcuuagcuacuuugaugacaaauguacguuaccuccaccuuucaacaucauucccucaccaaagacuaucugcuauaugauuaguagccucaguaaguggauuugcucucauacaucaaaaggcaaggucaaacggcaaaacaguuuaaaggaauggaggaauuugaaacagaagagagaugaaaacuaucaaaaagugaugugcugccuagugcaucguuacuugacuuccaugagacagaagaugcaaaguacagaucaggcaacuguggaaaaucuaaacgaacugcgccaagaucugucaaaauuccgaaaugaaauaagggauuuacuuggcuuucggacuucuaaauaugcuauguuuuauccaagaaauuaa

SEQ ID NO: 3690 - RNA, 2382 nt, Artificial Sequence
  derived and/or modified sequence opt1 from TRPC1__Homo_sapiens__AAA93251
augauggccgcccuguaccccagcaccgaccucuccggcgcgagcuccagcucccugccgagcucccccagcuccagcucccccaacgaggugauggcccugaaggacguccgcgaggugaaggaggagaacacccucaacgagaagcuguuccugcucgccugcgacaagggggacuacuacauggugaagaagauccuggaggagaacagcuccggcgaccugaacaucaacugcgucgacgugcucgggcggaacgccgugacgaucaccaucgagaacgagaaccuggacauccugcagcuccugcuggacuacggcugccagagcgccgacgcgcuccuggucgccaucgacuccgagguggugggggccgucgacauccugcucaaccaccgccccaagcggagcucccgcccgaccaucgugaagcugauggagcggauccagaaccccgaguacagcaccacgauggacguggcccccgucauccuggcggcccaccgcaacaacuacgagauccucaccaugcugcugaagcaggacgugucccuccccaagccgcacgccgugggcugcgagugcacccugugcagcgccaagaacaagaaggacagccugcggcacucccgcuuccggcucgacaucuaccgcugccuggccagccccgcgcugaucaugcucaccgaggaggaccccauccugcgggccuucgagcuguccgccgaccucaaggagcugagccuggucgagguggaguuccgcaacgacuacgaggagcucgcccggcagugcaagauguucgccaaggaccugcuggcgcaggcccgcaacucccgggagcucgaggugauccugaaccacacgagcuccgacgagccccuggacaagcgcggccuccuggaggagcggaugaaccugagccgccucaagcuggccaucaaguacaaccagaaggaguucgucucccagagcaacugccagcaguuccugaacaccgugugguucgggcagauguccggcuaccggcgcaagccgaccugcaagaagaucaugaccgugcucacggucgggaucuucuggcccgugcugagccugugcuaccugaucgcccccaagucccaguucggccggaucauccacacccccuucaugaaguucaucauccacggggccagcuacuucaccuuccuccugcugcucaaccuguacucccugguguacaacgaggacaagaagaacaccaugggcccggcgcucgagcgcaucgacuaccugcugauccucuggaucaucggcaugaucuggagcgacaucaagcgccugugguacgaggggcuggaggacuuccucgaggagucccggaaccagcugagcuucgucaugaacucccuguaccucgccacguucgcccugaagguggucgcccacaacaaguuccacgacuucgccgaccgcaaggacugggacgcguuccaccccacccugguggccgagggccucuucgccuucgccaacgugcugagcuaccugcgccucuucuucauguacaccaccagcuccauccuggggccccugcagaucagcaugggccagaugcuccaggacuucggcaaguuccuggggauguuccugcucguccuguucuccuucacgaucggccugacccagcucuacgacaagggguacaccagcaaggagcagaaggacugcgugggcaucuucugcgagcagcaguccaacgacaccuuccacagcuucaucgggacgugcuucgcgcuguucugguacaucuucucccuggcccacguggccaucuucgucacccgguucagcuacggcgaggagcuccaguccuucgugggcgccgugaucgucgggaccuacaacgugguggucgugaucgugcugaccaagcugcucgucgccaugcugcacaagagcuuccagcugaucgcgaaccacgaggacaaggaguggaaguucgcccgggccaagcucuggcuguccuacuucgacgacaagugcacgcugcccccgcccuucaacaucauccccagccccaagaccaucugcuacaugaucuccagccucuccaaguggaucugcagccacaccuccaagggcaaggugaagcgccagaacagccugaaggaguggcggaaccugaagcagaagcgcgacgagaacuaccagaaggugaugugcugccucguccaccgguaccugaccagcaugcgccagaagaugcaguccacggaccaggccaccguggagaaccugaacgagcuccggcaggaccugagcaaguuccgcaacgagauccgggaccugcucggguuccgcaccuccaaguacgccauguucuacccgcggaacuga

SEQ ID NO: 3691 - RNA, 2382 nt, Artificial Sequence
  derived and/or modified sequence opt2 from TRPC1__Homo_sapiens__AAA93251
augauggccgcccucuaccccuccaccgaccucuccggcgccuccuccuccucccuccccuccucccccuccuccuccucccccaacgaggucauggcccucaaggacguccgcgaggucaaggaggagaacacccucaacgagaagcucuuccuccucgccugcgacaagggcgacuacuacauggucaagaagauccucgaggagaacuccuccggcgaccucaacaucaacugcgucgacguccucggccgcaacgccgucaccaucaccaucgagaacgagaaccucgacauccuccagcuccuccucgacuacggcugccaguccgccgacgcccuccucgucgccaucgacuccgaggucgucggcgccgucgacauccuccucaaccaccgccccaagcgcuccucccgccccaccaucgucaagcucauggagcgcauccagaaccccgaguacuccaccaccauggacgucgcccccgucauccucgccgcccaccgcaacaacuacgagauccucaccaugcuccucaagcaggacgucucccuccccaagccccacgccgucggcugcgagugcacccucugcuccgccaagaacaagaaggacucccuccgccacucccgcuuccgccucgacaucuaccgcugccucgccucccccgcccucaucaugcucaccgaggaggaccccauccuccgcgccuucgagcucuccgccgaccucaaggagcucucccucgucgaggucgaguuccgcaacgacuacgaggagcucgcccgccagugcaagauguucgccaaggaccuccucgcccaggcccgcaacucccgcgagcucgaggucauccucaaccacaccuccuccgacgagccccucgacaagcgcggccuccucgaggagcgcaugaaccucucccgccucaagcucgccaucaaguacaaccagaaggaguucgucucccaguccaacugccagcaguuccucaacaccgucugguucggccagauguccggcuaccgccgcaagcccaccugcaagaagaucaugaccguccucaccgucggcaucuucuggcccguccucucccucugcuaccucaucgcccccaagucccaguucggccgcaucauccacacccccuucaugaaguucaucauccacggcgccuccuacuucaccuuccuccuccuccucaaccucuacucccucgucuacaacgaggacaagaagaacaccaugggccccgcccucgagcgcaucgacuaccuccucauccucuggaucaucggcaugaucugguccgacaucaagcgccucugguacgagggccucgaggacuuccucgaggagucccgcaaccagcucuccuucgucaugaacucccucuaccucgccaccuucgcccucaaggucgucgcccacaacaaguuccacgacuucgccgaccgcaaggacugggacgccuuccaccccacccucgucgccgagggccucuucgccuucgccaacguccucuccuaccuccgccucuucuucauguacaccaccuccuccauccucggcccccuccagaucuccaugggccagaugcuccaggacuucggcaaguuccucggcauguuccuccucguccucuucuccuucaccaucggccucacccagcucuacgacaagggcuacaccuccaaggagcagaaggacugcgucggcaucuucugcgagcagcaguccaacgacaccuuccacuccuucaucggcaccugcuucgcccucuucugguacaucuucucccucgcccacgucgccaucuucgucacccgcuucuccuacggcgaggagcuccaguccuucgucggcgccgucaucgucggcaccuacaacgucgucgucgucaucguccucaccaagcuccucgucgccaugcuccacaaguccuuccagcucaucgccaaccacgaggacaaggaguggaaguucgcccgcgccaagcucuggcucuccuacuucgacgacaagugcacccuccccccccccuucaacaucauccccucccccaagaccaucugcuacaugaucuccucccucuccaaguggaucugcucccacaccuccaagggcaaggucaagcgccagaacucccucaaggaguggcgcaaccucaagcagaagcgcgacgagaacuaccagaaggucaugugcugccucguccaccgcuaccucaccuccaugcgccagaagaugcaguccaccgaccaggccaccgucgagaaccucaacgagcuccgccaggaccucuccaaguuccgcaacgagauccgcgaccuccucggcuuccgcaccuccaaguacgccauguucuacccccgcaacuga

SEQ ID NO: 3692 - RNA, 2382 nt, Artificial Sequence
  derived and/or modified sequence opt3 from TRPC1__Homo_sapiens__AAA93251
augauggccgcucuguaccccagcaccgaccucuccggcgcaucuucaaguagccuuccuuccucuccaucgucaagcaguccgaacgaggugauggcccugaaggaugucagagaaguuaaagaggaaaauacauugaacgagaaguuauuccugcuagcgugcgacaaaggggauuauuacauggugaagaaaauccucgaagaaaauuccucuggagaccugaacauuaauuguguagaugugcuugguaggaacgcugucacuauaacgaucgagaaugaaaaccuggacauuuugcagcuccugcuggauuauggcugccaaagcgccgacgcacucuuaguggccaucgauuccgagguugugggggcugucgacauucugcuuaaucaccggcccaagcgcucaagucgaccuaccaucgugaaguugauggaacguauacagaacccagaguacagcacaacuauggauguagcacccguuauccuggccgcucauagaaauaacuaugagauucuaaccaugcuccugaaacaggacgugucucuuccuaagccacacgccgucggaugugaaugcacacuguguuccgcgaaaaauaagaaagauucauugaggcauagccgguuucgccucgacaucuacagaugccuggcaagucccgccuuaauuaugcugaccgaggaagacccuauccucagggcuuucgagcuuucugccgaucugaaggaauugucccuaguggagguggaguuucggaacgacuaugaggagcuggcacgccaguguaagauguucgcuaaagaucuccuggcccaagcgcgaaauagcagagaacuugaggucauacugaaccacacuucgucugacgaaccauuggauaagaggggccuccuggaggagcggaugaacuuaucccgucugaaacuagccauuaaguacaaucagaaagaauuuguuucacagaguaacugccagcaauuccucaauacagugugguuuggucagaugagcggguaccgcagaaagccgaccuguaaaaagaucaugacgguacugacugugggaauuuucuggcccguccuuuccuugugcuaucugaucgcaccuaagucucaguuuggcaggaucauucauaccccauucaugaaauuuauaauccacggcgcuagcuacuucacauuucuccugcuucugaacuuguauucacucguguacaaugaggacaagaaaaacacuauggggcccgcccuggaacggauugauuauuuacugauccuauggauaauuggaaugaucuggagugacaucaagcgacucugguacgagggucuggaagauuuccuugaggagucccgcaaucaguugagcuucguuaugaacucucuguaucucgcuaccuuugcccugaaaguggucgcacacaauaaguuccaugacuuugccgauagaaaggacugggacgcuuuccacccuacauuaguggcggaaggccuguuugcauucgccaacguacuuucauacuugaggcucuuuuucauguacaccacgaguagcauucuggggccacuacaaaucuccaugggacagaugcugcaggauuuuggcaaauuccucgguauguuucugcuuguuuuguucucuuuuacuauugggcugacacaauuauaugacaagggauacaccucgaaagagcagaaggauugugugggcauauucugcgaacagcagagcaaugacacuuuccauuccuuuaucggcacaugcuucgcucucuuuugguauauuuucucacuggcccacgucgcaaucuuugugacccgguucaguuacggggaggagcuucaaucuuuugucggagccgugaucguugguacguauaacgugguagucgugauuguucugaccaaauugcucguggcuaugcugcacaagagcuuccagcuaauagccaaucaugaagauaaggaguggaaauuugcacgcgcgaagcuguggcucuccuacuucgacgauaaauguacacugcccccgccuuuuaacaucauucccucaccaaagacuaucugcuauaugauuagcucucuuuccaaauggaucuguagucacaccagcaagggcaaggucaaaagacaaaauucuuugaaggaauggaggaaccugaaacagaagcgugacgagaacuaccagaaagugaugugcuguuuaguacaucgguaccucacauccaugcgacagaagaugcagucaacugaucaggcuaccguggaaaaucugaacgagcuuagacaagaccugaguaaauucaggaaugagauacgcgaucuacucggguuucggacaagcaaguaugccauguucuacccuagaaacuga

SEQ ID NO: 3693 - RNA, 2382 nt, Artificial Sequence
  derived and/or modified sequence opt4 from TRPC1__Homo_sapiens__AAA93251
augauggccgcccuguaccccagcaccgaccugagcggcgccagcagcagcagccugcccagcagccccagcagcagcagccccaacgaggugauggcccugaaggacgugagagaggugaaggaggagaacacccugaacgagaagcuguuccugcuggccugcgacaagggcgacuacuacauggugaagaagauccuggaggagaacagcagcggcgaccugaacaucaacugcguggacgugcugggcagaaacgccgugaccaucaccaucgagaacgagaaccuggacauccugcagcugcugcuggacuacggcugccagagcgccgacgcccugcugguggccaucgacagcgagguggugggcgccguggacauccugcugaaccacagacccaagagaagcagcagacccaccaucgugaagcugauggagagaauccagaaccccgaguacagcaccaccauggacguggcccccgugauccuggccgcccacagaaacaacuacgagauccugaccaugcugcugaagcaggacgugagccugcccaagccccacgccgugggcugcgagugcacccugugcagcgccaagaacaagaaggacagccugagacacagcagauucagacuggacaucuacagaugccuggccagccccgcccugaucaugcugaccgaggaggaccccauccugagagccuucgagcugagcgccgaccugaaggagcugagccugguggagguggaguucagaaacgacuacgaggagcuggccagacagugcaagauguucgccaaggaccugcuggcccaggccagaaacagcagagagcuggaggugauccugaaccacaccagcagcgacgagccccuggacaagagaggccugcuggaggagagaaugaaccugagcagacugaagcuggccaucaaguacaaccagaaggaguucgugagccagagcaacugccagcaguuccugaacaccgugugguucggccagaugagcggcuacagaagaaagcccaccugcaagaagaucaugaccgugcugaccgugggcaucuucuggcccgugcugagccugugcuaccugaucgcccccaagagccaguucggcagaaucauccacacccccuucaugaaguucaucauccacggcgccagcuacuucaccuuccugcugcugcugaaccuguacagccugguguacaacgaggacaagaagaacaccaugggccccgcccuggagagaaucgacuaccugcugauccuguggaucaucggcaugaucuggagcgacaucaagagacugugguacgagggccuggaggacuuccuggaggagagcagaaaccagcugagcuucgugaugaacagccuguaccuggccaccuucgcccugaaggugguggcccacaacaaguuccacgacuucgccgacagaaaggacugggacgccuuccaccccacccugguggccgagggccuguucgccuucgccaacgugcugagcuaccugagacuguucuucauguacaccaccagcagcauccugggcccccugcagaucagcaugggccagaugcugcaggacuucggcaaguuccugggcauguuccugcuggugcuguucagcuucaccaucggccugacccagcuguacgacaagggcuacaccagcaaggagcagaaggacugcgugggcaucuucugcgagcagcagagcaacgacaccuuccacagcuucaucggcaccugcuucgcccuguucugguacaucuucagccuggcccacguggccaucuucgugaccagauucagcuacggcgaggagcugcagagcuucgugggcgccgugaucgugggcaccuacaacguggugguggugaucgugcugaccaagcugcugguggccaugcugcacaagagcuuccagcugaucgccaaccacgaggacaaggaguggaaguucgccagagccaagcuguggcugagcuacuucgacgacaagugcacccugcccccccccuucaacaucauccccagccccaagaccaucugcuacaugaucagcagccugagcaaguggaucugcagccacaccagcaagggcaaggugaagagacagaacagccugaaggaguggagaaaccugaagcagaagagagacgagaacuaccagaaggugaugugcugccuggugcacagauaccugaccagcaugagacagaagaugcagagcaccgaccaggccaccguggagaaccugaacgagcugagacaggaccugagcaaguucagaaacgagaucagagaccugcugggcuucagaaccagcaaguacgccauguucuaccccagaaacuga

SEQ ID NO: 3694 - RNA, 2382 nt, Artificial Sequence
  derived and/or modified sequence opt5 from TRPC1__Homo_sapiens__AAA93251
augauggccgcucuguaccccagcaccgaccucuccggcgccucuagcuccucucugccuagcuccccgucuagcuccagccccaacgaggugauggcgcuuaaggaugucagagaaguuaaagaggaaaauacacugaacgagaagcucuuucugcuugcuugcgacaaaggggauuauuacauggugaagaaaauccuggaagaaaauucuuccggagaccucaacauuaauuguguggauguccugggccggaacgccgugacgaucaccauugagaaugaaaaccuggacauccuccagcugcuucuggauuaugggugccaaagcgccgacgcucuccugguugccauugauucugagguggucggagcuguggacauccuucugaaucaccgcccuaagagauccagccggcccacaaucguuaagcucauggaacgcauucagaacccugaguacucuaccacaauggauguggcccccgucauccuggcggcccauagaaauaacuaugagauucugaccaugcuccugaaacaggacgugucccuuccuaagccgcacgcugugggcugugaaugcacacuguguagcgccaaaaauaagaaagauucccuccggcauucucgcuuuagacuggacaucuaccggugccuugcuagccccgcccugauuaugcucaccgaggaagacccuauccugcgcgcguucgagcuguccgccgaucucaaggaacugagccuugucgagguugaguuuagaaacgacuaugaggagcuggcucggcaguguaagauguucgccaaagaucuccuggcucaagcccgcaauucuagagaacuugaggugauucugaaccacacguccagcgacgaaccccucgauaagcgggggcugcuggaggagcgcaugaaccucucuagacugaaacuugccaucaaguacaaucagaaagaauuugugagccaguccaacugccagcaauuccugaauaccgucugguuuggacagaugucuggcuaccggagaaagccuacauguaaaaagaucaugaccgugcucacaguuggcauuuucuggcccgugcugagccugugcuaucuuaucgcuccgaagucccaguuugggcgcauuauccauaccccuuucaugaaauuuauuauccacggagcgagcuacuucacguuucuccugcugcucaaccuguauucucuugucuacaaugaggacaagaaaaacacaaugggccccgcccuggaacggaucgauuaucuccugauucuguggaucauugggaugaucugguccgacauuaagagacuuugguacgagggacucgaagauuuccuggaggagagccgcaaucagcugucuuucgugaugaacucccucuaucuggcuaccuuugcccuuaaaguuguggcccacaauaaguuccaugacuuugcugaucggaaggacugggacgccuuccacccuacacuggucgcggaaggccucuuugcuuucgccaacgugcugagcuaccugagacuuuucuucauguacaccaccuccucuauccucgggccccugcaaaucagcaugggacagaugcugcaggauuuuggcaaauuccucggcauguuucugcuuguccuguucuccuuuacaauugggcucacgcaacuguaugacaagggauacaccucuaaagagcagaaggauugugugggcaucuucugcgaacagcagagcaaugacacauuccauuccuuuauugggaccugcuucgcccuguuuugguauaucuucagccuugcucacguugccauuuuugugacacgcuucucuuacggagaggagcuccaauccuuugucggcgcugugaucguugggaccuauaacguggucguggugauuguucugacgaaacugcucgucgccaugcugcacaagagcuuccagcuuaucgcgaaucaugaagauaaggaguggaaauuugcccgggcuaagcuguggcucucuuacuucgacgauaaauguacacugcccccuccguuuaacaucauucccuccccuaagaccaucugcuauaugauuagcucucugagcaaauggaucuguucccacaccagcaagggaaaggugaaaagacaaaauucucuuaaggaauggcgcaaccugaaacagaagcgggacgagaacuaccagaaagugaugugcugucucguccauagauaccugacauccaugcgccagaagaugcagagcaccgaucaggccacaguggaaaaucucaacgagcugcggcaagaccuuuccaaauucagaaaugagauucgggaucugcucggcuuucgcacgucuaaguaugcuauguucuaccccagaaacuga

SEQ ID NO: 3695 - protein, 1104 aa, Artificial Sequence
  TRP-p8__Homo_sapiens__Q7Z2W7
MSFRAARLSMRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 3696 - RNA, 3315 nt, Artificial Sequence
  TRP-p8__Homo_sapiens__AAZ73614
auguccuuucgggcagccaggcucagcaugaggaacagaaggaaugacacucuggacagcacccggacccuguacuccagcgcgucucggagcacagacuugucuuacagugaaagcgacuuggugaauuuuauucaagcaaauuuuaagaaacgagaaugugucuucuuuaccaaagauuccaaggccacggagaaugugugcaaguguggcuaugcccagagccagcacauggaaggcacccagaucaaccaaagugagaaauggaacuacaagaaacacaccaaggaauuuccuaccgacgccuuuggggauauucaguuugagacacuggggaagaaagggaaguauauacgucuguccugcgacacggacgcggaaauccuuuacgagcugcugacccagcacuggcaccugaaaacacccaaccuggucauuucugugaccgggggcgccaagaacuucgcccugaagccgcgcaugcgcaagaucuucagccggcucaucuacaucgcgcaguccaaaggugcuuggauucucacgggaggcacccauuauggccugaugaaguacaucggggagguggugagagauaacaccaucagcaggaguucagaggagaauauuguggccauuggcauagcagcuuggggcauggucuccaaccgggacacccucaucaggaauugcgaugcugagggcuauuuuuuagcccaguaccuuauggaugacuucacaagagauccacuguauauccuggacaacaaccacacacauuugcugcucguggacaauggcugucauggacaucccacugucgaagcaaagcuccggaaucagcuagagaaguauaucucugagcgcacuauucaagauuccaacuaugguggcaagauccccauuguguguuuugcccaaggagguggaaaagagacuuugaaagccaucaauaccuccaucaaaaauaaaauuccuuguguggugguggaaggcucgggccagaucgcugaugugaucgcuagccugguggagguggaggaugcccugacaucuucugccgucaaggagaagcugguacgcuuuuuaccccgcacggugucccggcugccugaggaggagacugagaguuggaucaaauggcucaaagaaauucucgaauguucucaccuauuaacaguuauuaaaauggaagaagcuggggaugaaauugugagcaaugccaucuccuacgcucuauacaaagccuucagcaccagugagcaagacaaggauaacuggaaugggcagcugaagcuucugcuggaguggaaccagcuggacuuagccaaugaugagauuuucaccaaugaccgccgaugggagucugcugaccuucaagaagucauguuuacggcucucauaaaggacagacccaaguuuguccgccucuuucuggagaauggcuugaaccuacggaaguuucucacccaugauguccucacugaacucuucuccaaccacuucagcacgcuuguguaccggaaucugcagaucgccaagaauuccuauaaugaugcccuccucacguuugucuggaaacugguugcgaacuuccgaagaggcuuccggaaggaagacagaaauggccgggacgagauggacauagaacuccacgacgugucuccuauuacucggcacccccugcaagcucucuucaucugggccauucuucagaauaagaaggaacucuccaaagucauuugggagcagaccaggggcugcacucuggcagcccugggagccagcaagcuucugaagacucuggccaaagugaagaacgacaucaaugcugcuggggaguccgaggagcuggcuaaugaguacgagacccgggcuguugagcuguucacugaguguuacagcagcgaugaagacuuggcagaacagcugcuggucuauuccugugaagcuugggguggaagcaacugucuggagcuggcgguggaggccacagaccagcauuucaucgcccagccugggguccagaauuuucuuucuaagcaaugguauggagagauuucccgagacaccaagaacuggaagauuauccugugucuguuuauuauacccuuggugggcuguggcuuuguaucauuuaggaagaaaccugucgacaagcacaagaagcugcuuugguacuauguggcguucuucaccucccccuucguggucuucuccuggaauguggucuucuacaucgccuuccuccugcuguuugccuacgugcugcucauggauuuccauucggugccacacccccccgagcugguccuguacucgcuggucuuuguccucuucugugaugaagugagacagugguacguaaauggggugaauuauuuuacugaccuguggaaugugauggacacgcuggggcuuuuuuacuucauagcaggaauuguauuucggcuccacucuucuaauaaaagcucuuuguauucuggacgagucauuuucugucuggacuacauuauuuucacucuaagauugauccacauuuuuacuguaagcagaaacuuaggacccaagauuauaaugcugcagaggaugcugaucgauguguucuucuuccuguuccucuuugcgguguggaugguggccuuuggcguggccaggcaagggauccuuaggcagaaugagcagcgcuggagguggauauuccguucggucaucuacgagcccuaccuggccauguucggccaggugcccagugacguggaugguaccacguaugacuuugcccacugcaccuucacugggaaugaguccaagccacuguguguggagcuggaugagcacaaccugccccgguuccccgaguggaucaccaucccccuggugugcaucuacauguuauccaccaacauccugcuggucaaccugcuggucgccauguuuggcuacacggugggcaccguccaggagaacaaugaccaggucuggaaguuccagagguacuuccuggugcaggaguacugcagccgccucaauauccccuuccccuucaucgucuucgcuuacuucuacaugguggugaagaagugcuucaaguguugcugcaaggagaaaaacauggagucuucugucugcuguuucaaaaaugaagacaaugagacucuggcaugggagggugucaugaaggaaaacuaccuugucaagaucaacacaaaagccaacgacaccucagaggaaaugaggcaucgauuuagacaacuggauacaaagcuuaaugaucucaagggucuucugaaagagauugcuaauaaaaucaaauaa

SEQ ID NO: 3697 - RNA, 3315 nt, Artificial Sequence
  derived and/or modified sequence opt1 from TRP-p8__Homo_sapiens__AAZ73614
augagcuuccgcgccgcccggcuguccaugcgcaaccggcgcaacgacacccucgacagcacccggacgcuguacuccagcgcgucccgcagcaccgaccuguccuacagcgaguccgaccucgugaacuucauccaggccaacuucaagaagcgggagugcgucuucuucaccaaggacagcaaggccaccgagaacgugugcaagugcggcuacgcccagucccagcacauggaggggacgcagaucaaccagagcgagaaguggaacuacaagaagcacaccaaggaguuccccaccgacgccuucggcgacauccaguucgagacccuggggaagaagggcaaguacauccgccuguccugcgacacggacgcggagauccucuacgagcugcugacccagcacuggcaccucaagaccccgaaccuggugaucagcgucaccgggggcgccaagaacuucgcccugaagccccggaugcgcaagaucuucucccggcucaucuacaucgcccagagcaagggcgcguggauccugaccgggggcacgcacuacgggcugaugaaguacaucggcgagguggugcgcgacaacaccaucucccggagcuccgaggagaacaucgucgccaucgggaucgccgccuggggcauggugagcaaccgcgacacccucauccggaacugcgacgccgagggcuacuuccuggcgcaguaccugauggacgacuucacgcgcgacccccucuacauccuggacaacaaccacacccaccuccuccugguggacaacgggugccacggccaccccaccgucgaggccaagcugcggaaccagcucgagaaguacaucagcgagcgcaccauccaggacuccaacuacgggggcaagaucccgaucgugugcuucgcccagggcgggggcaaggagacgcugaaggccaucaacaccagcaucaagaacaagauccccugcguggucguggagggguccggccagaucgccgacgugaucgcgagccuggucgagguggaggacgcccucaccuccagcgccgugaaggagaagcugguccgguuccugccccgcaccgugucccggcuccccgaggaggagacggagagcuggaucaaguggcugaaggagauccuggagugcucccaccuccugaccgugaucaagauggaggaggccggggacgagaucgucagcaacgccaucuccuacgcgcuguacaaggccuucagcaccuccgagcaggacaaggacaacuggaacggccagcucaagcugcugcucgaguggaaccagcuggaccuggccaacgacgagaucuucaccaacgaccgccgcugggagagcgccgaccuccaggaggugauguucacggcccugaucaaggaccggccgaaguucgugcgccuguuccucgagaacggccugaaccugcggaaguuccucacccacgacguccugaccgagcuguucuccaaccacuucagcacccugguguaccgcaaccuccagaucgcgaagaacuccuacaacgacgcccugcugacguucgucuggaagcucguggccaacuuccggcgcggguuccggaaggaggaccgcaacggccgggacgagauggacaucgagcugcacgacgugagccccaucacccgccacccccugcaggcccucuucaucugggcgauccugcagaacaagaaggagcuguccaaggucaucugggagcagacccgggggugcacccucgccgcccugggcgccagcaagcugcucaagacgcuggccaaggugaagaacgacaucaacgcggccggggagagcgaggagcuggccaacgaguacgagacccgcgccguggagcuguucaccgagugcuacuccagcgacgaggaccuggccgagcagcugcucgucuacuccugcgaggcguggggcggcagcaacugccuggagcuggccguggaggccaccgaccagcacuucaucgcccagcccggggugcagaacuuccucuccaagcagugguacggcgagaucagccgggacaccaagaacuggaagaucauccugugccuguucaucaucccgcucgucgggugcggcuucguguccuuccgcaagaagcccguggacaagcacaagaagcugcugugguacuacgucgccuucuucacgagccccuucgugguguucuccuggaacgucguguucuacaucgcguuccuccugcuguucgccuacgugcuccugauggacuuccacagcgucccccacccgcccgagcuggugcucuacucccugguguucguccuguucugcgacgaggugcggcagugguacgugaacggggucaacuacuucaccgaccucuggaacgugauggacacccugggccuguucuacuucaucgccggcaucguguuccgccuccacagcuccaacaagagcucccuguacagcgggcgggucaucuucugccuggacuacaucaucuucacccuccgccugauccacaucuucacggugucccggaaccugggccccaagaucaucaugcuccagcgcaugcugaucgacguguucuucuuccuguuccucuucgccgucuggaugguggcguucgggguggcccgccagggcauccugcggcagaacgagcagcgcuggcgguggaucuuccgcagcgucaucuacgagcccuaccuggccauguucggccaggugccgagcgacguggacgggaccaccuacgacuucgcccacugcaccuucacgggcaacgaguccaagccccucugcgucgagcuggacgagcacaaccugccccgguuccccgaguggaucaccaucccgcucgugugcaucuacaugcugagcaccaacauccugcucgugaaccugcuggucgccauguucggguacaccgugggcacggugcaggagaacaacgaccaggucuggaaguuccagcgcuacuuccucgugcaggaguacugcucccggcugaacauccccuuccccuucaucguguucgcguacuucuacauggucgugaagaagugcuucaagugcugcugcaaggagaagaacauggagagcuccgugugcugcuucaagaacgaggacaacgagacccuggccugggagggggucaugaaggagaacuaccucgugaagaucaacaccaaggccaacgacaccagcgaggagaugcgccaccgguuccgccagcuggacacgaagcugaacgaccucaagggccugcugaaggagaucgccaacaagaucaaguga

SEQ ID NO: 3698 - RNA, 3315 nt, Artificial Sequence
  derived and/or modified sequence opt2 from TRP-p8__Homo_sapiens__AAZ73614
auguccuuccgcgccgcccgccucuccaugcgcaaccgccgcaacgacacccucgacuccacccgcacccucuacuccuccgccucccgcuccaccgaccucuccuacuccgaguccgaccucgucaacuucauccaggccaacuucaagaagcgcgagugcgucuucuucaccaaggacuccaaggccaccgagaacgucugcaagugcggcuacgcccagucccagcacauggagggcacccagaucaaccaguccgagaaguggaacuacaagaagcacaccaaggaguuccccaccgacgccuucggcgacauccaguucgagacccucggcaagaagggcaaguacauccgccucuccugcgacaccgacgccgagauccucuacgagcuccucacccagcacuggcaccucaagacccccaaccucgucaucuccgucaccggcggcgccaagaacuucgcccucaagccccgcaugcgcaagaucuucucccgccucaucuacaucgcccaguccaagggcgccuggauccucaccggcggcacccacuacggccucaugaaguacaucggcgaggucguccgcgacaacaccaucucccgcuccuccgaggagaacaucgucgccaucggcaucgccgccuggggcauggucuccaaccgcgacacccucauccgcaacugcgacgccgagggcuacuuccucgcccaguaccucauggacgacuucacccgcgacccccucuacauccucgacaacaaccacacccaccuccuccucgucgacaacggcugccacggccaccccaccgucgaggccaagcuccgcaaccagcucgagaaguacaucuccgagcgcaccauccaggacuccaacuacggcggcaagauccccaucgucugcuucgcccagggcggcggcaaggagacccucaaggccaucaacaccuccaucaagaacaagauccccugcgucgucgucgagggcuccggccagaucgccgacgucaucgccucccucgucgaggucgaggacgcccucaccuccuccgccgucaaggagaagcucguccgcuuccucccccgcaccgucucccgccuccccgaggaggagaccgaguccuggaucaaguggcucaaggagauccucgagugcucccaccuccucaccgucaucaagauggaggaggccggcgacgagaucgucuccaacgccaucuccuacgcccucuacaaggccuucuccaccuccgagcaggacaaggacaacuggaacggccagcucaagcuccuccucgaguggaaccagcucgaccucgccaacgacgagaucuucaccaacgaccgccgcugggaguccgccgaccuccaggaggucauguucaccgcccucaucaaggaccgccccaaguucguccgccucuuccucgagaacggccucaaccuccgcaaguuccucacccacgacguccucaccgagcucuucuccaaccacuucuccacccucgucuaccgcaaccuccagaucgccaagaacuccuacaacgacgcccuccucaccuucgucuggaagcucgucgccaacuuccgccgcggcuuccgcaaggaggaccgcaacggccgcgacgagauggacaucgagcuccacgacgucucccccaucacccgccacccccuccaggcccucuucaucugggccauccuccagaacaagaaggagcucuccaaggucaucugggagcagacccgcggcugcacccucgccgcccucggcgccuccaagcuccucaagacccucgccaaggucaagaacgacaucaacgccgccggcgaguccgaggagcucgccaacgaguacgagacccgcgccgucgagcucuucaccgagugcuacuccuccgacgaggaccucgccgagcagcuccucgucuacuccugcgaggccuggggcggcuccaacugccucgagcucgccgucgaggccaccgaccagcacuucaucgcccagcccggcguccagaacuuccucuccaagcagugguacggcgagaucucccgcgacaccaagaacuggaagaucauccucugccucuucaucaucccccucgucggcugcggcuucgucuccuuccgcaagaagcccgucgacaagcacaagaagcuccucugguacuacgucgccuucuucaccucccccuucgucgucuucuccuggaacgucgucuucuacaucgccuuccuccuccucuucgccuacguccuccucauggacuuccacuccgucccccacccccccgagcucguccucuacucccucgucuucguccucuucugcgacgagguccgccagugguacgucaacggcgucaacuacuucaccgaccucuggaacgucauggacacccucggccucuucuacuucaucgccggcaucgucuuccgccuccacuccuccaacaaguccucccucuacuccggccgcgucaucuucugccucgacuacaucaucuucacccuccgccucauccacaucuucaccgucucccgcaaccucggccccaagaucaucaugcuccagcgcaugcucaucgacgucuucuucuuccucuuccucuucgccgucuggauggucgccuucggcgucgcccgccagggcauccuccgccagaacgagcagcgcuggcgcuggaucuuccgcuccgucaucuacgagcccuaccucgccauguucggccagguccccuccgacgucgacggcaccaccuacgacuucgcccacugcaccuucaccggcaacgaguccaagccccucugcgucgagcucgacgagcacaaccucccccgcuuccccgaguggaucaccaucccccucgucugcaucuacaugcucuccaccaacauccuccucgucaaccuccucgucgccauguucggcuacaccgucggcaccguccaggagaacaacgaccaggucuggaaguuccagcgcuacuuccucguccaggaguacugcucccgccucaacauccccuuccccuucaucgucuucgccuacuucuacauggucgucaagaagugcuucaagugcugcugcaaggagaagaacauggaguccuccgucugcugcuucaagaacgaggacaacgagacccucgccugggagggcgucaugaaggagaacuaccucgucaagaucaacaccaaggccaacgacaccuccgaggagaugcgccaccgcuuccgccagcucgacaccaagcucaacgaccucaagggccuccucaaggagaucgccaacaagaucaaguga

SEQ ID NO: 3699 - RNA, 3315 nt, Artificial Sequence
  derived and/or modified sequence opt3 from TRP-p8__Homo_sapiens__AAZ73614
augagcuucagagccgcuaggcuguccaugcggaaccgccgaaaugacacccucgauucuacacguacucuuuacucaagugcaagcagauccacggaccugucuuauucggagucagauuuggugaacuuuauccaggccaauuucaagaaaagggaaugcgucuuuuucaccaaggacagcaaagcgacagagaacguuuguaagugcggcuacgcucaaagucagcacauggaagggacucagauuaaucaguccgagaaauggaacuauaagaagcauaccaaagaauuucccacagaugccuucggagacauacaauuugagaccuuagguaagaaaggcaaguacauccggcugucuugugauacugacgcagagauucuauaugaacuccugacacagcacuggcaucuuaaaaccccuaaucuggugaucagcguaacugggggagccaagaacuucgcuuugaagccacgcaugagaaaaaucuuuuccaggcucauuuacauagcacagucaaagggcgccuggauccugacgggugggacccacuauggacugaugaaauacauuggcgaggugguccgggauaauacaaucagucgcagcucugaagagaacauuguggcuaucggcauagccgcgugggggaugguuuccaaucgagacacucucauuagaaacugcgaugcagagggauacuucuuagcccaguaucugauggacgauuuuaccagggacccgcuuuacaucuuggacaauaaccauacacaccuucuacucguggauaaugguugucacggccaucccaccgucgaagcuaagcugcggaaccaacuugagaaauauauuucagaacguacgauccaggacagcaacuacgggggaaagaucccuauugugugcuucgcccagggcggugggaaagagacucugaaggcaauaaauacaaguaucaagaacaaaauuccauguguaguuguggaaggaucuggccagaucgcugaugucauagccuccuugguggagguggaggacgcgcucaccagcucggccgucaaggaaaaacugguucgcuuuuuacccagaacugugucuaggcugccugaggaagagacagaauccuggauuaaguggcucaaagagauccuugagugcucacaccuguugaccguaaucaagauggaagaggcaggcgaugaaauugugaguaaugcuaucagcuaugcccuauacaaggcuuucuccacgucugagcaagacaaagauaacuggaaugggcagcugaagcuccugcuugaauggaaccagcuggacuuggccaaugaugagauuuucaccaacgaccggcgaugggagagcgcagaucuccaagaagucauguuuacagcccugauaaaagaccgcccaaaguucgugagauuauuucuggagaauggacuaaaccucaggaaauuccugacucaugacguucuuaccgaauuguuuucaaaucacuucaguacacugguguaucggaaccuccagaucgcuaaaaauuccuacaacgaugcgcugcuuacuuuugucuggaagcugguggcaaauuuccgcagagguuuuaggaaggaggaccguaacggccgggaugagauggacauugaauugcacgauguaagccccaucacccgacauccucuccaggcccuguucaucugggcuauuuuacagaacaagaaagagcugucuaagguuauaugggaacaaacaagaggguguacccuagccgcacucggagccucaaaacugcuuaagacuuuggcuaaggugaaaaaugacaucaacgccgcaggcgagagugaggaacuggcgaaugaguacgaaacgagggcugucgagcucuuuacagaaugcuauagcuccgaugaggaccuggccgaacaguuacugguguacucuugugaggcauggggugggucgaacugccuugaguuggccgucgaagcuaccgaucagcacuucauugcccagccaggcgugcaaaauuuucucagcaagcagugguauggagagaucucccgcgacacuaaaaacuggaagauuauccugugccuauucauaaucccgcugguuggcuguggguucgugucauuucggaaaaagcccguagauaaacauaagaagcuccugugguacuaugucgcauucuuuaccaguccuuucgugguguuuucuuggaauguugucuucuacauugcuuuucuuuugcuguucgccuauguguuacucauggacuuucacagcguaccacaucccccugaacuggugcuuuacucccugguuuucgucuuguuuugcgaugaggugagacagugguacgugaacggagucaauuauuucacagaccucuggaacguuauggacacccugggucuauuuuacuucaucgcgggcauuguguucaggcugcacucaagcaauaaaucuucccucuauagugggcgcgugaucuuuugucuggauuacauaauuuucacucuucgauugauccacauuuuuacaguaagccggaaccugggaccaaagaucauaauguuacagcguaugcucaucgacgucuucuuuuuccuguuucuuuucgccguguggaugguugcuuuuggcguggcaagacaagguauucugaggcagaaugaacagcgcuggcgguggaucuucagaucugucauuuaugagcccuaccuagccauguuuggccaggugccguccgauguugacgggacgaccuaugauuucgcucauugcacuuucacaggaaacgagucaaaaccucucuguguggaacuggacgagcacaauuugcccagguuuccagaauggaucaccauaccucugguaugcauuuacauguuaaguacaaacauccuccuggucaaccuucugguggccauguucggcuacacuguggggaccguccaagagaauaacgaucagguuuggaaguuucagcgauauuucuuggugcaagaguacuguagccgccucaauauccccuuuccauucauuguauuugcauauuucuacaugguggucaaaaagugcuuuaaguguugcuguaaagaaaagaacauggagucguccgugugcugcuucaaaaaugaagacaacgagacgcuggcgugggaaggaguuaugaaggagaauuaucuagugaaaaucaacaccaaggccaaugauacaucugaggaaaugcggcauagauuuaggcagcuggacacuaagcugaacgaucucaaaggucuguugaaggagauugcuaauaaaauaaaguga

SEQ ID NO: 3700 - RNA, 3315 nt, Artificial Sequence
  derived and/or modified sequence opt4 from TRP-p8__Homo_sapiens__AAZ73614
augagcuucagagccgccagacugagcaugagaaacagaagaaacgacacccuggacagcaccagaacccuguacagcagcgccagcagaagcaccgaccugagcuacagcgagagcgaccuggugaacuucauccaggccaacuucaagaagagagagugcguguucuucaccaaggacagcaaggccaccgagaacgugugcaagugcggcuacgcccagagccagcacauggagggcacccagaucaaccagagcgagaaguggaacuacaagaagcacaccaaggaguuccccaccgacgccuucggcgacauccaguucgagacccugggcaagaagggcaaguacaucagacugagcugcgacaccgacgccgagauccuguacgagcugcugacccagcacuggcaccugaagacccccaaccuggugaucagcgugaccggcggcgccaagaacuucgcccugaagcccagaaugagaaagaucuucagcagacugaucuacaucgcccagagcaagggcgccuggauccugaccggcggcacccacuacggccugaugaaguacaucggcgagguggugagagacaacaccaucagcagaagcagcgaggagaacaucguggccaucggcaucgccgccuggggcauggugagcaacagagacacccugaucagaaacugcgacgccgagggcuacuuccuggcccaguaccugauggacgacuucaccagagacccccuguacauccuggacaacaaccacacccaccugcugcugguggacaacggcugccacggccaccccaccguggaggccaagcugagaaaccagcuggagaaguacaucagcgagagaaccauccaggacagcaacuacggcggcaagauccccaucgugugcuucgcccagggcggcggcaaggagacccugaaggccaucaacaccagcaucaagaacaagauccccugcguggugguggagggcagcggccagaucgccgacgugaucgccagccugguggagguggaggacgcccugaccagcagcgccgugaaggagaagcuggugagauuccugcccagaaccgugagcagacugcccgaggaggagaccgagagcuggaucaaguggcugaaggagauccuggagugcagccaccugcugaccgugaucaagauggaggaggccggcgacgagaucgugagcaacgccaucagcuacgcccuguacaaggccuucagcaccagcgagcaggacaaggacaacuggaacggccagcugaagcugcugcuggaguggaaccagcuggaccuggccaacgacgagaucuucaccaacgacagaagaugggagagcgccgaccugcaggaggugauguucaccgcccugaucaaggacagacccaaguucgugagacuguuccuggagaacggccugaaccugagaaaguuccugacccacgacgugcugaccgagcuguucagcaaccacuucagcacccugguguacagaaaccugcagaucgccaagaacagcuacaacgacgcccugcugaccuucguguggaagcugguggccaacuucagaagaggcuucagaaaggaggacagaaacggcagagacgagauggacaucgagcugcacgacgugagccccaucaccagacacccccugcaggcccuguucaucugggccauccugcagaacaagaaggagcugagcaaggugaucugggagcagaccagaggcugcacccuggccgcccugggcgccagcaagcugcugaagacccuggccaaggugaagaacgacaucaacgccgccggcgagagcgaggagcuggccaacgaguacgagaccagagccguggagcuguucaccgagugcuacagcagcgacgaggaccuggccgagcagcugcugguguacagcugcgaggccuggggcggcagcaacugccuggagcuggccguggaggccaccgaccagcacuucaucgcccagcccggcgugcagaacuuccugagcaagcagugguacggcgagaucagcagagacaccaagaacuggaagaucauccugugccuguucaucaucccccuggugggcugcggcuucgugagcuucagaaagaagcccguggacaagcacaagaagcugcugugguacuacguggccuucuucaccagccccuucgugguguucagcuggaacgugguguucuacaucgccuuccugcugcuguucgccuacgugcugcugauggacuuccacagcgugccccacccccccgagcuggugcuguacagccugguguucgugcuguucugcgacgaggugagacagugguacgugaacggcgugaacuacuucaccgaccuguggaacgugauggacacccugggccuguucuacuucaucgccggcaucguguucagacugcacagcagcaacaagagcagccuguacagcggcagagugaucuucugccuggacuacaucaucuucacccugagacugauccacaucuucaccgugagcagaaaccugggccccaagaucaucaugcugcagagaaugcugaucgacguguucuucuuccuguuccuguucgccguguggaugguggccuucggcguggccagacagggcauccugagacagaacgagcagagauggagauggaucuucagaagcgugaucuacgagcccuaccuggccauguucggccaggugcccagcgacguggacggcaccaccuacgacuucgcccacugcaccuucaccggcaacgagagcaagccccugugcguggagcuggacgagcacaaccugcccagauuccccgaguggaucaccaucccccuggugugcaucuacaugcugagcaccaacauccugcuggugaaccugcugguggccauguucggcuacaccgugggcaccgugcaggagaacaacgaccagguguggaaguuccagagauacuuccuggugcaggaguacugcagcagacugaacauccccuuccccuucaucguguucgccuacuucuacaugguggugaagaagugcuucaagugcugcugcaaggagaagaacauggagagcagcgugugcugcuucaagaacgaggacaacgagacccuggccugggagggcgugaugaaggagaacuaccuggugaagaucaacaccaaggccaacgacaccagcgaggagaugagacacagauucagacagcuggacaccaagcugaacgaccugaagggccugcugaaggagaucgccaacaagaucaaguga

SEQ ID NO: 3701 - RNA, 3315 nt, Artificial Sequence
  derived and/or modified sequence opt5 from TRP-p8__Homo_sapiens__AAZ73614
augagcuucagagccgcucggcuguccaugcgcaacagacggaaugacacccucgauucuacacgcacgcuguacagcuccgccucuagaagcaccgaccuuuccuauucugagagcgaucuggugaacuuuauccaggcgaauuucaagaaacgggaaugcgucuuuuucacaaaggacuccaaagcuaccgagaacguuuguaagugcggcuacgcccaaagccagcacauggaagggacacagauuaaucagucugagaaauggaacuauaagaagcauaccaaagaauuucccacagaugccuucggagacauccaauuugagacccucggcaagaaagggaaguacauucgccuguccugugauacggacgcugagauccuuuaugaacugcucacccagcacuggcaucugaaaacaccuaaucuggugauuagcgugaccggaggcgccaagaacuucgcucucaagccgagaaugcggaaaaucuuuucucgccugaucuacauugcccaguccaagggggcguggauccuuacaggaggcacccacuauggccugaugaaauacauuggggaggucgugagagauaauacgaucagccggucuuccgaagagaacauuguugccaucggaauugcugccuggggcauggugagcaaucgcgacacacucaucagaaacugcgaugcugagggguacuuccuggcccaguaucuuauggacgauuuuacccgggacccccuguacauccucgacaauaaccauacacaccuucugcucgucgauaauggaugucacggccauccuaccguggaagcgaagcugcgcaaccaacuugagaaauauauuuccgaaagaaccauccaggacucuaacuacgggggaaagauucccaucguuugcuucgcccagggcggcgggaaagagacacugaaggcuauuaauacgagcaucaagaacaaaaucccuuguguggucguggaaggauccggccagauugccgaugugaucgcuagccucgucgagguugaggacgcccugaccucuuccgccgugaaggaaaaacuugugcgguuucugcccagaacagucagccgccucccugaggaagagaccgaaucuuggauuaaguggcugaaagagauccuggagugcagccaccuccugacagugauuaagauggaagaggcuggggaugaaaucguuuccaaugcgaucucuuaugcccuuuacaaggcuuucagcaccuccgagcaagacaaagauaacuggaauggacagcugaagcuccugcuugaauggaaccagcuggaccucgccaaugaugagauuuucacgaacgaccggagaugggagagcgccgaucugcaagaagugauguuuacagcucugaucaaagaccgcccgaaguucguccggcucuuucuggagaauggccuuaaccugagaaaauuccucacccaugacgugcugaccgaacuguuuucuaaucacuucuccacacuuguuuaucgcaaccuccagauugccaagaauagcuacaacgaugcgcugcugaccuuuguguggaagcucgucgcuaauuuccggagaggguuucgcaaagaggaccggaacggaagagaugagauggacaucgaacugcacgaugugucucccauuacacgccauccucuucaggcccuguucaucugggccauucuccagaacaagaaagagcuguccaaggucaucugggaacaaacgcggggcuguacccuggcugcccuuggcgcuagcaaacuccugaagacacuggccaaggugaaaaaugacaucaacgcggccggggaguccgaggaacucgcuaaugaguacgaaaccagagccguugagcuguuuacagaaugcuauucuagcgaugaggaccuugcugaacagcugcucguguacuccugugaggccuggggaggcucuaacugccuggagcuggcggucgaagccaccgaucagcacuucauugcucagcccggggugcaaaauuuucuuagcaagcagugguauggagagaucucccgggacacgaaaaacuggaagauuauccucugccuguucauuaucccucugguuggcuguggguucgugagcuuucgcaaaaagcccgucgauaaacauaagaagcuccugugguacuauguggccuucuuuaccucuccguucguggucuuuuccuggaauguuguguucuacaucgcuuuucuucuucucuucgccuaugugcugcugauggacuuucacagcgucccucaucccccugaacuugugcucuacucucugguuuucgugcuguuuugcgaugaggucagacagugguacgugaacggcguuaauuauuucacagaccucuggaacgugauggacacccugggacuguuuuacuucauugccggcaucgucuuccggcugcacuccagcaauaaaucuagccucuauuccgggagagugaucuuuugucuggauuacauuauuuucacacugcgccuuauccacaucuuuaccguuagccggaaccugggacccaagauuaucaugcuccagagaaugcugauugacguguucuuuuuccucuuucuguucgcugucuggaugguggcguuuggcguggcccgccaagggauccuuagacagaaugaacagcgguggcgcuggauuuucagaucugucaucuaugagcccuaccuggcuauguuuggacagguuccuuccgauguggacggcacgacauaugauuucgcccauugcaccuucacagggaacgagagcaaaccgcucuguguggaacuggacgagcacaaucugccccgguuuccugaauggaucaccauuccccuugucugcaucuacaugcuguccaccaacauucuccuggugaaccuccugguugccauguucggcuacacagugggaacgguccaagagaauaacgaucagguguggaaguuucagcgcuauuuccuuguucaagaguacuguucuagacugaauaucccuuuucccuucauuguguuugcuuauuucuacauggucgugaaaaagugcuuuaaguguugcuguaaagaaaagaacauggagagcuccguuugcugcuucaaaaaugaagacaacgagacccucgccugggaaggcgugaugaaggagaauuaucuggucaaaaucaacacaaaggcgaaugauaccucugaggaaaugcggcaucgcuuuagacagcuggacacaaagcugaacgaucugaaagggcuccugaaggagauugcuaauaaaaucaaguga

SEQ ID NO: 3702 - protein, 698 aa, Artificial Sequence
  TSG10__Homo_sapiens__Q9BZW7
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEENLCYRDF

SEQ ID NO: 3703 - RNA, 2097 nt, Artificial Sequence
  TSG10__Homo_sapiens__AAK13079
augaugcgaaguaggucuaaaaguccaagacgcccaucaccaacugcccggggugcaaacugugauguagaacuuuugaagacaacaacaagagaucgugaagaacuuaaaugcaugcuggaaaaauaugagcgccauuuggcagaaauucaggguaaugucaagguucuuaaaucugagagagacaagaucuuccuucuuuaugaacaggcacaggaagaaauuacccgacuucgacgagaaaugaugaaaagcuguaagaguccuaaaucaacaacggcacaugcuauucuccggcgaguggagacugaaagagauguagccuuuacugauuuacgaagaaugaccacagaacgagauagucuaagggagaggcuaaagauugcucaagagacagcauuuaaugagaaggcucaccuggaacaaaggauagaggagcuggaguguacaguucauaaucuugaugaugaacguauggagcaaaugucaaauaugacuuugaugaaggaaaccauaagcacuguggaaaaagaaaugaaaucacuagcaagaaaggcaauggauaccgaaagugaacuuggcagacaaaaagcagagaauaauucuuugagacuuuuguaugaaaacacagaaaaagaucuuucugauacucagcgacaccuugcuaagaaaaaauaugagcuacagcuuacucaggagaaaauuaugugcuuggaugaaaaaauugauaacuuuacaaggcaaaauauugcacagcgagaagaaaucagcauucuugguggaacccucaaugaucuggcuaaagaaaaggaaugccugcaagcauguuuggauaaaaaaucugagaauauugcaucccuuggagagaguuuggcaaugaaagaaaagaccauuucaggcaugaagaauaucauugcugagauggaacaggcaucaagacaguguacugaggcccuaauugugugugaacaagacguuuccagaaugcgucggcaauuggaugagacaaaugaugagcuggcccagaucgccagggaaagagauaucuuggcucaugacaaugacaaucuccaggaacaguuugcuaaagcuaaacaagaaaaccaggcacuguccaaaaaauugaaugacacucauaaugaacuuaaugacauaaaacagaagguucaagauacuaauuuggagguuaacaagcugaagaauauauuaaagucugaagaaucugagaaccggcaaaugauggaacaacuucgaaaagccaaugaagaugcugaaaacugggaaaauaaagcccgucaaucagaggcagauaacaauacccucaaacuggaacuuaucacugcugaggcagaggguaacagauuaaaagaaaaaguagauucccucaacagagagguugagcaacacuuaaaugcagaaaggucuuacaagucccagauuucuaccuuacauaaaucuguuguaaaaauggaagaggagcuucagaagguucaguuugaaaaaguguccgcucuugcagauuugucuucuacuagggaacucuguauuaaacuugacucaagcaaagaacuucuuaaucgacagcugguugcuaaagaucaagaaauagaaaugagggagaaugaguuagauucugcucauucugaaauugaacuccugaggagucagauggcaaaugagagaaucuccaugcagaaucuagaagcuuugcugguggccaaucgagacaaagaauaucagucucagauagcacuucaagaaaaagaaucugaaauucagcuucuuaaagaacaccuuuguuuggcagaaaauaaaauggccauccagaguagagauguggcccaguucagaaauguugucacacaauuggaagcugauuuagacauuaccaaaagacaacuaggaacagagcgcuuugaaagggagagggccguacaagaacuucgccgccaaaauuauucaaguaaugcuuaucauaugaguucuacaaugaagccaaauacaaaaugucauucaccagaacgugcucaccaucgaucuccugaccgaggccuagaucgaucauuagaagagaaucuuugcuacagagauuucuga

SEQ ID NO: 3704 - RNA, 2097 nt, Artificial Sequence
  derived and/or modified sequence opt1 from TSG10__Homo_sapiens__AAK13079
augaugcgcagccgguccaagagcccccgccggccgucccccaccgcccgcggcgccaacugcgacguggagcugcucaagaccacgacccgggaccgcgaggagcugaagugcaugcuggagaaguacgagcggcaccucgcggagauccaggggaacgucaaggugcucaagagcgagcgcgacaagaucuuccugcuguacgagcaggcccaggaggagaucacccggcugcgccgggagaugaugaaguccugcaagagccccaaguccaccacggcccacgccauccugcgccggguggagaccgagcgcgacgucgccuucaccgaccuccggcgcaugaccacggagcgggacagccugcgcgagcggcugaagaucgcgcaggagaccgccuucaacgagaaggcccaccucgagcagcgcaucgaggagcuggagugcaccgugcacaaccuggacgacgagcggauggagcagauguccaacaugacccucaugaaggagacgaucagcaccguggagaaggagaugaagucccuggcccgcaaggcgauggacaccgagagcgagcugggccgccagaaggccgagaacaacucccuccggcugcuguacgagaacaccgagaaggaccucagcgacacgcagcgccaccuggccaagaagaaguacgagcugcagcucacccaggagaagaucaugugccuggacgagaagaucgacaacuucacccggcagaacaucgcccagcgcgaggagaucuccauccucgggggcacccugaacgaccuggccaaggagaaggagugccugcaggcgugccucgacaagaaguccgagaacaucgccagccugggggagagccuggccaugaaggagaagacgaucuccggcaugaagaacaucaucgccgagauggagcaggccagccggcagugcaccgaggcgcucaucgucugcgagcaggacgugagccgcaugcggcgccagcuggacgagaccaacgacgagcuggcccagaucgcccgggagcgcgacauccucgcccacgacaacgacaaccugcaggagcaguucgccaaggcgaagcaggagaaccaggcccuguccaagaagcucaacgacacccacaacgagcugaacgacaucaagcagaaggugcaggacacgaaccuggaggucaacaagcucaagaacauccucaagagcgaggaguccgagaaccggcagaugauggagcagcugcgcaaggccaacgaggacgccgagaacugggagaacaaggcccggcagagcgaggcggacaacaacacccugaagcuggagcugaucaccgccgaggccgagggcaaccgccucaaggagaagguggacucccugaaccgggagguggagcagcaccugaacgccgagcgcagcuacaagucccagaucagcacccugcacaaguccgucgugaagauggaggaggagcuccagaaggugcaguucgagaaggucagcgcgcuggccgaccuguccagcacgcgggagcucugcaucaagcuggacuccagcaaggagcugcucaaccgccagcugguggccaaggaccaggagaucgagaugcgggagaacgagcuggacuccgcccacagcgagaucgagcuccugcgcucccagauggccaacgagcgcaucagcaugcagaaccuggaggcgcuccugguggccaaccgggacaaggaguaccagucccagaucgcccugcaggagaaggagagcgagauccagcuccugaaggagcaccugugccucgccgagaacaagauggccauccagagccgcgacgucgcgcaguuccggaacguggugacccagcuggaggccgaccuggacaucaccaagcgccagcucgggaccgagcgguucgagcgcgagcgggccguccaggagcugcgccggcagaacuacuccagcaacgccuaccacauguccagcacgaugaagcccaacaccaagugccacuccccggagcgcgcccaccaccggagccccgaccgcggccuggaccggucccucgaggagaaccugugcuaccgcgacuucuga

SEQ ID NO: 3705 - RNA, 2097 nt, Artificial Sequence
  derived and/or modified sequence opt2 from TSG10__Homo_sapiens__AAK13079
augaugcgcucccgcuccaaguccccccgccgccccucccccaccgcccgcggcgccaacugcgacgucgagcuccucaagaccaccacccgcgaccgcgaggagcucaagugcaugcucgagaaguacgagcgccaccucgccgagauccagggcaacgucaagguccucaaguccgagcgcgacaagaucuuccuccucuacgagcaggcccaggaggagaucacccgccuccgccgcgagaugaugaaguccugcaagucccccaaguccaccaccgcccacgccauccuccgccgcgucgagaccgagcgcgacgucgccuucaccgaccuccgccgcaugaccaccgagcgcgacucccuccgcgagcgccucaagaucgcccaggagaccgccuucaacgagaaggcccaccucgagcagcgcaucgaggagcucgagugcaccguccacaaccucgacgacgagcgcauggagcagauguccaacaugacccucaugaaggagaccaucuccaccgucgagaaggagaugaagucccucgcccgcaaggccauggacaccgaguccgagcucggccgccagaaggccgagaacaacucccuccgccuccucuacgagaacaccgagaaggaccucuccgacacccagcgccaccucgccaagaagaaguacgagcuccagcucacccaggagaagaucaugugccucgacgagaagaucgacaacuucacccgccagaacaucgcccagcgcgaggagaucuccauccucggcggcacccucaacgaccucgccaaggagaaggagugccuccaggccugccucgacaagaaguccgagaacaucgccucccucggcgagucccucgccaugaaggagaagaccaucuccggcaugaagaacaucaucgccgagauggagcaggccucccgccagugcaccgaggcccucaucgucugcgagcaggacgucucccgcaugcgccgccagcucgacgagaccaacgacgagcucgcccagaucgcccgcgagcgcgacauccucgcccacgacaacgacaaccuccaggagcaguucgccaaggccaagcaggagaaccaggcccucuccaagaagcucaacgacacccacaacgagcucaacgacaucaagcagaagguccaggacaccaaccucgaggucaacaagcucaagaacauccucaaguccgaggaguccgagaaccgccagaugauggagcagcuccgcaaggccaacgaggacgccgagaacugggagaacaaggcccgccaguccgaggccgacaacaacacccucaagcucgagcucaucaccgccgaggccgagggcaaccgccucaaggagaaggucgacucccucaaccgcgaggucgagcagcaccucaacgccgagcgcuccuacaagucccagaucuccacccuccacaaguccgucgucaagauggaggaggagcuccagaagguccaguucgagaaggucuccgcccucgccgaccucuccuccacccgcgagcucugcaucaagcucgacuccuccaaggagcuccucaaccgccagcucgucgccaaggaccaggagaucgagaugcgcgagaacgagcucgacuccgcccacuccgagaucgagcuccuccgcucccagauggccaacgagcgcaucuccaugcagaaccucgaggcccuccucgucgccaaccgcgacaaggaguaccagucccagaucgcccuccaggagaaggaguccgagauccagcuccucaaggagcaccucugccucgccgagaacaagauggccauccagucccgcgacgucgcccaguuccgcaacgucgucacccagcucgaggccgaccucgacaucaccaagcgccagcucggcaccgagcgcuucgagcgcgagcgcgccguccaggagcuccgccgccagaacuacuccuccaacgccuaccacauguccuccaccaugaagcccaacaccaagugccacucccccgagcgcgcccaccaccgcucccccgaccgcggccucgaccgcucccucgaggagaaccucugcuaccgcgacuucuga

SEQ ID NO: 3706 - RNA, 2097 nt, Artificial Sequence
  derived and/or modified sequence opt3 from TSG10__Homo_sapiens__AAK13079
augaugagaagcagguccaagucuccccggcgcccuucaccaaccgcccgaggcgcuaacugcgacguggagcugcucaaaacaacuacgcgugauagagaggaacuuaaguguaugcuggaaaaauacgagaggcacuuggcagaaauccaggggaaugucaagguuuuaaaaagugagcgggacaagauuuuccugcuauaugagcaagcccaggaagagauaacccgccucagaagggaaaugaugaaguccugcaaauccccgaagucuacaacugcgcaugcuauccugcggcgcguggagaccgagcgagauguagccuuuacagaccuuagaaggaugaccacugaacgggauucgcugcgugagcgcuugaaaauugcacaggaaacagccuucaacgagaaggcucaccucgaacagagaaucgaggagcuggaauguaccgugcauaaucuggacgaugagaggauggaacaaaugucaaacaugacgcucaugaaagagacuauuagcaccgucgaaaaggagaugaagaguuuagcacggaaagccauggacacagaguccgaacugggacgacagaaggcugagaauaacucucuucgcuugcuguacgaaaauacugagaaagaucuaagcgacacccagagacaccucgccaagaaaaaguaugaacugcagcuuacacaagagaaaaucaugugccuggaugagaagauagacaacuuuaccaggcagaauaucgcgcagcgggaagagauuuccaucuuggguggcacgcucaacgaucuggcaaaggaaaaagaguguuuacaggccugccuggacaagaaaucagagaauauugcuagucucggggaaagccuugccaugaaggagaaaacuaucucuggaaugaagaacauaauugcagaaauggagcaagcuagccgccaguguacagaagcccugaucgugugcgagcaggacguuucaagaaugaggcgucaauuggaugagaccaaugacgaacuagcgcagauugcccgggagcgagauauccuggcacaugacaacgauaaucuccaggaacaguucgcuaaggccaaacaagagaaccaggcucugagcaagaaacuuaacgacacucacaaugaacugaacgauaucaagcagaaagugcaggacacaaauuuggaggucaacaagcucaagaauauucugaaaagugaggaaucugagaacagacaaaugauggaacaguuaaggaaggccaaugaggaugcagaaaacugggagaauaaagcccgccaguccgaggcugacaacaauacccugaagcuagaacucauaacggcggaggcagaaggcaaccggcugaaagagaagguggauagccuuaauagagagguagaacagcacuugaacgccgagaggucguacaagucucaaaucuccacccugcauaaaucaguugugaagauggaagaggaacuccagaaaguccaguuugagaaggugagugcucuggccgaccuuagcuccacacgcgagcuguguauuaaauuggacucuagcaaggaacuccugaaucgacaguuaguggcaaaagaucaagagaucgaaaugcgggagaacgaacuggacucagcccacagugagauagagcuacuccguucccagauggcuaacgaaagaauuagcaugcagaaucuggaggcccuuuuggucgcaaacagggauaaggaauaucaaucucagaucgcgcugcaggagaaggaaucagagauccagcuccugaaagagcauuuaugccuggcugaaaauaagauggccauucaaagucgcgacguugcacaguuccggaacgugguaacucagcuugaggccgauuuggacaucaccaaaagacagcucgguacagaaagguuugagcgagagcgcgcugugcaagaacugcggagacagaauuacagcuccaacgccuaucacaugucuucgacuaugaagcccaauaccaaaugucacagcccugagagggcacaucaccguuccccagaucgcgggcuagaccggucacuggaagagaaccucugcuacagagauuucuga

SEQ ID NO: 3707 - RNA, 2097 nt, Artificial Sequence
  derived and/or modified sequence opt4 from TSG10__Homo_sapiens__AAK13079
augaugagaagcagaagcaagagccccagaagacccagccccaccgccagaggcgccaacugcgacguggagcugcugaagaccaccaccagagacagagaggagcugaagugcaugcuggagaaguacgagagacaccuggccgagauccagggcaacgugaaggugcugaagagcgagagagacaagaucuuccugcuguacgagcaggcccaggaggagaucaccagacugagaagagagaugaugaagagcugcaagagccccaagagcaccaccgcccacgccauccugagaagaguggagaccgagagagacguggccuucaccgaccugagaagaaugaccaccgagagagacagccugagagagagacugaagaucgcccaggagaccgccuucaacgagaaggcccaccuggagcagagaaucgaggagcuggagugcaccgugcacaaccuggacgacgagagaauggagcagaugagcaacaugacccugaugaaggagaccaucagcaccguggagaaggagaugaagagccuggccagaaaggccauggacaccgagagcgagcugggcagacagaaggccgagaacaacagccugagacugcuguacgagaacaccgagaaggaccugagcgacacccagagacaccuggccaagaagaaguacgagcugcagcugacccaggagaagaucaugugccuggacgagaagaucgacaacuucaccagacagaacaucgcccagagagaggagaucagcauccugggcggcacccugaacgaccuggccaaggagaaggagugccugcaggccugccuggacaagaagagcgagaacaucgccagccugggcgagagccuggccaugaaggagaagaccaucagcggcaugaagaacaucaucgccgagauggagcaggccagcagacagugcaccgaggcccugaucgugugcgagcaggacgugagcagaaugagaagacagcuggacgagaccaacgacgagcuggcccagaucgccagagagagagacauccuggcccacgacaacgacaaccugcaggagcaguucgccaaggccaagcaggagaaccaggcccugagcaagaagcugaacgacacccacaacgagcugaacgacaucaagcagaaggugcaggacaccaaccuggaggugaacaagcugaagaacauccugaagagcgaggagagcgagaacagacagaugauggagcagcugagaaaggccaacgaggacgccgagaacugggagaacaaggccagacagagcgaggccgacaacaacacccugaagcuggagcugaucaccgccgaggccgagggcaacagacugaaggagaagguggacagccugaacagagagguggagcagcaccugaacgccgagagaagcuacaagagccagaucagcacccugcacaagagcguggugaagauggaggaggagcugcagaaggugcaguucgagaaggugagcgcccuggccgaccugagcagcaccagagagcugugcaucaagcuggacagcagcaaggagcugcugaacagacagcugguggccaaggaccaggagaucgagaugagagagaacgagcuggacagcgcccacagcgagaucgagcugcugagaagccagauggccaacgagagaaucagcaugcagaaccuggaggcccugcugguggccaacagagacaaggaguaccagagccagaucgcccugcaggagaaggagagcgagauccagcugcugaaggagcaccugugccuggccgagaacaagauggccauccagagcagagacguggcccaguucagaaacguggugacccagcuggaggccgaccuggacaucaccaagagacagcugggcaccgagagauucgagagagagagagccgugcaggagcugagaagacagaacuacagcagcaacgccuaccacaugagcagcaccaugaagcccaacaccaagugccacagccccgagagagcccaccacagaagccccgacagaggccuggacagaagccuggaggagaaccugugcuacagagacuucuga

SEQ ID NO: 3708 - RNA, 2097 nt, Artificial Sequence
  derived and/or modified sequence opt5 from TSG10__Homo_sapiens__AAK13079
augaugagaagccgguccaagucuccccgcagaccuagcccgaccgcccggggcgcuaacugcgacguggagcugcucaaaacaacgacccgcgauagagaggaacugaaguguaugcuugaaaaauacgagcggcaccuggccgaaauccaggggaaugucaagguucucaaauccgagcgcgacaagauuuuccugcuuuaugagcaagcgcaggaagagaucacaagacugcggcgcgaaaugaugaagucuugcaaaagccccaaguccaccacagcucaugccauucucagacggguggagaccgagcgcgauguggccuuuacagaccugagacggaugaccacggaacgcgauucucugagagagcggcucaaaaucgcucaggaaaccgccuucaacgagaaggcucaccuggaacagagaauugaggagcuugaauguacaguccauaaucuggacgaugagcgcauggaacaaaugagcaacaugacccucaugaaagagacaaucuccaccguggaaaaggagaugaaaagccuggcccggaaggcgauggacacggagucugaacuuggaagacagaaggccgagaauaacucccugcgccuccuguacgaaaauacagagaaagaucugagcgacacccagcggcaccucgcuaagaaaaaguaugaacugcagcuuacacaagagaaaaucaugugccuggaugagaagauugacaacuuuaccagacagaauaucgcccagcgcgaagagauuucuauccucggcgggacccugaacgaucuugcuaaggaaaaagagugucugcaggccugccucgacaagaaauccgagaauauugcgagccugggagaaucucuggccaugaaggagaaaacaaucuccggcaugaagaacauuaucgcugaaauggagcaagccagccggcaguguacggaagcucucaucguuugcgagcaggacguguccagaaugcgccggcaacuggaugagaccaaugacgaacuugcccagauugccagagagcgcgauauccuggcucaugacaacgauaaucuccaggaacaguucgcgaaggccaaacaagagaaccaggcucugucuaagaaacuuaacgacacacacaaugaacugaacgauauuaagcagaaaguccaggacaccaaucucgaggugaacaagcugaagaauauccugaaaagcgaggaauccgagaaccggcaaaugauggaacagcucagaaaggccaaugaggaugccgaaaacugggagaauaaagcucggcagagcgaggccgacaacaauacacugaaacuugaacugauuaccgcggaggcugaagggaaccgccucaaggagaagguugauucucugaauagagagguggaacagcaccugaacgccgagcgguccuacaagagccaaaucucuacgcuucauaaaagcgucgugaagauggaagaggaacuccagaaagugcaguuugagaaggucuccgcccuggcugaccugucuagcacaagagagcucuguaucaaacuggacuccagcaaggaacuucugaaucgccagcucguugccaaagaucaagagauugaaaugcgggagaacgaacuggacucugcucacuccgagaucgagcugcuuagaagccagauggccaacgaacgcauuucuaugcagaaucucgaggcgcugcugguggccaacagagauaaggaauaucaaucccagaucgcucuccaggagaaggaaagcgagauucagcugcuuaaagagcaucugugccucgccgaaaauaagauggcuauccaaucccgggacguggcccaguuccgcaacgucgugacccagcuggaggcggaucuggacaucaccaaaagacagcuuggaacagaacgguuugagcgcgagagagccguucaagaacuccggcgccagaauuacucuagcaacgcuuaucacauguccucuaccaugaagccuaauacaaaaugucacagccccgagagagcccaucaccgguccccugaucgcggccuggacagaagccuggaagagaaccucugcuaccgggauuucuga

SEQ ID NO: 3709 - protein, 308 aa, Artificial Sequence
  TSPY1__Homo_sapiens__Q01534
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESAPEELLAVQVELEPVNAQARKAFSRQREKMERRRKPHLDRRGAVIQSVPGFWANVIANHPQMSALITDEDEDMLSYMVSLEVGEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 3710 - RNA, 927 nt, Artificial Sequence
  TSPY1__Homo_sapiens__CCDS48205.1
augcgcccugagggcucgcugaccuaccgggugccagagaggcugcggcaggguuucuguggcgugggucgggcagcacaggccuuggugugugcgagugccaaggagggcaccgccuucaggauggaggcugugcaggagggggcggccgggguggagagugagcaggcggcuuugggggaggaggcggugcugcuguuggaugacauaauggcggagguggaggugguggcggaggaggagggccucguggagcggcgggaggaggcccagcgggcacagcaggcugugccuggcccugggcccaugaccccagagucugcaccggaggagcugcuggccguucagguggagcuggagccgguuaaugcccaagccaggaaggccuuuucucggcagcgggaaaagauggagcggaggcgcaagccccaccuagaccgcagaggcgccgucauccagagcgucccuggcuucugggccaauguuauugcaaaccacccccagaugucagcccugaucacugacgaagaugaagacaugcugagcuacauggucagccuggaggugggagaagagaagcauccuguucaucucugcaagaucauguuguucuuucggaguaaccccuacuuccagaauaaagugauuaccaaggaauaucuggugaacaucacagaauacagggcuucucauuccacuccaauugagugguauccggauuaugaaguggaggccuaucgccgcagacaccacaacagcagccuuaacuucuucaacugguucucugaccacaacuucgcaggaucuaacaagauugcugagauccuauguaaggaccuguggcgcaauccccugcaauacuacaagaggaugaagccaccugaagagggaacagagacgucaggggacucccaguuguugaguuga

SEQ ID NO: 3711 - RNA, 927 nt, Artificial Sequence
  derived and/or modified sequence opt1 from TSPY1__Homo_sapiens__CCDS48205.1
augcgccccgagggcagccugaccuaccgggugccggagcgccuccggcagggguucugcggcgucgggcgcgccgcccaggcgcuggugugcgccuccgccaaggagggcaccgccuuccggauggaggccgugcaggagggggcggccggcgucgagagcgagcaggccgcccugggcgaggaggcggugcuccugcuggacgacaucauggccgagguggaggucguggccgaggaggaggggcucguggagcgccgggaggaggcccagcgcgcccagcaggcgguccccggccccgggcccaugacgccggaguccgcccccgaggagcugcuggccguccagguggagcucgagcccgugaacgcccaggcccggaaggcguucagccgccagcgggagaagauggagcgccggcgcaagccccaccuggaccggcgcggcgccgugauccaguccgugccgggguucugggccaacgucaucgccaaccacccccagaugagcgcccugaucaccgacgaggacgaggacaugcucuccuacauggugagccuggaggugggcgaggagaagcaccccguccaccugugcaagaucaugcuguucuuccgguccaaccccuacuuccagaacaaggugaucaccaaggaguaccucgugaacaucaccgaguaccgcgcgagccacuccacgccgaucgagugguaccccgacuacgaggucgaggccuaccggcgccggcaccacaacagcucccugaacuucuucaacugguucagcgaccacaacuucgccggcuccaacaagaucgccgagauccucugcaaggaccuguggcgcaacccccugcaguacuacaagcgcaugaagcccccggaggaggggaccgagaccagcggcgacucccagcuccugagcuga

SEQ ID NO: 3712 - RNA, 927 nt, Artificial Sequence
  derived and/or modified sequence opt2 from TSPY1__Homo_sapiens__CCDS48205.1
augcgccccgagggcucccucaccuaccgcguccccgagcgccuccgccagggcuucugcggcgucggccgcgccgcccaggcccucgucugcgccuccgccaaggagggcaccgccuuccgcauggaggccguccaggagggcgccgccggcgucgaguccgagcaggccgcccucggcgaggaggccguccuccuccucgacgacaucauggccgaggucgaggucgucgccgaggaggagggccucgucgagcgccgcgaggaggcccagcgcgcccagcaggccguccccggccccggccccaugacccccgaguccgcccccgaggagcuccucgccguccaggucgagcucgagcccgucaacgcccaggcccgcaaggccuucucccgccagcgcgagaagauggagcgccgccgcaagccccaccucgaccgccgcggcgccgucauccaguccguccccggcuucugggccaacgucaucgccaaccacccccagauguccgcccucaucaccgacgaggacgaggacaugcucuccuacauggucucccucgaggucggcgaggagaagcaccccguccaccucugcaagaucaugcucuucuuccgcuccaaccccuacuuccagaacaaggucaucaccaaggaguaccucgucaacaucaccgaguaccgcgccucccacuccacccccaucgagugguaccccgacuacgaggucgaggccuaccgccgccgccaccacaacuccucccucaacuucuucaacugguucuccgaccacaacuucgccggcuccaacaagaucgccgagauccucugcaaggaccucuggcgcaacccccuccaguacuacaagcgcaugaagccccccgaggagggcaccgagaccuccggcgacucccagcuccucuccuga

SEQ ID NO: 3713 - RNA, 927 nt, Artificial Sequence
  derived and/or modified sequence opt3 from TSPY1__Homo_sapiens__CCDS48205.1
augagacccgagggcagccugaccuacagggugccugaacggcuccgccagggguucugcggagucggucgagccgcucaagcacuuguuugugccuccgcgaaggagggcacagcuuuucguauggaagccgugcaggagggggcagccggaguagaaucugagcaggcugcacugggcgaggaagccguguuguuacuggacgauaucauggcugaggucgaagugguugccgaggaggaaggucuaguggagagaagggaagaggcgcagcgggcacaacaggccgucccagggccgggacccaugacuccugaaucagcuccagaggagcuccuggccgugcagguagaacuugagcccguuaacgcacaggcucgcaaagccuucaguagacaaagggaaaagauggagcggcgccgaaaaccucaccuggacagaaggggcgcggugauucagagcgucccaggcuuuugggccaaugugauagcaaaccauccccagauguccgcuuugaucacggaugaagacgaggauaugcucucuuauauggugucgcuggaggucggggaagagaagcacccuguucaucugugcaaaauuauguuauucuuucggucaaauccauacuuccagaacaaggugaucaccaaggaauaucucguaaauauuacagaguaccgugccagccacaguacuccgaucgaaugguaucccgacuacgagguggaggcuuaucgcagaaggcaucacaacuccucucugaacuuuuucaauugguuuagcgaucacaauuucgccggauccaacaaaauagcagaaauccuuuguaaggacuuguggcggaauccucugcaauacuacaaacgaaugaagccacccgaggaagguaccgagacaucaggcgauagucagcuacucagcuga

SEQ ID NO: 3714 - RNA, 927 nt, Artificial Sequence
  derived and/or modified sequence opt4 from TSPY1__Homo_sapiens__CCDS48205.1
augagacccgagggcagccugaccuacagagugcccgagagacugagacagggcuucugcggcgugggcagagccgcccaggcccuggugugcgccagcgccaaggagggcaccgccuucagaauggaggccgugcaggagggcgccgccggcguggagagcgagcaggccgcccugggcgaggaggccgugcugcugcuggacgacaucauggccgagguggaggugguggccgaggaggagggccugguggagagaagagaggaggcccagagagcccagcaggccgugcccggccccggccccaugacccccgagagcgcccccgaggagcugcuggccgugcagguggagcuggagcccgugaacgcccaggccagaaaggccuucagcagacagagagagaagauggagagaagaagaaagccccaccuggacagaagaggcgccgugauccagagcgugcccggcuucugggccaacgugaucgccaaccacccccagaugagcgcccugaucaccgacgaggacgaggacaugcugagcuacauggugagccuggaggugggcgaggagaagcaccccgugcaccugugcaagaucaugcuguucuucagaagcaaccccuacuuccagaacaaggugaucaccaaggaguaccuggugaacaucaccgaguacagagccagccacagcacccccaucgagugguaccccgacuacgagguggaggccuacagaagaagacaccacaacagcagccugaacuucuucaacugguucagcgaccacaacuucgccggcagcaacaagaucgccgagauccugugcaaggaccuguggagaaacccccugcaguacuacaagagaaugaagccccccgaggagggcaccgagaccagcggcgacagccagcugcugagcuga

SEQ ID NO: 3715 - RNA, 927 nt, Artificial Sequence
  derived and/or modified sequence opt5 from TSPY1__Homo_sapiens__CCDS48205.1
augagacccgagggcagccugaccuaccgggugccugaacgccucagacagggguucugcggagucggccgggccgcucaagcccugguuugugcguccgcuaaggaggggacagccuuucgcauggaagccgugcaggagggagcugccggcguggaaucugagcaggcugcccuuggggaggaagcgguccugcuccuggacgauaucauggccgagguggaaguuguggcugaggaggaaggacuugucgagagacgggaagaggcccagcgcgcucaacaggccgugccgggccccggcccuaugacgcccgaaagcgcgccugaggagcugcucgccguucagguggaacuggagcccgucaacgcucaggccagaaaagccuucucccggcaacgcgaaaagauggagagacggcgcaaaccucaccuggacagacgcggggcugugauucagucugugccgggauuuugggccaaugucaucgcuaaccauccccagaugagcgcgcucauuaccgaugaagacgaggauaugcuguccuauaugguuucucuugaggugggcgaagagaagcacccugugcaucugugcaaaaucaugcuguucuuucggagcaaucccuacuuccagaacaaggucauuacaaaggaauaucucgugaauaucaccgaguacagagccucccacagcacaccuaucgaaugguaucccgacuacgagguugaggcuuaucggagacgccaucacaacucuucccuuaacuuuuucaauugguuuagcgaucacaauuucgccgggucuaacaaaauugccgaaauccuguguaaggaccucuggcggaauccgcugcaauacuacaaaagaaugaagccucccgaggaaggaaccgagacauccggcgauagccagcugcucucuuga

SEQ ID NO: 3716 - protein, 122 aa, Artificial Sequence
  TVC_(TRGV3)__Homo_sapiens__M13231.1
MRWALLVLLAFLSPASQKSSNLEGRTKSVTRQTGSSAEITCDLTVTNTFYIHWYLHQEGKAPQRLLYYDVSTARDVLESGLSPGKYYTHTPRRWSWILRLQNLIENDSGVYYCATWDRQKLL

SEQ ID NO: 3717 - RNA, 369 nt, Artificial Sequence
  TVC_(TRGV3)__Homo_sapiens__M13231.1
augcggugggcccuacuggugcuucuagcuuuccugucuccugccagucagaaaucuuccaacuuggaagggagaacgaagucagucaccaggcagacugggucaucugcugaaaucacuugcgaucuuacuguaacaaauaccuucuacauccacugguaccuacaccaggaggggaaggccccacagcgucuucuguacuaugacgucuccacugcaagggauguguuggaaucaggacucaguccaggaaaguauuauacucauacacccaggagguggagcuggauauugagacugcaaaaucuaauugaaaaugauucuggggucuauuacugugccaccugggacaggcaaaaauuauuauaa

SEQ ID NO: 3718 - RNA, 369 nt, Artificial Sequence
  derived and/or modified sequence opt1 from TVC_(TRGV3)__Homo_sapiens__M13231.1
augcgcugggcccugcucgugcugcuggccuuccucagccccgcgucccagaaguccagcaaccuggagggccggaccaagagcgucacccgccagacgggguccagcgccgagaucacgugcgaccugaccgugaccaacaccuucuacauccacugguaccuccaccaggagggcaaggccccgcagcggcugcuguacuacgacguguccaccgcccgcgacguccucgagagcgggcugucccccggcaaguacuacacccacacgccccggcgcuggagcuggauccugcggcuccagaaccugaucgagaacgacuccgggguguacuacugcgccaccugggaccgccagaagcugcucuga

SEQ ID NO: 3719 - RNA, 369 nt, Artificial Sequence
  derived and/or modified sequence opt2 from TVC_(TRGV3)__Homo_sapiens__M13231.1
augcgcugggcccuccucguccuccucgccuuccucucccccgccucccagaaguccuccaaccucgagggccgcaccaaguccgucacccgccagaccggcuccuccgccgagaucaccugcgaccucaccgucaccaacaccuucuacauccacugguaccuccaccaggagggcaaggccccccagcgccuccucuacuacgacgucuccaccgcccgcgacguccucgaguccggccucucccccggcaaguacuacacccacaccccccgccgcugguccuggauccuccgccuccagaaccucaucgagaacgacuccggcgucuacuacugcgccaccugggaccgccagaagcuccucuga

SEQ ID NO: 3720 - RNA, 369 nt, Artificial Sequence
  derived and/or modified sequence opt3 from TVC_(TRGV3)__Homo_sapiens__M13231.1
augagaugggcccugcucgugcuucuggcuuucuugagccccgcaucccagaagucuucaaacuuagagggcaggaccaaaagugucacacggcaaacugggagcuccgccgaaaucacgugcgaccugaccguuacaaauacuuuuuacauucacugguaucuacaucaggagggaaaggcgccucagcgccuccuguacuaugaugugucuaccgcucgagacguacuugaaucgggucugucaccaggcaaauacuauacacacaccccgcguagauggagcuggauauugaggcuccagaaccugaucgagaaugauagugggguguacuauugugccacuugggaccggcaaaagcugcucuga

SEQ ID NO: 3721 - RNA, 369 nt, Artificial Sequence
  derived and/or modified sequence opt4 from TVC_(TRGV3)__Homo_sapiens__M13231.1
augagaugggcccugcuggugcugcuggccuuccugagccccgccagccagaagagcagcaaccuggagggcagaaccaagagcgugaccagacagaccggcagcagcgccgagaucaccugcgaccugaccgugaccaacaccuucuacauccacugguaccugcaccaggagggcaaggccccccagagacugcuguacuacgacgugagcaccgccagagacgugcuggagagcggccugagccccggcaaguacuacacccacacccccagaagauggagcuggauccugagacugcagaaccugaucgagaacgacagcggcguguacuacugcgccaccugggacagacagaagcugcuguga

SEQ ID NO: 3722 - RNA, 369 nt, Artificial Sequence
  derived and/or modified sequence opt5 from TVC_(TRGV3)__Homo_sapiens__M13231.1
augagaugggcccugcucgugcugcuugcuuuccugagccccgccucccagaagucuagcaaccucgagggccggaccaaauccgucacacgccaaacggggucuagcgcggaaauuaccugcgaccugacaguuaccaauacauuuuacauccacugguaucuucaucaggagggaaaggcuccucagagacugcucuacuaugauguguccaccgcccgggacgugcuggaaucuggccugagcccggggaaauacuauacacacacgccccgcagaugguccuggauccuccggcugcagaaccuuauugagaaugauagcggagucuacuauugugccaccugggaccgccaaaagcugcucuga

SEQ ID NO: 3723 - protein, 267 aa, Artificial Sequence
  TX101__Homo_sapiens__Q9BY14-2
MGARQIQTSSSQTSPEEAMGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 3724 - RNA, 804 nt, Artificial Sequence
  TX101__Homo_sapiens__CCDS12619.1
augggggcgaggcagauccagaccagcuccucccagaccucuccagaagaagccaugggaaccccucguauccagcauuugcugauccuccugguccuaggagccucccuccugaccucgggccuagagcuguauugucaaaagggucuguccaugacuguggaagcagauccagccaauauguuuaacuggaccacagaggaaguggagacuugugacaaaggggcacuuugccaggaaaccauacuaauaauuaaagcagggacugagacagccauuuuggccacgaagggcugcaucccggaaggggaggaggccauaacaauuguccagcacucuucaccucccggccugaucgugaccuccuacaguaacuacugugaggauuccuucuguaaugacaaagacagccugucucaguuuugggaguucagugagaccacagcuuccacugugucaacaacccuccauuguccaaccuguguggcuuuggggaccuguuucagugcuccuucucuucccugucccaaugguacaacucgaugcuaucaaggaaaacuugagaucacuggagguggcauugagucgucuguggaggucaaaggcuguacagccaugauuggcugcaggcugaugucuggaaucuuagcaguaggacccauguuugugagggaagcgugcccacaucagcugcucacucaaccucgaaagacugaaaauggggccaccugucuucccauuccuguuuggggguuacagcuacugcugccauugcugcugccaucauuuauucacuuuuccuaa

SEQ ID NO: 3725 - RNA, 804 nt, Artificial Sequence
  derived and/or modified sequence opt1 from TX101__Homo_sapiens__CCDS12619.1
augggcgcccgccagauccagaccagcuccagccagaccucccccgaggaggccauggggacgccgcggauccagcaccuccugauccugcuggugcucggcgcgagccugcugaccuccgggcucgagcuguacugccagaagggccugagcaugaccgucgaggccgaccccgccaacauguucaacuggaccacggaggagguggagaccugcgacaagggggcccucugccaggagaccauccugaucaucaaggccggcaccgagacggcgauccuggccaccaagggcugcauccccgagggggaggaggccaucaccaucgugcagcacuccagcccgcccggccucaucgucaccuccuacagcaacuacugcgaggacuccuucugcaacgacaaggacagccugucccaguucugggaguucagcgagacgaccgccuccaccgugagcaccacgcugcacugcccgaccugcguggcgcucgggaccugcuucuccgcccccagccugcccugccccaacggcaccacgcgcugcuaccaggggaagcuggagaucaccggcggcgggaucgaguccagcgucgaggugaagggcugcaccgccaugaucgggugccggcucaugagcggcauccuggccgugggccccauguucguccgcgaggccugcccccaccagcugcucacccagccccggaagacggagaacggggcgaccugccugccgauccccguguggggccugcagcuccugcugccccuccugcugcccuccuucauccacuucagcuga

SEQ ID NO: 3726 - RNA, 804 nt, Artificial Sequence
  derived and/or modified sequence opt2 from TX101__Homo_sapiens__CCDS12619.1
augggcgcccgccagauccagaccuccuccucccagaccucccccgaggaggccaugggcaccccccgcauccagcaccuccucauccuccucguccucggcgccucccuccucaccuccggccucgagcucuacugccagaagggccucuccaugaccgucgaggccgaccccgccaacauguucaacuggaccaccgaggaggucgagaccugcgacaagggcgcccucugccaggagaccauccucaucaucaaggccggcaccgagaccgccauccucgccaccaagggcugcauccccgagggcgaggaggccaucaccaucguccagcacuccuccccccccggccucaucgucaccuccuacuccaacuacugcgaggacuccuucugcaacgacaaggacucccucucccaguucugggaguucuccgagaccaccgccuccaccgucuccaccacccuccacugccccaccugcgucgcccucggcaccugcuucuccgcccccucccuccccugccccaacggcaccacccgcugcuaccagggcaagcucgagaucaccggcggcggcaucgaguccuccgucgaggucaagggcugcaccgccaugaucggcugccgccucauguccggcauccucgccgucggccccauguucguccgcgaggccugcccccaccagcuccucacccagccccgcaagaccgagaacggcgccaccugccuccccauccccgucuggggccuccagcuccuccucccccuccuccuccccuccuucauccacuucuccuga

SEQ ID NO: 3727 - RNA, 804 nt, Artificial Sequence
  derived and/or modified sequence opt3 from TX101__Homo_sapiens__CCDS12619.1
augggcgccagacagauccaaaccagcuccucucagacaucaccagaggaagcuauggggacuccuaggauucagcaucugcucauacuucugguguugggagcaaguuuacugacgagcggucuagagcucuacugccagaagggccuguccaugaccgucgaagccgacccagcgaacauguucaauuggacaacugaggaaguugagaccugugauaaaggggcucuuugccaagagacaauccugauuaucaaggccggaaccgaaacugcaauuuuggccacaaaaggcuguaucccggagggugaagaggcuauaaccaucgugcagcacucuucgcccccugggcucauuguaacgucauauagcaacuacugcgaggacaguuuuuguaaugauaaggacucccugucucaguucugggaauuuagcgagacuaccgcauccacagugucaacuacccugcacugcccaacaugugucgcccucggaaccugcuucagugcucccagcuuaccuuguccaaacggcacgacucggugcuaucagggcaaacuggaaaucacagggggagguauugagucuuccguggaaguuaagggcuguaccgccaugaucgggugccgccuuaugucaggaauauuggcggugggccccauguuuguccgagaggcaugcccucaucaacugcuaacucagccacguaagacagagaauggugccaccugucucccgauucccgugugggggcugcagcuucuguugccucuccuguuacccagcuucauccacuuuaguuga

SEQ ID NO: 3728 - RNA, 804 nt, Artificial Sequence
  derived and/or modified sequence opt4 from TX101__Homo_sapiens__CCDS12619.1
augggcgccagacagauccagaccagcagcagccagaccagccccgaggaggccaugggcacccccagaauccagcaccugcugauccugcuggugcugggcgccagccugcugaccagcggccuggagcuguacugccagaagggccugagcaugaccguggaggccgaccccgccaacauguucaacuggaccaccgaggagguggagaccugcgacaagggcgcccugugccaggagaccauccugaucaucaaggccggcaccgagaccgccauccuggccaccaagggcugcauccccgagggcgaggaggccaucaccaucgugcagcacagcagcccccccggccugaucgugaccagcuacagcaacuacugcgaggacagcuucugcaacgacaaggacagccugagccaguucugggaguucagcgagaccaccgccagcaccgugagcaccacccugcacugccccaccugcguggcccugggcaccugcuucagcgcccccagccugcccugccccaacggcaccaccagaugcuaccagggcaagcuggagaucaccggcggcggcaucgagagcagcguggaggugaagggcugcaccgccaugaucggcugcagacugaugagcggcauccuggccgugggccccauguucgugagagaggccugcccccaccagcugcugacccagcccagaaagaccgagaacggcgccaccugccugcccauccccguguggggccugcagcugcugcugccccugcugcugcccagcuucauccacuucagcuga

SEQ ID NO: 3729 - RNA, 804 nt, Artificial Sequence
  derived and/or modified sequence opt5 from TX101__Homo_sapiens__CCDS12619.1
augggcgccagacagauccaaaccagcuccucucagacaagccccgaggaagcuauggggacgccucggauucagcaucugcucauccugcuugugcugggagccucccuccugaccucuggccuugagcuguacugccagaaggggcucagcaugacagucgaagcggacccggcuaacauguucaauuggaccacagaggaaguugagaccugugauaaaggagcccugugccaagagacaauucugaucauuaaggccggcaccgaaacggcuauccucgccaccaaaggguguauccccgagggagaagaggcuauuacaaucgugcagcacuccucuccucccggccugauugugaccagcuauuccaacuacugcgaggacagcuuuuguaaugauaaggacucucuuucccaguucugggaauuuagcgagacaaccgccucuacggucuccacaacccugcacugcccuacauguguggcgcucggaaccugcuucagcgcccccucucugccuuguccgaacgggaccacacgcugcuaucagggaaaacuugaaaucacgggcgggggaauugaguccagcguugaagugaagggcuguaccgcuaugaucgggugcagacugauguccggcauucucgccgucggccccauguuugugcgggaggcuugcccucaucaacugcugacacagccccgcaagaccgagaauggcgccacaugucucccuauccccguuugggggcugcagcuucugcucccgcugcuucugccuucuuucauccacuuuagcuga

SEQ ID NO: 3730 - protein, 529 aa, Artificial Sequence [sequence omitted]

SEQ ID NO: 3731 - RNA, 1590 nt, Artificial Sequence
  tyrosinase__Homo_sapiens__AHZ44440
augcuccuggcuguuuuguacugccugcuguggaguuuccagaccuccgcuggccauuucccuagagccugugucuccucuaagaaccugauggagaaggaaugcuguccaccguggagcggggacaggagucccuguggccagcuuucaggcagagguuccugucagaauauccuucuguccaaugcaccacuugggccucaauuucccuucacagggguggaugaccgggagucguggccuuccgucuuuuauaauaggaccugccagugcucuggcaacuucaugggauucaacuguggaaacugcaaguuuggcuuuuggggaccaaacugcacagagagacgacucuuggugagaagaaacaucuucgauuugagugccccagagaaggacaaauuuuuugccuaccucacuuuagcaaagcauaccaucagcucagacuaugucauccccauagggaccuauggccaaaugaaaaauggaucaacacccauguuuaacgacaucaauauuuaugaccucuuugucuggaugcauuauuaugugucaauggaugcacugcuugggggaucugaaaucuggagagacauugauuuugcccaugaagcaccagcuuuucugccuuggcauagacucuucuuguugcggugggaacaagaaauccagaagcugacaggagaugaaaacuucacuauuccauauugggacuggcgggaugcagaaaagugugacauuugcacagaugaguacaugggaggucagcaccccacaaauccuaacuuacucagcccagcaucauucuucuccucuuggcagauugucuguagccgauuggaggaguacaacagccaucagucuuuaugcaauggaacgcccgagggaccuuuacggcguaauccuggaaaccaugacaaauccagaaccccaaggcuccccucuucagcugauguagaauuuugccugaguuugacccaauaugaaucugguuccauggauaaagcugccaauuucagcuuuagaaauacacuggaaggauuugcuaguccacuuacugggauagcggaugccucucaaagcagcaugcacaaugccuugcacaucuauaugaauggaacaaugucccagguacagggaucugccaacgauccuaucuuccuucuucaccaugcauuuguugacaguauuuuugagcaguggcuccgaaggcaccguccucuucaagaaguuuauccagaagccaaugcacccauuagacauaaccgggaauccuacaugguuccuuuuauaccacuguacagaaauggugauuucuuuauuucauccaaagaucugggcuaugacuauagcuaucuacaagauucagacccagacucuuuucaagacuacauuaaguccuauuuggaacaagcgagucggaucuggucauggcuccuuggggcggcgaugguaggggccguccucacugcccugcuggcagggcuugugagcuugcugugucgucacaagagaaagcagcuuccugaagaaaagcagccacuccucauggagaaagaggauuaccacagcuuguaucagagccauuuauaa

SEQ ID NO: 3732 - RNA, 1590 nt, Artificial Sequence
  derived and/or modified sequence opt1 from tyrosinase__Homo_sapiens__AHZ44440
augcugcucgccgugcuguacugccugcucuggagcuuccagaccuccgccggccacuucccccgcgcgugcgucagcuccaagaaccugauggagaaggagugcugcccgcccuggagcggggaccggucccccugcggccagcugagcgggcgcggcuccugccagaacauccuccugagcaacgcgccccuggggccgcaguuccccuucaccggcguggacgaccgggaguccuggcccagcguguucuacaaccgcacgugccagugcuccggcaacuucaugggguucaacugcggcaacugcaaguucggguucuggggccccaacugcaccgagcggcgccuccugguccggcgcaacaucuucgaccugagcgccccggagaaggacaaguucuucgccuaccucacccuggccaagcacaccaucuccagcgacuacgugauccccaucgggacguacggccagaugaagaacggcuccacccccauguucaacgacaucaacaucuacgaccuguucguguggaugcacuacuacgucagcauggacgcccuccucgggggcuccgagaucuggcgggacaucgacuucgcccacgaggcccccgccuuccugccguggcaccgccuguuccugcugcggugggagcaggagauccagaagcucaccggggacgagaacuucaccauccccuacugggacuggcgcgacgcggagaagugcgacaucugcacggacgaguacaugggcggccagcaccccaccaaccccaaccugcugagcccggccuccuucuucagcagcuggcagaucgugugcucccggcucgaggaguacaacagccaccagucccugugcaacgggacccccgagggcccccugcgccggaaccccgggaaccacgacaagagccgcaccccgcggcuccccuccagcgccgacguggaguucugccugucccugacgcaguacgagagcggcuccauggacaaggccgccaacuucagcuuccgcaacacccucgagggguucgcgagcccccugaccggcaucgccgacgccucccaguccagcaugcacaacgcccugcacaucuacaugaacggcaccaugucccagguccaggggagcgccaacgaccccaucuuccuccugcaccacgcguucguggacuccaucuucgagcaguggcugcggcgccaccggccgcuccaggagguguaccccgaggccaacgcccccauccgccacaaccgcgagagcuacaugguccccuucaucccgcuguaccggaacggcgacuucuucaucuccagcaaggaccugggguacgacuacagcuaccuccaggacuccgaccccgacagcuuccaggacuacaucaaguccuaccuggagcaggccagccgcaucugguccuggcugcucggcgccgcgauggugggggccgugcugacggcccugcucgccggccuggucagccugcucugccggcacaagcgcaagcagcugcccgaggagaagcagccgcugcugauggagaaggaggacuaccacucccucuaccagagccaccuguga

SEQ ID NO: 3733 - RNA, 1590 nt, Artificial Sequence
  derived and/or modified sequence opt2 from tyrosinase__Homo_sapiens__AHZ44440
augcuccucgccguccucuacugccuccucugguccuuccagaccuccgccggccacuucccccgcgccugcgucuccuccaagaaccucauggagaaggagugcugcccccccugguccggcgaccgcucccccugcggccagcucuccggccgcggcuccugccagaacauccuccucuccaacgccccccucggcccccaguuccccuucaccggcgucgacgaccgcgaguccuggcccuccgucuucuacaaccgcaccugccagugcuccggcaacuucaugggcuucaacugcggcaacugcaaguucggcuucuggggccccaacugcaccgagcgccgccuccucguccgccgcaacaucuucgaccucuccgcccccgagaaggacaaguucuucgccuaccucacccucgccaagcacaccaucuccuccgacuacgucauccccaucggcaccuacggccagaugaagaacggcuccacccccauguucaacgacaucaacaucuacgaccucuucgucuggaugcacuacuacgucuccauggacgcccuccucggcggcuccgagaucuggcgcgacaucgacuucgcccacgaggcccccgccuuccuccccuggcaccgccucuuccuccuccgcugggagcaggagauccagaagcucaccggcgacgagaacuucaccauccccuacugggacuggcgcgacgccgagaagugcgacaucugcaccgacgaguacaugggcggccagcaccccaccaaccccaaccuccucucccccgccuccuucuucuccuccuggcagaucgucugcucccgccucgaggaguacaacucccaccagucccucugcaacggcacccccgagggcccccuccgccgcaaccccggcaaccacgacaagucccgcaccccccgccuccccuccuccgccgacgucgaguucugccucucccucacccaguacgaguccggcuccauggacaaggccgccaacuucuccuuccgcaacacccucgagggcuucgccuccccccucaccggcaucgccgacgccucccaguccuccaugcacaacgcccuccacaucuacaugaacggcaccaugucccagguccagggcuccgccaacgaccccaucuuccuccuccaccacgccuucgucgacuccaucuucgagcaguggcuccgccgccaccgcccccuccaggaggucuaccccgaggccaacgcccccauccgccacaaccgcgaguccuacaugguccccuucaucccccucuaccgcaacggcgacuucuucaucuccuccaaggaccucggcuacgacuacuccuaccuccaggacuccgaccccgacuccuuccaggacuacaucaaguccuaccucgagcaggccucccgcaucugguccuggcuccucggcgccgccauggucggcgccguccucaccgcccuccucgccggccucgucucccuccucugccgccacaagcgcaagcagcuccccgaggagaagcagccccuccucauggagaaggaggacuaccacucccucuaccagucccaccucuga

SEQ ID NO: 3734 - RNA, 1590 nt, Artificial Sequence
  derived and/or modified sequence opt3 from tyrosinase__Homo_sapiens__AHZ44440
augcugcucgccgugcuuuacugccuguuguggagcuuccagaccuccgcuggccacuuucccagagcaugugucucuucaaagaacuuaauggagaaagaaugcuguccuccauggaguggggacaggagcccgugcggacaacuguccggucggggcucuugucagaauauccuacucucgaacgcccccuuggggccucaguucccauuuacaggaguugaugaccgcgagucauggcccagcguguucuauaaucgaacuugccaguguaguggcaacuuuauggguuucaauugcgggaacuguaaguuuggauucuggggcccuaauugcacggaacguagacuucugguaaggcggaacauuuuugauuuguccgcgccagagaaagacaaguucuuugcuuaccucacccuggccaaacauacaauaucuagcgauuaugugauccccauuggcacuuacgggcaaaugaagaauggauccaccccuauguucaacgacaucaauauuuaugaucuguuugucuggaugcacuacuaugugucaauggacgcacucuuagguggcagugaaaucuggcgcgauauagacuucgcccaugaggcuccagcauuccugccguggcacagacuuuuucugcugaggugggagcaggaaauccagaagcuaacaggggaugagaacuucaccauucccuacugggacuggcgggaugccgaaaaaugugacaucugcacugacgaguacaugggaggccagcauccuacaaauccaaaccuccugagccccgcuuccuuuuucucuucauggcaaauuguuugcagccgccuugaggaauauaauagucaccagucucuguguaacgguaccccugaggggccauugcgaagaaaccccggaaaucacgauaaguccaggacgccgcggcucccuagcucggccgacguggaauuuugccugucuuuaacucaguacgaguccggcucaauggauaaagcggcaaacuucaguuuucguaauacccuggaaggcuucgccagcccccucacagggaucgcugacgccucccagucuagcaugcauaacgcacuucacauauauaugaauggaacuaugucacaaguccaggguagugcuaacgauccaauuuuucuguugcaucacgccuucguggacuccaucuuugagcaguggcuacgcagacacaggccucugcaagagguauaccccgaagcgaaugccccaauucggcauaaccgagagagcuauaugguucccuucaucccucucuaccgcaauggcgacuuuuucaucucuucaaaggaucugggguaugauuacaguuaccuucaggacagcgauccagacuccuuccaggacuauauuaaaucuuaccuggaacaggcaucgagaauauggagcugguugcucggagcugccauggugggcgcuguccugaccgccuuacuggcaggucuagugucccuccuguguaggcacaagcggaagcaacuuccggaggaaaaacagcccuugcugauggagaaggaggauuaucauucacucuaccagagucaccuguga

SEQ ID NO: 3735 - RNA, 1590 nt, Artificial Sequence
  derived and/or modified sequence opt4 from tyrosinase__Homo_sapiens__AHZ44440
augcugcuggccgugcuguacugccugcuguggagcuuccagaccagcgccggccacuuccccagagccugcgugagcagcaagaaccugauggagaaggagugcugcccccccuggagcggcgacagaagccccugcggccagcugagcggcagaggcagcugccagaacauccugcugagcaacgccccccugggcccccaguuccccuucaccggcguggacgacagagagagcuggcccagcguguucuacaacagaaccugccagugcagcggcaacuucaugggcuucaacugcggcaacugcaaguucggcuucuggggccccaacugcaccgagagaagacugcuggugagaagaaacaucuucgaccugagcgcccccgagaaggacaaguucuucgccuaccugacccuggccaagcacaccaucagcagcgacuacgugauccccaucggcaccuacggccagaugaagaacggcagcacccccauguucaacgacaucaacaucuacgaccuguucguguggaugcacuacuacgugagcauggacgcccugcugggcggcagcgagaucuggagagacaucgacuucgcccacgaggcccccgccuuccugcccuggcacagacuguuccugcugagaugggagcaggagauccagaagcugaccggcgacgagaacuucaccauccccuacugggacuggagagacgccgagaagugcgacaucugcaccgacgaguacaugggcggccagcaccccaccaaccccaaccugcugagccccgccagcuucuucagcagcuggcagaucgugugcagcagacuggaggaguacaacagccaccagagccugugcaacggcacccccgagggcccccugagaagaaaccccggcaaccacgacaagagcagaacccccagacugcccagcagcgccgacguggaguucugccugagccugacccaguacgagagcggcagcauggacaaggccgccaacuucagcuucagaaacacccuggagggcuucgccagcccccugaccggcaucgccgacgccagccagagcagcaugcacaacgcccugcacaucuacaugaacggcaccaugagccaggugcagggcagcgccaacgaccccaucuuccugcugcaccacgccuucguggacagcaucuucgagcaguggcugagaagacacagaccccugcaggagguguaccccgaggccaacgcccccaucagacacaacagagagagcuacauggugcccuucaucccccuguacagaaacggcgacuucuucaucagcagcaaggaccugggcuacgacuacagcuaccugcaggacagcgaccccgacagcuuccaggacuacaucaagagcuaccuggagcaggccagcagaaucuggagcuggcugcugggcgccgccauggugggcgccgugcugaccgcccugcuggccggccuggugagccugcugugcagacacaagagaaagcagcugcccgaggagaagcagccccugcugauggagaaggaggacuaccacagccuguaccagagccaccuguga

SEQ ID NO: 3736 - RNA, 1590 nt, Artificial Sequence
  derived and/or modified sequence opt5 from tyrosinase__Homo_sapiens__AHZ44440
augcugcucgccgugcuguacugccuucuguggagcuuccagaccuccgcuggccacuuucccagagccugugucucuagcaagaaccucauggagaaagaaugcuguccuccgugguccggggaccggucucccugcggacaacugagcggccgcggguccugucagaauauccuucugucuaacgcgccucucggaccccaguucccuuuuacaggcguugaugacagagagagcuggcccuccguguucuauaaucggacgugccaguguagcgggaacuuuaugggauucaauugcggcaacuguaaguuuggcuucugggggccuaauugcaccgaacgcagacugcuggugcggcgcaacauuuuugaucucucugcuccggagaaagacaaguucuuugccuaccugacacuugccaaacauaccaucuccagcgauuaugucauucccaucggaacauacggccaaaugaagaaugggucuaccccuauguucaacgacauuaauaucuaugaucuguuuguguggaugcacuacuauguuuccauggacgcucuccugggaggcagcgaaaucuggagagauauugacuucgcccaugaggcucccgccuuccuuccuuggcaccggcuguuucuccugcgcugggagcaggaaauccagaagcugacaggggaugagaacuucaccauucccuacugggacuggagagaugcggaaaaaugugacaucugcacggacgaguacaugggaggccagcauccgaccaauccuaaccuccugucucccgccuccuuuuucagcuccuggcaaauugugugcucucggcuugaggaauauaauagccaccagucccuguguaacggcacaccugaggggccccuccgcagaaaccccggaaaucacgauaagagccggaccccucgccugccgucuuccgcugacgucgaauuuugccuuagccugacacaguacgagucuggcagcauggauaaagccgcuaacuucuccuuuagaaauacccucgaaggguucgccucuccccugacgggaaucgcggacgccagccaguccagcaugcauaacgcucugcacauuuauaugaauggcacaaugucucaagugcagggguccgccaacgauccuaucuuucuccugcaucacgcuuucguugacagcaucuuugagcaguggcuucggagacaccgcccccugcaagagguguacccugaagccaaugcccccauucggcauaacagagagucuuauauggucccguucaucccucucuaccgcaauggagacuuuuucauuuccagcaaggaucugggcuaugauuacuccuaccuucaggacucugaucccgacagcuuccaggacuauaucaaauccuaccuggaacaggcuucucggauuuggagcuggcuccugggcgcggccauggugggggcugugcugaccgcccuccuggccggacuugucucccugcucuguagacacaagcgcaagcaacugccugaggaaaaacagccccugcuuauggagaaggaggauuaucauagccucuaccagucucaccuguga

SEQ ID NO: 3737 - protein, 529 aa, Artificial Sequence [sequence omitted]

SEQ ID NO: 3738 - RNA, 1590 nt, Artificial Sequence
  tyrosinase__Homo_sapiens__AGV39051
augcuccuggcuguuuuguacugccugcuguggaguuuccagaccuccgcuggccauuucccuagagccugugucuccucuaagaaccugauggagaaggaaugcuguccaccguggagcggggacaggagucccuguggccagcuuucaggcagagguuccugucagaauauccuucuguccaaugcaccacuugggccucaauuucccuucacagggguggaugaccgggagucguggccuuccgucuuuuauaauaggaccugccagugcucuggcaacuucaugggauucaacuguggaaacugcaaguuuggcuuuuggggaccaaacugcacagagagacgacucuuggugagaagaaacaucuucgauuugagugccccagagaaggacaaauuuuuugccuaccucacuuuagcaaagcauaccaucagcucagacuaugucauccccauagggaccuauggccaaaugaaaaauggaucaacacccauguuuaacgacaucaauauuuaugaccucuuugucuggaugcauuauuaugugucaauggaugcacugcuugggggaucugaaaucuggagagacauugauuuugcccaugaagcaccagcuuuucugccuuggcauagacucuucuuguugcggugggaacaagaaauccagaagcugacaggagaugaaaacuucacuauuccauauugggacuggcgggaugcagaaaagugugacauuugcacagaugaguacaugggaggucagcaccccacaaauccuaacuuacucagcccagcaucauucuucuccucuuggcagauugucuguagccgauuggaggaguacaacagccaucagucuuuaugcaauggaacgcccgagggaccuuuacggcguaauccuggaaaccaugacaaauccagaaccccaaggcuccccucuucagcugauguagaauuuugccugaguuugacccaauaugaaucugguuccauggauaaagcugccaauuucagcuuuagaaauacacuggaaggauuugcuaguccacuuacugggauagcggaugccucucaaagcagcaugcacaaugccuugcacaucuauaugaauggaacaaugucccagguacagggaucugccaacgauccuaucuuccuucuucaccaugcauuuguugacaguauuuuugagcaguggcuccgaaggcaccguccucuucaagaaguuuauccagaagccaaugcacccauuggacauaaccgggaauccuacaugguuccuuuuauaccacuguacagaaauggugauuucuuuauuucauccaaagaucugggcuaugacuauagcuaucuacaagauucagacccagacucuuuucaagacuacauuaaguccuauuuggaacaagcgagucggaucuggucauggcuccuuggggcggcgaugguaggggccguccucacugcccugcuggcagggcuugugagcuugcugugucgucacaagagaaagcagcuuccugaagaaaagcagccacuccucauggagaaagaggauuaccacagcuuguaucagagccauuuauaa

SEQ ID NO: 3739 - RNA, 1590 nt, Artificial Sequence
  derived and/or modified sequence opt1 from tyrosinase__Homo_sapiens__AGV39051
augcugcucgccgugcuguacugccugcucuggagcuuccagaccuccgccggccacuucccccgcgcgugcgucagcuccaagaaccugauggagaaggagugcugcccgcccuggagcggggaccggucccccugcggccagcugagcgggcgcggcuccugccagaacauccuccugagcaacgcgccccuggggccgcaguuccccuucaccggcguggacgaccgggaguccuggcccagcguguucuacaaccgcacgugccagugcuccggcaacuucaugggguucaacugcggcaacugcaaguucggguucuggggccccaacugcaccgagcggcgccuccugguccggcgcaacaucuucgaccugagcgccccggagaaggacaaguucuucgccuaccucacccuggccaagcacaccaucuccagcgacuacgugauccccaucgggacguacggccagaugaagaacggcuccacccccauguucaacgacaucaacaucuacgaccuguucguguggaugcacuacuacgucagcauggacgcccuccucgggggcuccgagaucuggcgggacaucgacuucgcccacgaggcccccgccuuccugccguggcaccgccuguuccugcugcggugggagcaggagauccagaagcucaccggggacgagaacuucaccauccccuacugggacuggcgcgacgcggagaagugcgacaucugcacggacgaguacaugggcggccagcaccccaccaaccccaaccugcugagcccggccuccuucuucagcagcuggcagaucgugugcucccggcucgaggaguacaacagccaccagucccugugcaacgggacccccgagggcccccugcgccggaaccccgggaaccacgacaagagccgcaccccgcggcuccccuccagcgccgacguggaguucugccugucccugacgcaguacgagagcggcuccauggacaaggccgccaacuucagcuuccgcaacacccucgagggguucgcgagcccccugaccggcaucgccgacgccucccaguccagcaugcacaacgcccugcacaucuacaugaacggcaccaugucccagguccaggggagcgccaacgaccccaucuuccuccugcaccacgcguucguggacuccaucuucgagcaguggcugcggcgccaccggccgcuccaggagguguaccccgaggccaacgcccccaucggccacaaccgcgagagcuacaugguccccuucaucccgcuguaccgcaacggggacuucuucaucuccagcaaggaccugggcuacgacuacagcuaccuccaggacuccgaccccgacagcuuccaggacuacaucaaguccuaccuggagcaggccagccggaucugguccuggcugcucggggccgcgauggugggcgccgugcugacggcccugcucgccggccuggucagccugcucugccgccacaagcggaagcagcugcccgaggagaagcagccgcugcugauggagaaggaggacuaccacucccucuaccagagccaccuguga

SEQ ID NO: 3740 - RNA, 1590 nt, Artificial Sequence
  derived and/or modified sequence opt2 from tyrosinase__Homo_sapiens__AGV39051
augcuccucgccguccucuacugccuccucugguccuuccagaccuccgccggccacuucccccgcgccugcgucuccuccaagaaccucauggagaaggagugcugcccccccugguccggcgaccgcucccccugcggccagcucuccggccgcggcuccugccagaacauccuccucuccaacgccccccucggcccccaguuccccuucaccggcgucgacgaccgcgaguccuggcccuccgucuucuacaaccgcaccugccagugcuccggcaacuucaugggcuucaacugcggcaacugcaaguucggcuucuggggccccaacugcaccgagcgccgccuccucguccgccgcaacaucuucgaccucuccgcccccgagaaggacaaguucuucgccuaccucacccucgccaagcacaccaucuccuccgacuacgucauccccaucggcaccuacggccagaugaagaacggcuccacccccauguucaacgacaucaacaucuacgaccucuucgucuggaugcacuacuacgucuccauggacgcccuccucggcggcuccgagaucuggcgcgacaucgacuucgcccacgaggcccccgccuuccuccccuggcaccgccucuuccuccuccgcugggagcaggagauccagaagcucaccggcgacgagaacuucaccauccccuacugggacuggcgcgacgccgagaagugcgacaucugcaccgacgaguacaugggcggccagcaccccaccaaccccaaccuccucucccccgccuccuucuucuccuccuggcagaucgucugcucccgccucgaggaguacaacucccaccagucccucugcaacggcacccccgagggcccccuccgccgcaaccccggcaaccacgacaagucccgcaccccccgccuccccuccuccgccgacgucgaguucugccucucccucacccaguacgaguccggcuccauggacaaggccgccaacuucuccuuccgcaacacccucgagggcuucgccuccccccucaccggcaucgccgacgccucccaguccuccaugcacaacgcccuccacaucuacaugaacggcaccaugucccagguccagggcuccgccaacgaccccaucuuccuccuccaccacgccuucgucgacuccaucuucgagcaguggcuccgccgccaccgcccccuccaggaggucuaccccgaggccaacgcccccaucggccacaaccgcgaguccuacaugguccccuucaucccccucuaccgcaacggcgacuucuucaucuccuccaaggaccucggcuacgacuacuccuaccuccaggacuccgaccccgacuccuuccaggacuacaucaaguccuaccucgagcaggccucccgcaucugguccuggcuccucggcgccgccauggucggcgccguccucaccgcccuccucgccggccucgucucccuccucugccgccacaagcgcaagcagcuccccgaggagaagcagccccuccucauggagaaggaggacuaccacucccucuaccagucccaccucuga

SEQ ID NO: 3741 - RNA, 1590 nt, Artificial Sequence
  derived and/or modified sequence opt3 from tyrosinase__Homo_sapiens__AGV39051
augcugcucgccgugcuuuacugccuguuguggagcuuccagaccuccgcuggccacuuucccagagcaugugucucuucaaagaacuuaauggagaaagaaugcuguccuccauggaguggggacaggagcccgugcggacaacuguccggucggggcucuugucagaauauccuacucucgaacgcccccuuggggccucaguucccauuuacaggaguugaugaccgcgagucauggcccagcguguucuauaaucgaacuugccaguguaguggcaacuuuauggguuucaauugcgggaacuguaaguuuggauucuggggcccuaauugcacggaacguagacuucugguaaggcggaacauuuuugauuuguccgcgccagagaaagacaaguucuuugcuuaccucacccuggccaaacauacaauaucuagcgauuaugugauccccauuggcacuuacgggcaaaugaagaauggauccaccccuauguucaacgacaucaauauuuaugaucuguuugucuggaugcacuacuaugugucaauggacgcacucuuagguggcagugaaaucuggcgcgauauagacuucgcccaugaggcuccagcauuccugccguggcacagacuuuuucugcugaggugggagcaggaaauccagaagcuaacaggggaugagaacuucaccauucccuacugggacuggcgggaugccgaaaaaugugacaucugcacugacgaguacaugggaggccagcauccuacaaauccaaaccuccugagccccgcuuccuuuuucucuucauggcaaauuguuugcagccgccuugaggaauauaauagucaccagucucuguguaacgguaccccugaggggccauugcgaagaaaccccggaaaucacgauaaguccaggacgccgcggcucccuagcucggccgacguggaauuuugccugucuuuaacucaguacgaguccggcucaauggauaaagcggcaaacuucaguuuucguaauacccuggaaggcuucgccagcccccucacagggaucgcugacgccucccagucuagcaugcauaacgcacuucacauauauaugaauggaacuaugucacaaguccaggguagugcuaacgauccaauuuuucuguugcaucacgccuucguggacuccaucuuugagcaguggcuacgcagacacaggccucugcaagagguauaccccgaagcgaaugccccaauuggccauaaccgggagagcuauaugguucccuucaucccucucuaccgaaauggggacuuuuucaucucuucaaaggaucugggauaugauuacaguuaccuucaggacagcgauccagacuccuuccaggacuauauuaaaucuuaccuggaacaggcaucgcgcauauggagcugguugcucggcgcugccauggugggugcuguccugaccgccuuacuggcagggcuagugucccuccuguguagacacaagaggaagcaacuuccggaggaaaaacagcccuugcugauggagaaggaggauuaucauucacucuaccagagucaccuguga

SEQ ID NO: 3742 - RNA, 1590 nt, Artificial Sequence
  derived and/or modified sequence opt4 from tyrosinase__Homo_sapiens__AGV39051
augcugcuggccgugcuguacugccugcuguggagcuuccagaccagcgccggccacuuccccagagccugcgugagcagcaagaaccugauggagaaggagugcugcccccccuggagcggcgacagaagccccugcggccagcugagcggcagaggcagcugccagaacauccugcugagcaacgccccccugggcccccaguuccccuucaccggcguggacgacagagagagcuggcccagcguguucuacaacagaaccugccagugcagcggcaacuucaugggcuucaacugcggcaacugcaaguucggcuucuggggccccaacugcaccgagagaagacugcuggugagaagaaacaucuucgaccugagcgcccccgagaaggacaaguucuucgccuaccugacccuggccaagcacaccaucagcagcgacuacgugauccccaucggcaccuacggccagaugaagaacggcagcacccccauguucaacgacaucaacaucuacgaccuguucguguggaugcacuacuacgugagcauggacgcccugcugggcggcagcgagaucuggagagacaucgacuucgcccacgaggcccccgccuuccugcccuggcacagacuguuccugcugagaugggagcaggagauccagaagcugaccggcgacgagaacuucaccauccccuacugggacuggagagacgccgagaagugcgacaucugcaccgacgaguacaugggcggccagcaccccaccaaccccaaccugcugagccccgccagcuucuucagcagcuggcagaucgugugcagcagacuggaggaguacaacagccaccagagccugugcaacggcacccccgagggcccccugagaagaaaccccggcaaccacgacaagagcagaacccccagacugcccagcagcgccgacguggaguucugccugagccugacccaguacgagagcggcagcauggacaaggccgccaacuucagcuucagaaacacccuggagggcuucgccagcccccugaccggcaucgccgacgccagccagagcagcaugcacaacgcccugcacaucuacaugaacggcaccaugagccaggugcagggcagcgccaacgaccccaucuuccugcugcaccacgccuucguggacagcaucuucgagcaguggcugagaagacacagaccccugcaggagguguaccccgaggccaacgcccccaucggccacaacagagagagcuacauggugcccuucaucccccuguacagaaacggcgacuucuucaucagcagcaaggaccugggcuacgacuacagcuaccugcaggacagcgaccccgacagcuuccaggacuacaucaagagcuaccuggagcaggccagcagaaucuggagcuggcugcugggcgccgccauggugggcgccgugcugaccgcccugcuggccggccuggugagccugcugugcagacacaagagaaagcagcugcccgaggagaagcagccccugcugauggagaaggaggacuaccacagccuguaccagagccaccuguga

SEQ ID NO: 3743 - RNA, 1590 nt, Artificial Sequence
  derived and/or modified sequence opt5 from tyrosinase__Homo_sapiens__AGV39051
augcugcucgccgugcuguacugccuucuguggagcuuccagaccuccgcuggccacuuucccagagccugugucucuagcaagaaccucauggagaaagaaugcuguccuccgugguccggggaccggucucccugcggacaacugagcggccgcggguccugucagaauauccuucugucuaacgcgccucucggaccccaguucccuuuuacaggcguugaugacagagagagcuggcccuccguguucuauaaucggacgugccaguguagcgggaacuuuaugggauucaauugcggcaacuguaaguuuggcuucugggggccuaauugcaccgaacgcagacugcuggugcggcgcaacauuuuugaucucucugcuccggagaaagacaaguucuuugccuaccugacacuugccaaacauaccaucuccagcgauuaugucauucccaucggaacauacggccaaaugaagaaugggucuaccccuauguucaacgacauuaauaucuaugaucuguuuguguggaugcacuacuauguuuccauggacgcucuccugggaggcagcgaaaucuggagagauauugacuucgcccaugaggcucccgccuuccuuccuuggcaccggcuguuucuccugcgcugggagcaggaaauccagaagcugacaggggaugagaacuucaccauucccuacugggacuggagagaugcggaaaaaugugacaucugcacggacgaguacaugggaggccagcauccgaccaauccuaaccuccugucucccgccuccuuuuucagcuccuggcaaauugugugcucucggcuugaggaauauaauagccaccagucccuguguaacggcacaccugaggggccccuccgcagaaaccccggaaaucacgauaagagccggaccccucgccugccgucuuccgcugacgucgaauuuugccuuagccugacacaguacgagucuggcagcauggauaaagccgcuaacuucuccuuuagaaauacccucgaaggguucgccucuccccugacgggaaucgcggacgccagccaguccagcaugcauaacgcucugcacauuuauaugaauggcacaaugucucaagugcagggguccgccaacgauccuaucuuucuccugcaucacgcuuucguugacagcaucuuugagcaguggcuucggagacaccgcccccugcaagagguguacccugaagccaaugcccccauuggacauaaccgggagucuuauauggucccguucaucccucucuacagaaauggcgacuuuuucauuuccagcaaggaucugggcuaugauuacuccuaccuucaggacucugaucccgacagcuuccaggacuauaucaaauccuaccuggaacaggcuucucgcauuuggagcuggcuccugggggcggccauggugggagcugugcugaccgcccuccuggccggccuugucucccugcucugucggcacaagagaaagcaacugccugaggaaaaacagccccugcuuauggagaaggaggauuaucauagccucuaccagucucaccuguga

SEQ ID NO: 3744 - protein, 529 aa, Artificial Sequence [sequence omitted]

SEQ ID NO: 3745 - RNA, 1590 nt, Artificial Sequence
  tyrosinase__Homo_sapiens__AGV39049
augcuccuggcuguuuuguacugccugcuguggaguuuccagaccuccgcuggccauuucccuagagccugugucuccucuaagaaccugauggagaaggaaugcuguccaccguggagcggggacaggagucccuguggccagcuuucaggcagagguuccugucagaauauccuucuguccaaugcaccacuugggccucaauuucccuucacagggguggaugaccgggagucguggccuuccgucuuuuauaauaggaccugccagugcucuggcaacuucaugggauucaacuguggaaacugcaaguuuggcuuuuggggaccaaacugcacagagagacgacucuuggugagaagaaacaucuucgauuugagugccccagagaaggacaaauuuuuugccuaccucacuuuagcaaagcauaccaucagcucagacuaugucauccccauagggaccuauggccaaaugaaaaauggaucaacacccauguuuaacgacaucaauauuuaugaccucuuugucuggaugcauuauuaugugucaauggaugcacugcuugggggaucugaaaucuggagagacauugauuuugcccaugaagcaccagcuuuucugccuuggcauagacucuucuuguugcggugggaacaagaaauccagaagcugacaggagaugaaaacuucacuauuccauauugggacuggcgggaugcagaaaagugugacauuugcacagaugaguacaugggaggucagcaccccacaaauccuaacuuacucagcccagcaucauucuucuccucuuggcagauugucuguagccgauuggaggaguacaacagccaucagucuuuaugcaauggaacgcccgagggaccuuuacggcguaauccuggaaaccaugacaaauccagaaccccaaggcuccccucuucagcugauguagaauuuugccugaguuugacccaauaugaaucugguuccauggauaaagcugccaauuucagcuuuagaaauacacuggaaggauuugcuaguccacuuacugggauagcggaugccucucaaagcagcaugcacaaugccuugcacaucuauaugaauggaacaaugucccagguacagggaucugccaacgauccuaucuuccuucuucaccaugcauuuguugacaguauuuuugagcaguggcuccaaaggcaccguccucuucaagaaguuuauccagaagccaaugcacccauuggacauaaccgggaauccuacaugguuccuuuuauaccacuguacagaaauggugauuucuuuauuucauccaaagaucugggcuaugacuauagcuaucuacaagauucagacccagacucuuuucaagacuacauuaaguccuauuuggaacaagcgagucggaucuggucauggcuccuuggggcggcgaugguaggggccguccucacugcccugcuggcagggcuugugagcuugcugugucgucacaagagaaagcagcuuccugaagaaaagcagccacuccucauggagaaagaggauuaccacagcuuguaucagagccauuuauaa

SEQ ID NO: 3746 - RNA, 1590 nt, Artificial Sequence
  derived and/or modified sequence opt1 from tyrosinase__Homo_sapiens__AGV39049
augcugcucgccgugcuguacugccugcucuggagcuuccagaccuccgccggccacuucccccgcgcgugcgucagcuccaagaaccugauggagaaggagugcugcccgcccuggagcggggaccggucccccugcggccagcugagcgggcgcggcuccugccagaacauccuccugagcaacgcgccccuggggccgcaguuccccuucaccggcguggacgaccgggaguccuggcccagcguguucuacaaccgcacgugccagugcuccggcaacuucaugggguucaacugcggcaacugcaaguucggguucuggggccccaacugcaccgagcggcgccuccugguccggcgcaacaucuucgaccugagcgccccggagaaggacaaguucuucgccuaccucacccuggccaagcacaccaucuccagcgacuacgugauccccaucgggacguacggccagaugaagaacggcuccacccccauguucaacgacaucaacaucuacgaccuguucguguggaugcacuacuacgucagcauggacgcccuccucgggggcuccgagaucuggcgggacaucgacuucgcccacgaggcccccgccuuccugccguggcaccgccuguuccugcugcggugggagcaggagauccagaagcucaccggggacgagaacuucaccauccccuacugggacuggcgcgacgcggagaagugcgacaucugcacggacgaguacaugggcggccagcaccccaccaaccccaaccugcugagcccggccuccuucuucagcagcuggcagaucgugugcucccggcucgaggaguacaacagccaccagucccugugcaacgggacccccgagggcccccugcgccggaaccccgggaaccacgacaagagccgcaccccgcggcuccccuccagcgccgacguggaguucugccugucccugacgcaguacgagagcggcuccauggacaaggccgccaacuucagcuuccgcaacacccucgagggguucgcgagcccccugaccggcaucgccgacgccucccaguccagcaugcacaacgcccugcacaucuacaugaacggcaccaugucccagguccaggggagcgccaacgaccccaucuuccuccugcaccacgcguucguggacuccaucuucgagcaguggcugcagcggcaccgcccgcuccaggagguguaccccgaggccaacgcccccaucggccacaaccgggagagcuacaugguccccuucaucccgcuguaccgcaacggggacuucuucaucuccagcaaggaccugggcuacgacuacagcuaccuccaggacuccgaccccgacagcuuccaggacuacaucaaguccuaccuggagcaggccagccgcaucugguccuggcugcucggggccgcgauggugggcgccgugcugacggcccugcucgccggccuggucagccugcucugccggcacaagcgcaagcagcugcccgaggagaagcagccgcugcugauggagaaggaggacuaccacucccucuaccagagccaccuguga

SEQ ID NO: 3747 - RNA, 1590 nt, Artificial Sequence
  derived and/or modified sequence opt2 from tyrosinase__Homo_sapiens__AGV39049
augcuccucgccguccucuacugccuccucugguccuuccagaccuccgccggccacuucccccgcgccugcgucuccuccaagaaccucauggagaaggagugcugcccccccugguccggcgaccgcucccccugcggccagcucuccggccgcggcuccugccagaacauccuccucuccaacgccccccucggcccccaguuccccuucaccggcgucgacgaccgcgaguccuggcccuccgucuucuacaaccgcaccugccagugcuccggcaacuucaugggcuucaacugcggcaacugcaaguucggcuucuggggccccaacugcaccgagcgccgccuccucguccgccgcaacaucuucgaccucuccgcccccgagaaggacaaguucuucgccuaccucacccucgccaagcacaccaucuccuccgacuacgucauccccaucggcaccuacggccagaugaagaacggcuccacccccauguucaacgacaucaacaucuacgaccucuucgucuggaugcacuacuacgucuccauggacgcccuccucggcggcuccgagaucuggcgcgacaucgacuucgcccacgaggcccccgccuuccuccccuggcaccgccucuuccuccuccgcugggagcaggagauccagaagcucaccggcgacgagaacuucaccauccccuacugggacuggcgcgacgccgagaagugcgacaucugcaccgacgaguacaugggcggccagcaccccaccaaccccaaccuccucucccccgccuccuucuucuccuccuggcagaucgucugcucccgccucgaggaguacaacucccaccagucccucugcaacggcacccccgagggcccccuccgccgcaaccccggcaaccacgacaagucccgcaccccccgccuccccuccuccgccgacgucgaguucugccucucccucacccaguacgaguccggcuccauggacaaggccgccaacuucuccuuccgcaacacccucgagggcuucgccuccccccucaccggcaucgccgacgccucccaguccuccaugcacaacgcccuccacaucuacaugaacggcaccaugucccagguccagggcuccgccaacgaccccaucuuccuccuccaccacgccuucgucgacuccaucuucgagcaguggcuccagcgccaccgcccccuccaggaggucuaccccgaggccaacgcccccaucggccacaaccgcgaguccuacaugguccccuucaucccccucuaccgcaacggcgacuucuucaucuccuccaaggaccucggcuacgacuacuccuaccuccaggacuccgaccccgacuccuuccaggacuacaucaaguccuaccucgagcaggccucccgcaucugguccuggcuccucggcgccgccauggucggcgccguccucaccgcccuccucgccggccucgucucccuccucugccgccacaagcgcaagcagcuccccgaggagaagcagccccuccucauggagaaggaggacuaccacucccucuaccagucccaccucuga

SEQ ID NO: 3748 - RNA, 1590 nt, Artificial Sequence
  derived and/or modified sequence opt3 from tyrosinase__Homo_sapiens__AGV39049
augcugcucgccgugcuuuacugccuguuguggagcuuccagaccuccgcuggccacuuucccagagcaugugucucuucaaagaacuuaauggagaaagaaugcuguccuccauggaguggggacaggagcccgugcggacaacuguccggucggggcucuugucagaauauccuacucucgaacgcccccuuggggccucaguucccauuuacaggaguugaugaccgcgagucauggcccagcguguucuauaaucgaacuugccaguguaguggcaacuuuauggguuucaauugcgggaacuguaaguuuggauucuggggcccuaauugcacggaacguagacuucugguaaggcggaacauuuuugauuuguccgcgccagagaaagacaaguucuuugcuuaccucacccuggccaaacauacaauaucuagcgauuaugugauccccauuggcacuuacgggcaaaugaagaauggauccaccccuauguucaacgacaucaauauuuaugaucuguuugucuggaugcacuacuaugugucaauggacgcacucuuagguggcagugaaaucuggcgcgauauagacuucgcccaugaggcuccagcauuccugccguggcacagacuuuuucugcugaggugggagcaggaaauccagaagcuaacaggggaugagaacuucaccauucccuacugggacuggcgggaugccgaaaaaugugacaucugcacugacgaguacaugggaggccagcauccuacaaauccaaaccuccugagccccgcuuccuuuuucucuucauggcaaauuguuugcagccgccuugaggaauauaauagucaccagucucuguguaacgguaccccugaggggccauugcgaagaaaccccggaaaucacgauaaguccaggacgccgcggcucccuagcucggccgacguggaauuuugccugucuuuaacucaguacgaguccggcucaauggauaaagcggcaaacuucaguuuucguaauacccuggaaggcuucgccagcccccucacagggaucgcugacgccucccagucuagcaugcauaacgcacuucacauauauaugaauggaacuaugucacaaguccaggguagugcuaacgauccaauuuuucuguugcaucacgccuucguggacuccaucuuugagcaguggcuacaacgccacagaccucugcaggagguauaccccgaagcgaaugccccaauuggccauaacagggagagcuauaugguucccuucaucccucucuaccggaauggggacuuuuucaucucuucaaaggaucugggauaugauuacaguuaccuucaggacagcgauccagacuccuuccaggacuauauuaaaucuuaccuggaacaagcaucgcgaauauggagcugguugcucggcgcugccauggugggugcuguccugaccgccuuacuggcagggcuagugucccuccugugucgccacaagagaaagcagcuuccggaggaaaaacagcccuugcugauggagaaggaggauuaucauucacucuaccagagucaccuguga

SEQ ID NO: 3749 - RNA, 1590 nt, Artificial Sequence
  derived and/or modified sequence opt4 from tyrosinase__Homo_sapiens__AGV39049
augcugcuggccgugcuguacugccugcuguggagcuuccagaccagcgccggccacuuccccagagccugcgugagcagcaagaaccugauggagaaggagugcugcccccccuggagcggcgacagaagccccugcggccagcugagcggcagaggcagcugccagaacauccugcugagcaacgccccccugggcccccaguuccccuucaccggcguggacgacagagagagcuggcccagcguguucuacaacagaaccugccagugcagcggcaacuucaugggcuucaacugcggcaacugcaaguucggcuucuggggccccaacugcaccgagagaagacugcuggugagaagaaacaucuucgaccugagcgcccccgagaaggacaaguucuucgccuaccugacccuggccaagcacaccaucagcagcgacuacgugauccccaucggcaccuacggccagaugaagaacggcagcacccccauguucaacgacaucaacaucuacgaccuguucguguggaugcacuacuacgugagcauggacgcccugcugggcggcagcgagaucuggagagacaucgacuucgcccacgaggcccccgccuuccugcccuggcacagacuguuccugcugagaugggagcaggagauccagaagcugaccggcgacgagaacuucaccauccccuacugggacuggagagacgccgagaagugcgacaucugcaccgacgaguacaugggcggccagcaccccaccaaccccaaccugcugagccccgccagcuucuucagcagcuggcagaucgugugcagcagacuggaggaguacaacagccaccagagccugugcaacggcacccccgagggcccccugagaagaaaccccggcaaccacgacaagagcagaacccccagacugcccagcagcgccgacguggaguucugccugagccugacccaguacgagagcggcagcauggacaaggccgccaacuucagcuucagaaacacccuggagggcuucgccagcccccugaccggcaucgccgacgccagccagagcagcaugcacaacgcccugcacaucuacaugaacggcaccaugagccaggugcagggcagcgccaacgaccccaucuuccugcugcaccacgccuucguggacagcaucuucgagcaguggcugcagagacacagaccccugcaggagguguaccccgaggccaacgcccccaucggccacaacagagagagcuacauggugcccuucaucccccuguacagaaacggcgacuucuucaucagcagcaaggaccugggcuacgacuacagcuaccugcaggacagcgaccccgacagcuuccaggacuacaucaagagcuaccuggagcaggccagcagaaucuggagcuggcugcugggcgccgccauggugggcgccgugcugaccgcccugcuggccggccuggugagccugcugugcagacacaagagaaagcagcugcccgaggagaagcagccccugcugauggagaaggaggacuaccacagccuguaccagagccaccuguga

SEQ ID NO: 3750 - RNA, 1590 nt, Artificial Sequence
  derived and/or modified sequence opt5 from tyrosinase__Homo_sapiens__AGV39049
augcugcucgccgugcuguacugccuucuguggagcuuccagaccuccgcuggccacuuucccagagccugugucucuagcaagaaccucauggagaaagaaugcuguccuccgugguccggggaccggucucccugcggacaacugagcggccgcggguccugucagaauauccuucugucuaacgcgccucucggaccccaguucccuuuuacaggcguugaugacagagagagcuggcccuccguguucuauaaucggacgugccaguguagcgggaacuuuaugggauucaauugcggcaacuguaaguuuggcuucugggggccuaauugcaccgaacgcagacugcuggugcggcgcaacauuuuugaucucucugcuccggagaaagacaaguucuuugccuaccugacacuugccaaacauaccaucuccagcgauuaugucauucccaucggaacauacggccaaaugaagaaugggucuaccccuauguucaacgacauuaauaucuaugaucuguuuguguggaugcacuacuauguuuccauggacgcucuccugggaggcagcgaaaucuggagagauauugacuucgcccaugaggcucccgccuuccuuccuuggcaccggcuguuucuccugcgcugggagcaggaaauccagaagcugacaggggaugagaacuucaccauucccuacugggacuggagagaugcggaaaaaugugacaucugcacggacgaguacaugggaggccagcauccgaccaauccuaaccuccugucucccgccuccuuuuucagcuccuggcaaauugugugcucucggcuugaggaauauaauagccaccagucccuguguaacggcacaccugaggggccccuccgcagaaaccccggaaaucacgauaagagccggaccccucgccugccgucuuccgcugacgucgaauuuugccuuagccugacacaguacgagucuggcagcauggauaaagccgcuaacuucuccuuuagaaauacccucgaaggguucgccucuccccugacgggaaucgcggacgccagccaguccagcaugcauaacgcucugcacauuuauaugaauggcacaaugucucaagugcagggguccgccaacgauccuaucuuucuccugcaucacgcuuucguugacagcaucuuugagcaguggcuucaacggcacagaccccugcaggagguguacccugaagccaaugcccccauuggacauaaccgcgagucuuauauggucccguucaucccucucuaccggaauggcgacuuuuucauuuccagcaaggaucugggcuaugauuacuccuaccuucaggacucugaucccgacagcuuccaggacuauaucaaauccuaccuggaacaggcuucuagaauuuggagcuggcuccugggggcggccauggugggagcugugcugaccgcccuccuggccggccuugucucccugcucugucgccacaagcggaagcaacugccugaggaaaaacagccccugcuuauggagaaggaggauuaucauagccucuaccagucucaccuguga

SEQ ID NO: 3751 - protein, 529 aa, Artificial Sequence [sequence omitted]

SEQ ID NO: 3752 - RNA, 1590 nt, Artificial Sequence
  tyrosinase__Homo_sapiens__AGV39050
augcuccuggcuguuuuguacugccugcuguggaguuuccagaccuccgcuggccauuucccuagagccugugucuccucuaagaaccugauggagaaggaaugcuguccaccguggagcggggacaggagucccuguggccagcuuucaggcagagguuccugucagaauauccuucuguccaaugcaccacuugggccucaauuucccuucacagggguggaugaccgggagucguggccuuccgucuuuuauaauaggaccugccagugcucuggcaacuucaugggauucaacuguggaaacugcaaguuuggcuuuuggggaccaaacugcacagagagacgacucuuggugagaagaaacaucuucgauuugagugccccagagaaggacaaauuuuuugccuaccucacuuuagcaaagcauaccaucagcucagacuaugucauccccauagggaccuauggccaaaugaaaaauggaucaacacccauguuuaacgacaucaauauuuaugaccucuuugucuggaugcauuauuaugugucaauggaugcacugcuugggggauaugaaaucuggagagacauugauuuugcccaugaagcaccagcuuuucugccuuggcauagacucuucuuguugcggugggaacaagaaauccagaagcugacaggagaugaaaacuucacuauuccauauugggacuggcgggaugcagaaaagugugacauuugcacagaugaguacaugggaggucagcaccccacaaauccuaacuuacucagcccagcaucauucuucuccucuuggcagauugucuguagccgauuggaggaguacaacagccaucagucuuuaugcaauggaacgcccgagggaccuuuacggcguaauccuggaaaccaugacaaauccagaaccccaaggcuccccucuucagcugauguagaauuuugccugaguuugacccaauaugaaucugguuccauggauaaagcugccaauuucagcuuuagaaauacacuggaaggauuugcuaguccacuuacugggauagcggaugccucucaaagcagcaugcacaaugccuugcacaucuauaugaauggaacaaugucccagguacagggaucugccaacgauccuaucuuccuucuucaccaugcauuuguugacaguauuuuugagcaguggcuccgaaggcaccguccucuucaagaaguuuauccagaagccaaugcacccauuggacauaaccgggaauccuacaugguuccuuuuauaccacuguacagaaauggugauuucuuuauuucauccaaagaucugggcuaugacuauagcuaucuacaagauucagacccagacucuuuucaagacuacauuaaguccuauuuggaacaagcgagucggaucuggucauggcuccuuggggcggcgaugguaggggccguccucacugcccugcuggcagggcuugugagcuugcugugucgucacaagagaaagcagcuuccugaagaaaagcagccacuccucauggagaaagaggauuaccacagcuuguaucagagccauuuauaa

SEQ ID NO: 3753 - RNA, 1590 nt, Artificial Sequence
  derived and/or modified sequence opt1 from tyrosinase__Homo_sapiens__AGV39050
augcugcucgccgugcuguacugccugcucuggagcuuccagaccuccgccggccacuucccccgcgcgugcgucagcuccaagaaccugauggagaaggagugcugcccgcccuggagcggggaccggucccccugcggccagcugagcgggcgcggcuccugccagaacauccuccugagcaacgcgccccuggggccgcaguuccccuucaccggcguggacgaccgggaguccuggcccagcguguucuacaaccgcacgugccagugcuccggcaacuucaugggguucaacugcggcaacugcaaguucggguucuggggccccaacugcaccgagcggcgccuccugguccggcgcaacaucuucgaccugagcgccccggagaaggacaaguucuucgccuaccucacccuggccaagcacaccaucuccagcgacuacgugauccccaucgggacguacggccagaugaagaacggcuccacccccauguucaacgacaucaacaucuacgaccuguucguguggaugcacuacuacgucagcauggacgcccuccucgggggcuacgagaucuggcgggacaucgacuucgcccacgaggcccccgccuuccugccguggcaccgccuguuccugcugcggugggagcaggagauccagaagcucaccggggacgagaacuucaccauccccuacugggacuggcgcgacgcggagaagugcgacaucugcacggacgaguacaugggcggccagcaccccaccaaccccaaccugcuguccccggccagcuucuucuccagcuggcagaucgugugcagccggcucgaggaguacaacucccaccagagccugugcaacgggacccccgagggcccccugcgccggaaccccgggaaccacgacaagucccgcaccccgcggcuccccagcuccgccgacguggaguucugccugagccugacgcaguacgaguccggcagcauggacaaggccgccaacuucuccuuccgcaacacccucgagggguucgcgagcccccugaccggcaucgccgacgccucccagagcuccaugcacaacgcccugcacaucuacaugaacggcaccaugagccagguccagggguccgccaacgaccccaucuuccuccugcaccacgcguucguggacagcaucuucgagcaguggcugcggcgccaccggccgcuccaggagguguaccccgaggccaacgcccccaucggccacaaccgcgaguccuacaugguccccuucaucccgcuguaccgcaacggggacuucuucaucagcuccaaggaccugggcuacgacuacagcuaccuccaggacagcgaccccgacuccuuccaggacuacaucaagagcuaccuggagcaggccucccggaucuggagcuggcugcucggggccgcgauggugggcgccgugcugacggcccugcucgccggccuggucucccugcucugccgccacaagcggaagcagcugcccgaggagaagcagccgcugcugauggagaaggaggacuaccacagccucuaccagucccaccuguga

SEQ ID NO: 3754 - RNA, 1590 nt, Artificial Sequence
  derived and/or modified sequence opt2 from tyrosinase__Homo_sapiens__AGV39050
augcuccucgccguccucuacugccuccucugguccuuccagaccuccgccggccacuucccccgcgccugcgucuccuccaagaaccucauggagaaggagugcugcccccccugguccggcgaccgcucccccugcggccagcucuccggccgcggcuccugccagaacauccuccucuccaacgccccccucggcccccaguuccccuucaccggcgucgacgaccgcgaguccuggcccuccgucuucuacaaccgcaccugccagugcuccggcaacuucaugggcuucaacugcggcaacugcaaguucggcuucuggggccccaacugcaccgagcgccgccuccucguccgccgcaacaucuucgaccucuccgcccccgagaaggacaaguucuucgccuaccucacccucgccaagcacaccaucuccuccgacuacgucauccccaucggcaccuacggccagaugaagaacggcuccacccccauguucaacgacaucaacaucuacgaccucuucgucuggaugcacuacuacgucuccauggacgcccuccucggcggcuacgagaucuggcgcgacaucgacuucgcccacgaggcccccgccuuccuccccuggcaccgccucuuccuccuccgcugggagcaggagauccagaagcucaccggcgacgagaacuucaccauccccuacugggacuggcgcgacgccgagaagugcgacaucugcaccgacgaguacaugggcggccagcaccccaccaaccccaaccuccucucccccgccuccuucuucuccuccuggcagaucgucugcucccgccucgaggaguacaacucccaccagucccucugcaacggcacccccgagggcccccuccgccgcaaccccggcaaccacgacaagucccgcaccccccgccuccccuccuccgccgacgucgaguucugccucucccucacccaguacgaguccggcuccauggacaaggccgccaacuucuccuuccgcaacacccucgagggcuucgccuccccccucaccggcaucgccgacgccucccaguccuccaugcacaacgcccuccacaucuacaugaacggcaccaugucccagguccagggcuccgccaacgaccccaucuuccuccuccaccacgccuucgucgacuccaucuucgagcaguggcuccgccgccaccgcccccuccaggaggucuaccccgaggccaacgcccccaucggccacaaccgcgaguccuacaugguccccuucaucccccucuaccgcaacggcgacuucuucaucuccuccaaggaccucggcuacgacuacuccuaccuccaggacuccgaccccgacuccuuccaggacuacaucaaguccuaccucgagcaggccucccgcaucugguccuggcuccucggcgccgccauggucggcgccguccucaccgcccuccucgccggccucgucucccuccucugccgccacaagcgcaagcagcuccccgaggagaagcagccccuccucauggagaaggaggacuaccacucccucuaccagucccaccucuga

SEQ ID NO: 3755 - RNA, 1590 nt, Artificial Sequence
  derived and/or modified sequence opt3 from tyrosinase__Homo_sapiens__AGV39050
augcugcucgccgugcuuuacugccuguuguggagcuuccagaccuccgcuggccacuuucccagagcaugugucucuucaaagaacuuaauggagaaagaaugcuguccuccauggaguggggacaggagcccgugcggacaacuguccggucggggcucuugucagaauauccuacucucgaacgcccccuuggggccucaguucccauuuacaggaguugaugaccgcgagucauggcccagcguguucuauaaucgaacuugccaguguaguggcaacuuuauggguuucaauugcgggaacuguaaguuuggauucuggggcccuaauugcacggaacguagacuucugguaaggcggaacauuuuugauuuguccgcgccagagaaagacaaguucuuugcuuaccucacccuggccaaacauacaauaucuagcgauuaugugauccccauuggcacuuacgggcaaaugaagaauggauccaccccuauguucaacgacaucaauauuuaugaucuguuugucuggaugcacuacuaugugucaauggacgcacucuuagguggcuacgaaaucuggcgcgauauagacuucgcccaugaggcuccagcauuccugccguggcacagacuuuuucugcugaggugggagcaggaaauccagaagcuaacaggggaugagaacuucaccauucccuacugggacuggcgggaugccgaaaaaugugacaucugcacugacgaguauaugggaggccagcauccuacaaauccaaaccuccugagucccgcuagcuuuuucucuuccuggcaaauuguuugcucacgccuugaggaauacaauagccaccagagucuguguaacgguaccccugaggggccauugcgaagaaaccccggaaaucacgauaagucuaggacgccgcggcucccuuccagcgccgacguggaauuuugccugucguuaacucaguaugagucuggcuccauggauaaagcggcaaacuucucauuucguaauacccuggaaggcuucgccaguccccucacagggaucgcugacgccagccaguccucuaugcauaacgcacuucacauauacaugaauggaacuaugagccaaguccaggguucagcuaacgauccaauuuuucuguugcaucacgccuucguggacaguaucuuugagcaguggcuacgcagacacaggccucugcaagagguauaucccgaagcgaaugccccaauuggccauaaccgggaguccuacaugguucccuucaucccucucuaucgaaauggggacuuuuucaucagcucuaaggaucugggauacgauuacucauaucuucaggacagugauccagacagcuuccaggacuacauuaaauccuaucuggaacaggcaucucgcauauggucgugguugcucggcgcugccauggugggugcuguccugaccgccuuacuggcagggcuagugagccuccuguguagacacaagaggaagcaacuuccggaggaaaaacagcccuugcugauggagaaggaggauuaccauucccucuaucagucacaccuguga

SEQ ID NO: 3756 - RNA, 1590 nt, Artificial Sequence
  derived and/or modified sequence opt4 from tyrosinase__Homo_sapiens__AGV39050
augcugcuggccgugcuguacugccugcuguggagcuuccagaccagcgccggccacuuccccagagccugcgugagcagcaagaaccugauggagaaggagugcugcccccccuggagcggcgacagaagccccugcggccagcugagcggcagaggcagcugccagaacauccugcugagcaacgccccccugggcccccaguuccccuucaccggcguggacgacagagagagcuggcccagcguguucuacaacagaaccugccagugcagcggcaacuucaugggcuucaacugcggcaacugcaaguucggcuucuggggccccaacugcaccgagagaagacugcuggugagaagaaacaucuucgaccugagcgcccccgagaaggacaaguucuucgccuaccugacccuggccaagcacaccaucagcagcgacuacgugauccccaucggcaccuacggccagaugaagaacggcagcacccccauguucaacgacaucaacaucuacgaccuguucguguggaugcacuacuacgugagcauggacgcccugcugggcggcuacgagaucuggagagacaucgacuucgcccacgaggcccccgccuuccugcccuggcacagacuguuccugcugagaugggagcaggagauccagaagcugaccggcgacgagaacuucaccauccccuacugggacuggagagacgccgagaagugcgacaucugcaccgacgaguacaugggcggccagcaccccaccaaccccaaccugcugagccccgccagcuucuucagcagcuggcagaucgugugcagcagacuggaggaguacaacagccaccagagccugugcaacggcacccccgagggcccccugagaagaaaccccggcaaccacgacaagagcagaacccccagacugcccagcagcgccgacguggaguucugccugagccugacccaguacgagagcggcagcauggacaaggccgccaacuucagcuucagaaacacccuggagggcuucgccagcccccugaccggcaucgccgacgccagccagagcagcaugcacaacgcccugcacaucuacaugaacggcaccaugagccaggugcagggcagcgccaacgaccccaucuuccugcugcaccacgccuucguggacagcaucuucgagcaguggcugagaagacacagaccccugcaggagguguaccccgaggccaacgcccccaucggccacaacagagagagcuacauggugcccuucaucccccuguacagaaacggcgacuucuucaucagcagcaaggaccugggcuacgacuacagcuaccugcaggacagcgaccccgacagcuuccaggacuacaucaagagcuaccuggagcaggccagcagaaucuggagcuggcugcugggcgccgccauggugggcgccgugcugaccgcccugcuggccggccuggugagccugcugugcagacacaagagaaagcagcugcccgaggagaagcagccccugcugauggagaaggaggacuaccacagccuguaccagagccaccuguga

SEQ ID NO: 3757 - RNA, 1590 nt, Artificial Sequence
  derived and/or modified sequence opt5 from tyrosinase__Homo_sapiens__AGV39050
augcugcucgccgugcuguacugccuucuguggagcuuccagaccuccgcuggccacuuucccagagccugugucucuagcaagaaccucauggagaaagaaugcuguccuccgugguccggggaccggucucccugcggacaacugagcggccgcggguccugucagaauauccuucugucuaacgcgccucucggaccccaguucccuuuuacaggcguugaugacagagagagcuggcccuccguguucuauaaucggacgugccaguguagcgggaacuuuaugggauucaauugcggcaacuguaaguuuggcuucugggggccuaauugcaccgaacgcagacugcuggugcggcgcaacauuuuugaucucucugcuccggagaaagacaaguucuuugccuaccugacacuugccaaacauaccaucuccagcgauuaugucauucccaucggaacauacggccaaaugaagaaugggucuaccccuauguucaacgacauuaauaucuaugaucuguuuguguggaugcacuacuauguuuccauggacgcucuccugggaggcuacgaaaucuggagagauauugacuucgcccaugaggcucccgccuuccuuccuuggcaccggcuguuucuccugcgcugggagcaggaaauccagaagcugacaggggaugagaacuucaccauucccuacugggacuggagagaugcggaaaaaugugacaucugcacggacgaguauaugggaggccagcauccgaccaauccuaaccuccugagccccgccuccuuuuucuccagcuggcaaauugugugcucccggcuugaggaauacaauucucaccagagccuguguaacggcacaccugaggggccccuccgcagaaaccccggaaaucacgauaagucccggaccccucgccugccgagcucugcugacgucgaauuuugccuuucccugacacaguaugagagcggcucuauggauaaagccgcuaacuucagcuuuagaaauacccucgaaggguucgccucuccccugacgggaaucgcggacgccucucagagcuccaugcauaacgcucugcacauuuacaugaauggcacaaugagccaagugcaggggucugccaacgauccuaucuuucuccugcaucacgcuuucguugacuccaucuuugagcaguggcuucggagacaccgcccccugcaagagguguauccugaagccaaugcccccauuggacauaaccgggagagcuacauggucccguucaucccucucuauagaaauggcgacuuuuucauuucuuccaaggaucugggcuacgauuacagcuaucuucaggacuccgaucccgacucuuuccaggacuacaucaaaagcuaucuggaacaggcuucccgcauuuggucuuggcuccugggggcggccauggugggagcugugcugaccgcccuccuggccggccuugucagccugcucugucggcacaagagaaagcaacugccugaggaaaaacagccccugcuuauggagaaggaggauuaccauucccucuaucagagccaccuguga

SEQ ID NO: 3758 - protein, 237 aa, Artificial Sequence [sequence omitted]

SEQ ID NO: 3759 - RNA, 714 nt, Artificial Sequence
  tyrosinase__Homo_sapiens__CAA04137
augagcccccuuugguggggguuucugcucaguugcuugggcugcaaaauccugccaggagcccagggucaguucccccgagucugcaugacgguggacagccuagugaacaaggagugcugcccacgccugggugcagagucggccaaugucuguggcucucagcaaggccgggggcagugcacagaggugcgagccgacacaaggcccuggaguggucccuacauccuacgaaaccaggaugaccgugagcuguggccaagaaaauucuuccaccggaccugcaagugcacaggaaacuuugccggcuauaauuguggagacugcaaguuuggcuggaccggucccaacugcgagcggaagaaaccaccagugauucggcagaacauccauuccuugaguccucaggaaagagagcaguucuugggcgccuuagaucucgcgaagaagagaguacaccccgacuacgugaucaccacacaacacugggugggccugcuugggcccaauggaacccagccgcaguuugccaacugcaguguuuaugauuuuuuuguguggcuccauuauuauucuguuagagauacauuauuagguggguuuuuuccuuggcugaagguauauuauuacagguuugugauuggguugaggguauggcagugggaaguaauuucaugcaaguuaauuaagagagcaaccacaaggcagccuuag

SEQ ID NO: 3760 - RNA, 714 nt, Artificial Sequence
  derived and/or modified sequence opt1 from tyrosinase__Homo_sapiens__CAA04137
augagcccccugugguggggcuuccuccuguccugccuggggugcaagauccucccgggcgcccaggggcaguucccccgcgugugcaugaccgucgacagccuggugaacaaggagugcugcccccggcugggcgccgaguccgcgaacgugugcgggagccagcagggccgcggccagugcaccgagguccgggccgacacgcgccccugguccgggccguacauccuccggaaccaggacgaccgcgagcuguggccccggaaguucuuccaccggaccugcaagugcaccggcaacuucgccggguacaacugcggcgacugcaaguucggguggaccggccccaacugcgagcgcaagaagcccccggugauccgccagaacauccacagccugagcccccaggagcgggagcaguuccucggcgcccuggaccuggccaagaagcgcgugcaccccgacuacgucaucacgacccagcacuggguggggcuccugggccccaacgggacccagccgcaguucgcgaacugcuccguguacgacuucuucgucuggcugcacuacuacuccgugcgggacacccuccugggcggcuucuuccccuggcugaagguguacuacuaccgcuucgucaucgggcuccggguguggcagugggaggugaucagcugcaagcugaucaagcgcgccacgacccggcagcccuga

SEQ ID NO: 3761 - RNA, 714 nt, Artificial Sequence
  derived and/or modified sequence opt2 from tyrosinase__Homo_sapiens__CAA04137
auguccccccucugguggggcuuccuccucuccugccucggcugcaagauccuccccggcgcccagggccaguucccccgcgucugcaugaccgucgacucccucgucaacaaggagugcugcccccgccucggcgccgaguccgccaacgucugcggcucccagcagggccgcggccagugcaccgagguccgcgccgacacccgccccugguccggccccuacauccuccgcaaccaggacgaccgcgagcucuggccccgcaaguucuuccaccgcaccugcaagugcaccggcaacuucgccggcuacaacugcggcgacugcaaguucggcuggaccggccccaacugcgagcgcaagaagccccccgucauccgccagaacauccacucccucuccccccaggagcgcgagcaguuccucggcgcccucgaccucgccaagaagcgcguccaccccgacuacgucaucaccacccagcacugggucggccuccucggccccaacggcacccagccccaguucgccaacugcuccgucuacgacuucuucgucuggcuccacuacuacuccguccgcgacacccuccucggcggcuucuuccccuggcucaaggucuacuacuaccgcuucgucaucggccuccgcgucuggcagugggaggucaucuccugcaagcucaucaagcgcgccaccacccgccagcccuga

SEQ ID NO: 3762 - RNA, 714 nt, Artificial Sequence
  derived and/or modified sequence opt3 from tyrosinase__Homo_sapiens__CAA04137
augagcccccugugguggggcuuccuccuuuccugccugggguguaagaucuugccuggagcccagggucaauuuccaagagugugcaugaccgucgacucuuuaguuaacaaagaguguugcccgaggcugggcgcugaaucagcaaaugugugugggagucagcagggacggggccagugcacagagguacgcgccgauacucgacccuggagcgguccuuacauucuacguaaccaagacgauagagaacucuggccaaggaaguucuuucaccggacguguaaaugcaccgggaauuucgcgggauauaacuguggcgacugcaaguuuggcuggacagggcccaauugugagcgcaaaaagccuccagugauaagacagaacauccauucccugucuccccaggaaagggagcaguuccuuggagcucuggauuuggccaagaaacggguccacccugacuacgugauuacuacccaacauuggguuggucuccugggcccaaaugggacacagccgcaguuugcaaacugcucgguguaugauuucuuugucuggcugcacuacuauucagugcgcgacacccucuuaggaggcuucuuucccuggcugaagguauacuauuaccgauucguuaucggucuuagaguguggcagugggaggucauuagcugcaaauugaucaagagggccacuacacggcaaccuuga

SEQ ID NO: 3763 - RNA, 714 nt, Artificial Sequence
  derived and/or modified sequence opt4 from tyrosinase__Homo_sapiens__CAA04137
augagcccccugugguggggcuuccugcugagcugccugggcugcaagauccugcccggcgcccagggccaguuccccagagugugcaugaccguggacagccuggugaacaaggagugcugccccagacugggcgccgagagcgccaacgugugcggcagccagcagggcagaggccagugcaccgaggugagagccgacaccagacccuggagcggccccuacauccugagaaaccaggacgacagagagcuguggcccagaaaguucuuccacagaaccugcaagugcaccggcaacuucgccggcuacaacugcggcgacugcaaguucggcuggaccggccccaacugcgagagaaagaagccccccgugaucagacagaacauccacagccugagcccccaggagagagagcaguuccugggcgcccuggaccuggccaagaagagagugcaccccgacuacgugaucaccacccagcacugggugggccugcugggccccaacggcacccagccccaguucgccaacugcagcguguacgacuucuucguguggcugcacuacuacagcgugagagacacccugcugggcggcuucuuccccuggcugaagguguacuacuacagauucgugaucggccugagaguguggcagugggaggugaucagcugcaagcugaucaagagagccaccaccagacagcccuga

SEQ ID NO: 3764 - RNA, 714 nt, Artificial Sequence
  derived and/or modified sequence opt5 from tyrosinase__Homo_sapiens__CAA04137
augagcccccugugguggggcuuccuccuguccugccuuggguguaagauccugccuggagcccagggccaauuuccgagagugugcaugaccgucgacucucucguuaacaaagaguguugcccccggcugggggcugaaagcgccaauguguguggaucccagcagggccgcgggcagugcacagaggugagagcggauacgcggccuuggucuggacccuacauucuucgcaaccaagacgauagagaacuguggccucggaaguucuuucaccgcaccuguaaaugcacaggcaauuucgcuggcuauaacuguggggacugcaaguuuggauggaccggccccaauugugagcggaaaaagccuccggucaucagacagaacauucauagccucucuccccaggaacgcgagcaguuccugggggcccuggaucucgccaagaaaagagugcacccugacuacguuaucacaacccaacauugggugggacugcuuggccccaaugggacacagccucaguuugcuaacugcuccgucuaugauuucuuuguguggcugcacuacuauagcguucgggacacccuccugggaggcuucuuucccuggcuuaagguguacuauuaccgcuucgucauuggccugagaguguggcagugggaggugaucuccugcaaacucaucaagcgggccacgacccgccaaccguga

SEQ ID NO: 3765 - protein, 529 aa, Artificial Sequence [sequence omitted]

SEQ ID NO: 3766 - RNA, 1590 nt, Artificial Sequence; identical to SEQ ID NO: 3738
  tyrosinase__Homo_sapiens__AAA61242

SEQ ID NO: 3767 - RNA, 1590 nt, Artificial Sequence; identical to SEQ ID NO: 3739
  derived and/or modified sequence opt1 from tyrosinase__Homo_sapiens__AAA61242

SEQ ID NO: 3768 - RNA, 1590 nt, Artificial Sequence; identical to SEQ ID NO: 3740
  derived and/or modified sequence opt2 from tyrosinase__Homo_sapiens__AAA61242

SEQ ID NO: 3769 - RNA, 1590 nt, Artificial Sequence; identical to SEQ ID NO: 3741
  derived and/or modified sequence opt3 from tyrosinase__Homo_sapiens__AAA61242

SEQ ID NO: 3770 - RNA, 1590 nt, Artificial Sequence; identical to SEQ ID NO: 3742
  derived and/or modified sequence opt4 from tyrosinase__Homo_sapiens__AAA61242

SEQ ID NO: 3771 - RNA, 1590 nt, Artificial Sequence; identical to SEQ ID NO: 3743
  derived and/or modified sequence opt5 from tyrosinase__Homo_sapiens__AAA61242

SEQ ID NO: 3772 - protein, 529 aa, Artificial Sequence [sequence omitted]

SEQ ID NO: 3773 - RNA, 1590 nt, Artificial Sequence
  tyrosinase__Homo_sapiens__AGV39054
augcuccuggcuguuuuguacugccugcuguggaguuuccagaccuccgcuggccauuucccuagagccugugucuccucuaagaaccugauggagaaggaaugcuguccaccguggagcggggacaggagucccuguggccagcuuucaggcagagguuccugucagaauauccuucuguccaaugcaccacuugggccucaauuucccuucacagggguggaugaccgggagucguggccuuccgucuuuuauaauaggaccugccagugcucuggcaacuucaugggauucaacuguggaaacugcaaguuuggcuuuuggggaccaaacugcacagagagacgacucuuggugagaagaaacaucuucgauuugagugccccagagaaggacaaauuuuuugccuaccucacuuuagcaaagcauaccaucagcucagacuaugucauccccauagggaccuauggccaaaugaaaaauggaucaacacccauguuuaacgacaucaauauuuaugaccucuuugucuggaugcauuauuaugugucaauggaugcacugcuugggggaucugaaaucuggagagacauugauuuugcccaugaagcaccagcuuuucugccuuggcauagacucuucuuguugcggugggaacaagaaauccagaagcugacaggagaugaaaacuucacuauuccauauugggacuggcgggaugcagaaaagugugacauuugcacagaugaguacgugggaggucagcaccccacaaauccuaacuuacucagcccagcaucauucuucuccucuuggcagauugucuguagccgauuggaggaguacaacagccaucagucuuuaugcaauggaacgcccgagggaccuuuacggcguaauccuggaaaccaugacaaauccagaaccccaaggcuccccucuucagcugauguagaauuuugccugaguuugacccaauaugaaucugguuccauggauaaagcugccaauuucagcuuuagaaauacacuggaaggauuugcuaguccacuuacugggauagcggaugccucucaaagcagcaugcacaaugccuugcacaucuauaugaauggaacaaugucccagguacagggaucugccaacgauccuaucuuccuucuucaccaugcauuuguugacaguauuuuugagcaguggcuccgaaggcaccguccucuucaagaaguuuauccagaagccaaugcacccauuggacauaaccgggaauccuacaugguuccuuuuauaccacuguacagaaauggugauuucuuuauuucauccaaagaucugggcuaugacuauagcuaucuacaagauucagacccagacucuuuucaagacuacauuaaguccuauuuggaacaagcgagucggaucuggucauggcuccuuggggcggcgaugguaggggccguccucacugcccugcuggcagggcuugugagcuugcugugucgucacaagagaaagcagcuuccugaagaaaagcagccacuccucauggagaaagaggauuaccacagcuuguaucagagccauuuauaa

SEQ ID NO: 3774 - RNA, 1590 nt, Artificial Sequence
  derived and/or modified sequence opt1 from tyrosinase__Homo_sapiens__AGV39054
augcugcucgccgugcuguacugccugcucuggagcuuccagaccuccgccggccacuucccccgcgcgugcgucagcuccaagaaccugauggagaaggagugcugcccgcccuggagcggggaccggucccccugcggccagcugagcgggcgcggcuccugccagaacauccuccugagcaacgcgccccuggggccgcaguuccccuucaccggcguggacgaccgggaguccuggcccagcguguucuacaaccgcacgugccagugcuccggcaacuucaugggguucaacugcggcaacugcaaguucggguucuggggccccaacugcaccgagcggcgccuccugguccggcgcaacaucuucgaccugagcgccccggagaaggacaaguucuucgccuaccucacccuggccaagcacaccaucuccagcgacuacgugauccccaucgggacguacggccagaugaagaacggcuccacccccauguucaacgacaucaacaucuacgaccuguucguguggaugcacuacuacgucagcauggacgcccuccucgggggcuccgagaucuggcgggacaucgacuucgcccacgaggcccccgccuuccugccguggcaccgccuguuccugcugcggugggagcaggagauccagaagcucaccggggacgagaacuucaccauccccuacugggacuggcgcgacgcggagaagugcgacaucugcacggacgaguacgugggcggccagcaccccaccaaccccaaccugcugagcccggccuccuucuucagcagcuggcagaucgugugcucccggcucgaggaguacaacagccaccagucccugugcaacgggacccccgagggcccccugcgccggaaccccgggaaccacgacaagagccgcaccccgcggcuccccuccagcgccgacgucgaguucugccugucccugacgcaguacgagagcggcuccauggacaaggccgccaacuucagcuuccgcaacacccucgagggguucgcgagcccccugaccggcaucgccgacgccucccaguccagcaugcacaacgcccugcacaucuacaugaacggcaccaugucccaggugcaggggagcgccaacgaccccaucuuccuccugcaccacgcguucguggacuccaucuucgagcaguggcugcggcgccaccggccgcuccaggaggucuaccccgaggccaacgcccccaucggccacaaccgcgagagcuacauggugcccuucaucccgcuguaccgcaacggggacuucuucaucuccagcaaggaccugggcuacgacuacagcuaccuccaggacuccgaccccgacagcuuccaggacuacaucaaguccuaccuggagcaggccagccggaucugguccuggcugcucggggccgcgauggugggcgccguccugacggcccugcucgccggccuggugagccugcucugccgccacaagcggaagcagcugcccgaggagaagcagccgcugcugauggagaaggaggacuaccacucccucuaccagagccaccuguga

SEQ ID NO: 3775 - RNA, 1590 nt, Artificial Sequence
  derived and/or modified sequence opt2 from tyrosinase__Homo_sapiens__AGV39054
augcuccucgccguccucuacugccuccucugguccuuccagaccuccgccggccacuucccccgcgccugcgucuccuccaagaaccucauggagaaggagugcugcccccccugguccggcgaccgcucccccugcggccagcucuccggccgcggcuccugccagaacauccuccucuccaacgccccccucggcccccaguuccccuucaccggcgucgacgaccgcgaguccuggcccuccgucuucuacaaccgcaccugccagugcuccggcaacuucaugggcuucaacugcggcaacugcaaguucggcuucuggggccccaacugcaccgagcgccgccuccucguccgccgcaacaucuucgaccucuccgcccccgagaaggacaaguucuucgccuaccucacccucgccaagcacaccaucuccuccgacuacgucauccccaucggcaccuacggccagaugaagaacggcuccacccccauguucaacgacaucaacaucuacgaccucuucgucuggaugcacuacuacgucuccauggacgcccuccucggcggcuccgagaucuggcgcgacaucgacuucgcccacgaggcccccgccuuccuccccuggcaccgccucuuccuccuccgcugggagcaggagauccagaagcucaccggcgacgagaacuucaccauccccuacugggacuggcgcgacgccgagaagugcgacaucugcaccgacgaguacgucggcggccagcaccccaccaaccccaaccuccucucccccgccuccuucuucuccuccuggcagaucgucugcucccgccucgaggaguacaacucccaccagucccucugcaacggcacccccgagggcccccuccgccgcaaccccggcaaccacgacaagucccgcaccccccgccuccccuccuccgccgacgucgaguucugccucucccucacccaguacgaguccggcuccauggacaaggccgccaacuucuccuuccgcaacacccucgagggcuucgccuccccccucaccggcaucgccgacgccucccaguccuccaugcacaacgcccuccacaucuacaugaacggcaccaugucccagguccagggcuccgccaacgaccccaucuuccuccuccaccacgccuucgucgacuccaucuucgagcaguggcuccgccgccaccgcccccuccaggaggucuaccccgaggccaacgcccccaucggccacaaccgcgaguccuacaugguccccuucaucccccucuaccgcaacggcgacuucuucaucuccuccaaggaccucggcuacgacuacuccuaccuccaggacuccgaccccgacuccuuccaggacuacaucaaguccuaccucgagcaggccucccgcaucugguccuggcuccucggcgccgccauggucggcgccguccucaccgcccuccucgccggccucgucucccuccucugccgccacaagcgcaagcagcuccccgaggagaagcagccccuccucauggagaaggaggacuaccacucccucuaccagucccaccucuga

SEQ ID NO: 3776 - RNA, 1590 nt, Artificial Sequence
  derived and/or modified sequence opt3 from tyrosinase__Homo_sapiens__AGV39054
augcugcucgccgugcuuuacugccuguuguggagcuuccagaccuccgcuggccacuuucccagagcaugugucucuucaaagaacuuaauggagaaagaaugcuguccuccauggaguggggacaggagcccgugcggacaacuguccggucggggcucuugucagaauauccuacucucgaacgcccccuuggggccucaguucccauuuacaggaguugaugaccgcgagucauggcccagcguguucuauaaucgaacuugccaguguaguggcaacuuuauggguuucaauugcgggaacuguaaguuuggauucuggggcccuaauugcacggaacguagacuucugguaaggcggaacauuuuugauuuguccgcgccagagaaagacaaguucuuugcuuaccucacccuggccaaacauacaauaucuagcgauuaugugauccccauuggcacuuacgggcaaaugaagaauggauccaccccuauguucaacgacaucaauauuuaugaucuguuugucuggaugcacuacuaugugucaauggacgcacucuuagguggcagugaaaucuggcgcgauauagacuucgcccaugaggcuccagcauuccugccguggcacagacuuuuucugcugaggugggagcaggaaauccagaagcuaacaggggaugagaacuucaccauucccuacugggacuggcgggaugccgaaaaaugugacaucugcacugacgaguacguuggaggccagcauccuacaaauccaaaccuccugagccccgcuuccuuuuucucuucauggcaaauugugugcagccgccuugaggaauauaauagucaccagucucuguguaacgguaccccugaggggccauugcgaagaaaccccggaaaucacgauaaguccaggacgccgcggcucccuagcucggccgacgucgaauuuugccugucuuuaacucaguacgaguccggcucaauggauaaagcggcaaacuucaguuuucguaauacccuggaaggcuucgccagcccccucacagggaucgcugacgccucccagucuagcaugcauaacgcacuucacauauauaugaauggaacuaugucacaagugcaggguagugcuaacgauccaauuuuucuguugcaucacgccuucguagacuccaucuuugagcaguggcuacgcagacacaggccucugcaagagguuuaccccgaagcgaaugccccaauuggccauaaccgggagagcuauauggugcccuucaucccucucuaccgaaauggggacuuuuucaucucuucaaaggaucugggauaugauuacaguuaccuucaggacagcgauccagacuccuuccaggacuauauuaaaucuuaccuggaacaggcaucgcgcauauggagcugguugcucggcgcugccauggucggugcugugcugaccgccuuacuggcagggcuagugucccuccuguguagacacaagaggaagcaacuuccggaggaaaaacagcccuugcugauggagaaggaggauuaucauucacucuaccagagucaccuguga

SEQ ID NO: 3777 - RNA, 1590 nt, Artificial Sequence
  derived and/or modified sequence opt4 from tyrosinase__Homo_sapiens__AGV39054
augcugcuggccgugcuguacugccugcuguggagcuuccagaccagcgccggccacuuccccagagccugcgugagcagcaagaaccugauggagaaggagugcugcccccccuggagcggcgacagaagccccugcggccagcugagcggcagaggcagcugccagaacauccugcugagcaacgccccccugggcccccaguuccccuucaccggcguggacgacagagagagcuggcccagcguguucuacaacagaaccugccagugcagcggcaacuucaugggcuucaacugcggcaacugcaaguucggcuucuggggccccaacugcaccgagagaagacugcuggugagaagaaacaucuucgaccugagcgcccccgagaaggacaaguucuucgccuaccugacccuggccaagcacaccaucagcagcgacuacgugauccccaucggcaccuacggccagaugaagaacggcagcacccccauguucaacgacaucaacaucuacgaccuguucguguggaugcacuacuacgugagcauggacgcccugcugggcggcagcgagaucuggagagacaucgacuucgcccacgaggcccccgccuuccugcccuggcacagacuguuccugcugagaugggagcaggagauccagaagcugaccggcgacgagaacuucaccauccccuacugggacuggagagacgccgagaagugcgacaucugcaccgacgaguacgugggcggccagcaccccaccaaccccaaccugcugagccccgccagcuucuucagcagcuggcagaucgugugcagcagacuggaggaguacaacagccaccagagccugugcaacggcacccccgagggcccccugagaagaaaccccggcaaccacgacaagagcagaacccccagacugcccagcagcgccgacguggaguucugccugagccugacccaguacgagagcggcagcauggacaaggccgccaacuucagcuucagaaacacccuggagggcuucgccagcccccugaccggcaucgccgacgccagccagagcagcaugcacaacgcccugcacaucuacaugaacggcaccaugagccaggugcagggcagcgccaacgaccccaucuuccugcugcaccacgccuucguggacagcaucuucgagcaguggcugagaagacacagaccccugcaggagguguaccccgaggccaacgcccccaucggccacaacagagagagcuacauggugcccuucaucccccuguacagaaacggcgacuucuucaucagcagcaaggaccugggcuacgacuacagcuaccugcaggacagcgaccccgacagcuuccaggacuacaucaagagcuaccuggagcaggccagcagaaucuggagcuggcugcugggcgccgccauggugggcgccgugcugaccgcccugcuggccggccuggugagccugcugugcagacacaagagaaagcagcugcccgaggagaagcagccccugcugauggagaaggaggacuaccacagccuguaccagagccaccuguga

SEQ ID NO: 3778 - RNA, 1590 nt, Artificial Sequence
  derived and/or modified sequence opt5 from tyrosinase__Homo_sapiens__AGV39054
augcugcucgccgugcuguacugccuucuguggagcuuccagaccuccgcuggccacuuucccagagccugugucucuagcaagaaccucauggagaaagaaugcuguccuccgugguccggggaccggucucccugcggacaacugagcggccgcggguccugucagaauauccuucugucuaacgcgccucucggaccccaguucccuuuuacaggcguugaugacagagagagcuggcccuccguguucuauaaucggacgugccaguguagcgggaacuuuaugggauucaauugcggcaacuguaaguuuggcuucugggggccuaauugcaccgaacgcagacugcuggugcggcgcaacauuuuugaucucucugcuccggagaaagacaaguucuuugccuaccugacacuugccaaacauaccaucuccagcgauuaugucauucccaucggaacauacggccaaaugaagaaugggucuaccccuauguucaacgacauuaauaucuaugaucuguuuguguggaugcacuacuauguuuccauggacgcucuccugggaggcagcgaaaucuggagagauauugacuucgcccaugaggcucccgccuuccuuccuuggcaccggcuguuucuccugcgcugggagcaggaaauccagaagcugacaggggaugagaacuucaccauucccuacugggacuggagagaugcggaaaaaugugacaucugcacggacgaguacgugggaggccagcauccgaccaauccuaaccuccugucucccgccuccuuuuucagcuccuggcaaauugucugcucucggcuugaggaauauaauagccaccagucccuguguaacggcacaccugaggggccccuccgcagaaaccccggaaaucacgauaagagccggaccccucgccugccgucuuccgcugacguggaauuuugccuuagccugacacaguacgagucuggcagcauggauaaagccgcuaacuucuccuuuagaaauacccucgaaggguucgccucuccccugacgggaaucgcggacgccagccaguccagcaugcauaacgcucugcacauuuauaugaauggcacaaugucucaaguucagggguccgccaacgauccuaucuuucuccugcaucacgcuuucguggacagcaucuuugagcaguggcuucggagacaccgcccccugcaagaggucuacccugaagccaaugcccccauuggacauaaccgggagucuuauauggugccguucaucccucucuacagaaauggcgacuuuuucauuuccagcaaggaucugggcuaugauuacuccuaccuucaggacucugaucccgacagcuuccaggacuauaucaaauccuaccuggaacaggcuucucgcauuuggagcuggcuccugggggcggccauggugggagcuguccugaccgcccuccuggccggccuuguuucccugcucugucggcacaagagaaagcaacugccugaggaaaaacagccccugcuuauggagaaggaggauuaucauagccucuaccagucucaccuguga

SEQ ID NO: 3779 - protein, 529 aa, Artificial Sequence [sequence omitted]

SEQ ID NO: 3780 - RNA, 1590 nt, Artificial Sequence
  tyrosinase__Homo_sapiens__AGV39162
augcuccuggcuguuuuguacugccugcuguggaguuuccagaccuccgcuggccauuucccuagagccugugucuccucuaagaaccugauggagaaggaaugcuguccaccguggagcggggacaggagucccuguggccagcuuucaggcagagguuccugucagaauauccuucuguccaaugcaccacuugggccucaauuucccuucacagggguggaugaccgggagucguggccuuccgucuuuuauaauaggaccugccagugcucuggcaacuucaugggauucaacuguggaaacugcaaguuuggcuuuuggggaccaaacugcacagagagacgacucuuggugagaagaaacaucuucgauuugagugccccagagaaggacaaauuuuuugccuaccucacuuuagcaaagcauaccaucagcucagacuaugucauccccauagggaccuauggccaaaugaaaaauggaucaacacccauguuuaacgacaucaauauuuaugaccucuuugucuggaugcauuauuaugugucaauggaugcacugcuugggggaucugaaaucuggagagacauugauuuugcccaugaagcaccagcuuuucugccuuggcauagacucuucuuguugcggugggaacaagaaauccagaagcugacaggagaugaaaacuucacuauuccauauugggacuggcgggaugcagaaaagugugacauuugcacagaugaguacaugggaggucagcaccccacaaauccuaacuuacucagcccagcaucauucuucuccucuuggcagauugucuguagccgauuggaggaguacaacagccaucagucuuuaugcaauggaacgcccgagggaccuuuacggcguaauccuggaaaccaugacaaauccagaaccccaaggcuccccucuucagcugauguagaauuuugccugaguuugacccaauaugaaucugguuccauggauaaagcugccaauuucagcuuuagaaauacacuggaaggauuugcuaguccacuuacugggauagcggaugccucucaaagcagcaugcacaaugccuugcacaucuauaugaauggaacaaugucccagguacagggaucugccaacgauccuaucuuccuucuucaccaugcauuuguugacaguauuuuugagcaguggcuccgaaggcaccgucuucuucaagaaguuuauccagaagccaaugcacccauuggacauaaccgggaauccuacaugguuccuuuuauaccacuguacagaaauggugauuucuuuauuucauccaaagaucugggcuaugacuauagcuaucuacaagauucagacccagacucuuuucaagacuacauuaaguccuauuuggaacaagcgagucggaucuggucauggcuccuuggggcggcgaugguaggggccguccucacugcccugcuggcagggcuugugagcuugcugugucgucacaagagaaagcagcuuccugaagaaaagcagccacuccucauggagaaagaggauuaccacagcuuguaucagagccauuuauaa

SEQ ID NO: 3781 - RNA, 1590 nt, Artificial Sequence
  derived and/or modified sequence opt1 from tyrosinase__Homo_sapiens__AGV39162
augcugcucgccgugcuguacugccugcucuggagcuuccagaccuccgccggccacuucccccgcgcgugcgucagcuccaagaaccugauggagaaggagugcugcccgcccuggagcggggaccggucccccugcggccagcugagcgggcgcggcuccugccagaacauccuccugagcaacgcgccccuggggccgcaguuccccuucaccggcguggacgaccgggaguccuggcccagcguguucuacaaccgcacgugccagugcuccggcaacuucaugggguucaacugcggcaacugcaaguucggguucuggggccccaacugcaccgagcggcgccuccugguccggcgcaacaucuucgaccugagcgccccggagaaggacaaguucuucgccuaccucacccuggccaagcacaccaucuccagcgacuacgugauccccaucgggacguacggccagaugaagaacggcuccacccccauguucaacgacaucaacaucuacgaccuguucguguggaugcacuacuacgucagcauggacgcccuccucgggggcuccgagaucuggcgggacaucgacuucgcccacgaggcccccgccuuccugccguggcaccgccuguuccugcugcggugggagcaggagauccagaagcucaccggggacgagaacuucaccauccccuacugggacuggcgcgacgcggagaagugcgacaucugcacggacgaguacaugggcggccagcaccccaccaaccccaaccugcugagcccggccuccuucuucagcagcuggcagaucgugugcucccggcucgaggaguacaacagccaccagucccugugcaacgggacccccgagggcccccugcgccggaaccccgggaaccacgacaagagccgcaccccgcggcuccccuccagcgccgacguggaguucugccugucccugacgcaguacgagagcggcuccauggacaaggccgccaacuucagcuuccgcaacacccucgagggguucgcgagcccccugaccggcaucgccgacgccucccaguccagcaugcacaacgcccugcacaucuacaugaacggcaccaugucccagguccaggggagcgccaacgaccccaucuuccuccugcaccacgcguucguggacuccaucuucgagcaguggcugcggcgccaccggcuccugcaggagguguacccggaggccaacgcccccaucggccacaaccgcgagagcuacaugguccccuucaucccccuguaccgcaacggggacuucuucaucuccagcaaggaccucggcuacgacuacagcuaccugcaggacuccgacccggacagcuuccaggacuacaucaaguccuaccuggagcaggccagccggaucugguccuggcuccugggggccgcgauggugggcgccgugcugacggcccuccuggccggccuggucagccuccugugccgccacaagcggaagcagcugcccgaggagaagcagccccugcucauggagaaggaggacuaccacucccuguaccagagccaccuguga

SEQ ID NO: 3782 - RNA, 1590 nt, Artificial Sequence
  derived and/or modified sequence opt2 from tyrosinase__Homo_sapiens__AGV39162
augcuccucgccguccucuacugccuccucugguccuuccagaccuccgccggccacuucccccgcgccugcgucuccuccaagaaccucauggagaaggagugcugcccccccugguccggcgaccgcucccccugcggccagcucuccggccgcggcuccugccagaacauccuccucuccaacgccccccucggcccccaguuccccuucaccggcgucgacgaccgcgaguccuggcccuccgucuucuacaaccgcaccugccagugcuccggcaacuucaugggcuucaacugcggcaacugcaaguucggcuucuggggccccaacugcaccgagcgccgccuccucguccgccgcaacaucuucgaccucuccgcccccgagaaggacaaguucuucgccuaccucacccucgccaagcacaccaucuccuccgacuacgucauccccaucggcaccuacggccagaugaagaacggcuccacccccauguucaacgacaucaacaucuacgaccucuucgucuggaugcacuacuacgucuccauggacgcccuccucggcggcuccgagaucuggcgcgacaucgacuucgcccacgaggcccccgccuuccuccccuggcaccgccucuuccuccuccgcugggagcaggagauccagaagcucaccggcgacgagaacuucaccauccccuacugggacuggcgcgacgccgagaagugcgacaucugcaccgacgaguacaugggcggccagcaccccaccaaccccaaccuccucucccccgccuccuucuucuccuccuggcagaucgucugcucccgccucgaggaguacaacucccaccagucccucugcaacggcacccccgagggcccccuccgccgcaaccccggcaaccacgacaagucccgcaccccccgccuccccuccuccgccgacgucgaguucugccucucccucacccaguacgaguccggcuccauggacaaggccgccaacuucuccuuccgcaacacccucgagggcuucgccuccccccucaccggcaucgccgacgccucccaguccuccaugcacaacgcccuccacaucuacaugaacggcaccaugucccagguccagggcuccgccaacgaccccaucuuccuccuccaccacgccuucgucgacuccaucuucgagcaguggcuccgccgccaccgccuccuccaggaggucuaccccgaggccaacgcccccaucggccacaaccgcgaguccuacaugguccccuucaucccccucuaccgcaacggcgacuucuucaucuccuccaaggaccucggcuacgacuacuccuaccuccaggacuccgaccccgacuccuuccaggacuacaucaaguccuaccucgagcaggccucccgcaucugguccuggcuccucggcgccgccauggucggcgccguccucaccgcccuccucgccggccucgucucccuccucugccgccacaagcgcaagcagcuccccgaggagaagcagccccuccucauggagaaggaggacuaccacucccucuaccagucccaccucuga

SEQ ID NO: 3783 - RNA, 1590 nt, Artificial Sequence
  derived and/or modified sequence opt3 from tyrosinase__Homo_sapiens__AGV39162
augcugcucgccgugcuuuacugccuguuguggagcuuccagaccuccgcuggccacuuucccagagcaugugucucuucaaagaacuuaauggagaaagaaugcuguccuccauggaguggggacaggagcccgugcggacaacuguccggucggggcucuugucagaauauccuacucucgaacgcccccuuggggccucaguucccauuuacaggaguugaugaccgcgagucauggcccagcguguucuauaaucgaacuugccaguguaguggcaacuuuauggguuucaauugcgggaacuguaaguuuggauucuggggcccuaauugcacggaacguagacuucugguaaggcggaacauuuuugauuuguccgcgccagagaaagacaaguucuuugcuuaccucacccuggccaaacauacaauaucuagcgauuaugugauccccauuggcacuuacgggcaaaugaagaauggauccaccccuauguucaacgacaucaauauuuaugaucuguuugucuggaugcacuacuaugugucaauggacgcacucuuagguggcagugaaaucuggcgcgauauagacuucgcccaugaggcuccagcauuccugccguggcacagacuuuuucugcugaggugggagcaggaaauccagaagcuaacaggggaugagaacuucaccauucccuacugggacuggcgggaugccgaaaaaugugacaucugcacugacgaguacaugggaggccagcauccuacaaauccaaaccuccugagccccgcuuccuuuuucucuucauggcaaauuguuugcagccgccuugaggaauauaauagucaccagucucuguguaacgguaccccugaggggccauugcgaagaaaccccggaaaucacgauaaguccaggacgccgcggcucccuagcucggccgacguggaauuuugccugucuuuaacucaguacgaguccggcucaauggauaaagcggcaaacuucaguuuucguaauacccuggaaggcuucgccagcccccucacagggaucgcugacgccucccagucuagcaugcauaacgcacuucacauauauaugaauggaacuaugucacaaguccaggguagugcuaacgauccaauuuuucuguugcaucacgccuucguggacuccaucuuugagcaguggcuacgcagacacaggcugcuccaagagguauacccugaagcgaaugcccccauuggccauaaccgggagagcuauaugguuccauucaucccccuguaccgaaauggggacuuuuucaucucuucaaaggaucuuggauaugauuacaguuaccugcaggacagcgauccugacuccuuccaggacuauauuaaaucuuacuuggaacaggcaucgcgcauauggagcuggcuccugggcgcugccauggugggugcugucuuaaccgcccugcuagcagggcucgugucccugcuuuguagacacaagaggaagcaauugccagaggaaaaacagccgcugcucauggagaaggaggauuaucauucacuguaccagagucaccuuuga

SEQ ID NO: 3784 - RNA, 1590 nt, Artificial Sequence
  derived and/or modified sequence opt4 from tyrosinase__Homo_sapiens__AGV39162
augcugcuggccgugcuguacugccugcuguggagcuuccagaccagcgccggccacuuccccagagccugcgugagcagcaagaaccugauggagaaggagugcugcccccccuggagcggcgacagaagccccugcggccagcugagcggcagaggcagcugccagaacauccugcugagcaacgccccccugggcccccaguuccccuucaccggcguggacgacagagagagcuggcccagcguguucuacaacagaaccugccagugcagcggcaacuucaugggcuucaacugcggcaacugcaaguucggcuucuggggccccaacugcaccgagagaagacugcuggugagaagaaacaucuucgaccugagcgcccccgagaaggacaaguucuucgccuaccugacccuggccaagcacaccaucagcagcgacuacgugauccccaucggcaccuacggccagaugaagaacggcagcacccccauguucaacgacaucaacaucuacgaccuguucguguggaugcacuacuacgugagcauggacgcccugcugggcggcagcgagaucuggagagacaucgacuucgcccacgaggcccccgccuuccugcccuggcacagacuguuccugcugagaugggagcaggagauccagaagcugaccggcgacgagaacuucaccauccccuacugggacuggagagacgccgagaagugcgacaucugcaccgacgaguacaugggcggccagcaccccaccaaccccaaccugcugagccccgccagcuucuucagcagcuggcagaucgugugcagcagacuggaggaguacaacagccaccagagccugugcaacggcacccccgagggcccccugagaagaaaccccggcaaccacgacaagagcagaacccccagacugcccagcagcgccgacguggaguucugccugagccugacccaguacgagagcggcagcauggacaaggccgccaacuucagcuucagaaacacccuggagggcuucgccagcccccugaccggcaucgccgacgccagccagagcagcaugcacaacgcccugcacaucuacaugaacggcaccaugagccaggugcagggcagcgccaacgaccccaucuuccugcugcaccacgccuucguggacagcaucuucgagcaguggcugagaagacacagacugcugcaggagguguaccccgaggccaacgcccccaucggccacaacagagagagcuacauggugcccuucaucccccuguacagaaacggcgacuucuucaucagcagcaaggaccugggcuacgacuacagcuaccugcaggacagcgaccccgacagcuuccaggacuacaucaagagcuaccuggagcaggccagcagaaucuggagcuggcugcugggcgccgccauggugggcgccgugcugaccgcccugcuggccggccuggugagccugcugugcagacacaagagaaagcagcugcccgaggagaagcagccccugcugauggagaaggaggacuaccacagccuguaccagagccaccuguga

SEQ ID NO: 3785 - RNA, 1590 nt, Artificial Sequence
  derived and/or modified sequence opt5 from tyrosinase__Homo_sapiens__AGV39162
augcugcucgccgugcuguacugccuucuguggagcuuccagaccuccgcuggccacuuucccagagccugugucucuagcaagaaccucauggagaaagaaugcuguccuccgugguccggggaccggucucccugcggacaacugagcggccgcggguccugucagaauauccuucugucuaacgcgccucucggaccccaguucccuuuuacaggcguugaugacagagagagcuggcccuccguguucuauaaucggacgugccaguguagcgggaacuuuaugggauucaauugcggcaacuguaaguuuggcuucugggggccuaauugcaccgaacgcagacugcuggugcggcgcaacauuuuugaucucucugcuccggagaaagacaaguucuuugccuaccugacacuugccaaacauaccaucuccagcgauuaugucauucccaucggaacauacggccaaaugaagaaugggucuaccccuauguucaacgacauuaauaucuaugaucuguuuguguggaugcacuacuauguuuccauggacgcucuccugggaggcagcgaaaucuggagagauauugacuucgcccaugaggcucccgccuuccuuccuuggcaccggcuguuucuccugcgcugggagcaggaaauccagaagcugacaggggaugagaacuucaccauucccuacugggacuggagagaugcggaaaaaugugacaucugcacggacgaguacaugggaggccagcauccgaccaauccuaaccuccugucucccgccuccuuuuucagcuccuggcaaauugugugcucucggcuugaggaauauaauagccaccagucccuguguaacggcacaccugaggggccccuccgcagaaaccccggaaaucacgauaagagccggaccccucgccugccgucuuccgcugacgucgaauuuugccuuagccugacacaguacgagucuggcagcauggauaaagccgcuaacuucuccuuuagaaauacccucgaaggguucgccucuccccugacgggaaucgcggacgccagccaguccagcaugcauaacgcucugcacauuuauaugaauggcacaaugucucaagugcagggguccgccaacgauccuaucuuucuccugcaucacgcuuucguugacagcaucuuugagcaguggcuucggagacaccgccugcuccaagagguguaccccgaagccaaugccccuauuggacauaaccgggagucuuauaugguccccuucaucccgcuguacagaaauggcgacuuuuucauuuccagcaaggaucuuggcuaugauuacuccuaccugcaggacucugauccugacagcuuccaggacuauaucaaauccuaccucgaacaggcuucucgcauuuggagcuggcugcugggggcggccauggugggagcugugcucaccgcccugcuugccggccuggucucccuccugugucggcacaagagaaagcaacugcccgaggaaaaacagccucuucucauggagaaggaggauuaucauagccuguaccagucucaccuguga

SEQ ID NO: 3786 - protein, 529 aa, Artificial Sequence [sequence omitted]

SEQ ID NO: 3787 - RNA, 1590 nt, Artificial Sequence
  tyrosinase__Homo_sapiens__AGV39086
augcuccuggcuguuuuguacugccugcuguggaguuuccagaccuccgcuggccauuucccuagagccugugucuccucuaagaaccugauggagaaggaaugcuguccaccguggagcggggacaggagucccuguggccagcuuucaggcagagguuccugucagaauauccuucuguccaaugcaccacuugggccucaauuucccuucacagggguggaugaccgggagucguggccuuccgucuuuuauaauaggaccugccagugcucuggcaacuucaugggauucaacuguggaaacugcaaguuuggcuuuuggggaccaaacugcacagagagacgacucuuggugagaagaaacaucuucgauuugagugccccagagaaggacaaauuuuuugccuaccucacuuuagcaaagcauaccaucagcucagacuaugucauccccauagggaccuauggccaaaugaaaaauggaucaacacccauguuuaacgacaucaauauuuaugaccucuuugucuggaugcauuauuaugugucaauggaugcacugcuugggggaucugaaaucuggagagacauugauuuugcccaugaagcaccagcuuuucugccuuggcauagacucuucuuguugcggugggaacaagaaauccagaagcugacaggagaugaaaacuucacuauuccauauugggacuggcgggaugcagaaaagugugacauuugcacagaugaguacaugggaggucagcaccccacaaauccuaacuuacucagcccagcaucauucuucuccucuuggcagauugucuguagccgauuggaggaguacaacagccaucagucuuuaugcaauggaacgcccgagggaccuuuacggcguaauccuggaaaccaugacaaauccagaaccccaaggcuccccucuucagcugauguagaauuuugccugaguuugacccaauaugaaucugguuccauggauaaagcugccaauuucagcuuuagaaauacacuggaaggauuugcuaguccacuuacugggauagcggaugccucucaaagcagcaugcacaaugccuugcacaucuauaugaauggaacaaugucccagguacagggaucugccaacgauccuaucuuccuucuucaccaugcauuuguugacaguauguuugagcaguggcuccgaaggcaccguccucuucaagaaguuuauccagaagccaaugcacccauuggacauaaccgggaauccuacaugguuccuuuuauaccacuguacagaaauggugauuucuuuauuucauccaaagaucugggcuaugacuauagcuaucuacaagauucagacccagacucuuuucaagacuacauuaaguccuauuuggaacaagcgagucggaucuggucauggcuccuuggggcggcgaugguaggggccguccucacugcccugcuggcagggcuugugagcuugcugugucgucacaagagaaagcagcuuccugaagaaaagcagccacuccucauggagaaagaggauuaccacagcuuguaucagagccauuuauaa

SEQ ID NO: 3788 - RNA, 1590 nt, Artificial Sequence
  derived and/or modified sequence opt1 from tyrosinase__Homo_sapiens__AGV39086
augcugcucgccgugcuguacugccugcucuggagcuuccagaccuccgccggccacuucccccgcgcgugcgucagcuccaagaaccugauggagaaggagugcugcccgcccuggagcggggaccggucccccugcggccagcugagcgggcgcggcuccugccagaacauccuccugagcaacgcgccccuggggccgcaguuccccuucaccggcguggacgaccgggaguccuggcccagcguguucuacaaccgcacgugccagugcuccggcaacuucaugggguucaacugcggcaacugcaaguucggguucuggggccccaacugcaccgagcggcgccuccugguccggcgcaacaucuucgaccugagcgccccggagaaggacaaguucuucgccuaccucacccuggccaagcacaccaucuccagcgacuacgugauccccaucgggacguacggccagaugaagaacggcuccacccccauguucaacgacaucaacaucuacgaccuguucguguggaugcacuacuacgucagcauggacgcccuccucgggggcuccgagaucuggcgggacaucgacuucgcccacgaggcccccgccuuccugccguggcaccgccuguuccugcugcggugggagcaggagauccagaagcucaccggggacgagaacuucaccauccccuacugggacuggcgcgacgcggagaagugcgacaucugcacggacgaguacaugggcggccagcaccccaccaaccccaaccugcugagcccggccuccuucuucagcagcuggcagaucgugugcucccggcucgaggaguacaacagccaccagucccugugcaacgggacccccgagggcccccugcgccggaaccccgggaaccacgacaagagccgcaccccgcggcuccccuccagcgccgacguggaguucugccugucccugacgcaguacgagagcggcuccauggacaaggccgccaacuucagcuuccgcaacacccucgagggguucgcgagcccccugaccggcaucgccgacgccucccaguccagcaugcacaacgcccugcacaucuacaugaacggcaccaugucccagguccaggggagcgccaacgaccccaucuuccuccugcaccacgcguucguggacuccauguucgagcaguggcugcggcgccaccggccgcuccaggagguguaccccgaggccaacgcccccaucggccacaaccgcgagagcuacaugguccccuucaucccgcuguaccgcaacggggacuucuucaucuccagcaaggaccugggcuacgacuacagcuaccuccaggacuccgaccccgacagcuuccaggacuacaucaaguccuaccuggagcaggccagccggaucugguccuggcugcucggggccgcgauggugggcgccgugcugacggcccugcucgccggccuggucagccugcucugccgccacaagcggaagcagcugcccgaggagaagcagccgcugcugauggagaaggaggacuaccacucccucuaccagagccaccuguga

SEQ ID NO: 3789 - RNA, 1590 nt, Artificial Sequence
  derived and/or modified sequence opt2 from tyrosinase__Homo_sapiens__AGV39086
augcuccucgccguccucuacugccuccucugguccuuccagaccuccgccggccacuucccccgcgccugcgucuccuccaagaaccucauggagaaggagugcugcccccccugguccggcgaccgcucccccugcggccagcucuccggccgcggcuccugccagaacauccuccucuccaacgccccccucggcccccaguuccccuucaccggcgucgacgaccgcgaguccuggcccuccgucuucuacaaccgcaccugccagugcuccggcaacuucaugggcuucaacugcggcaacugcaaguucggcuucuggggccccaacugcaccgagcgccgccuccucguccgccgcaacaucuucgaccucuccgcccccgagaaggacaaguucuucgccuaccucacccucgccaagcacaccaucuccuccgacuacgucauccccaucggcaccuacggccagaugaagaacggcuccacccccauguucaacgacaucaacaucuacgaccucuucgucuggaugcacuacuacgucuccauggacgcccuccucggcggcuccgagaucuggcgcgacaucgacuucgcccacgaggcccccgccuuccuccccuggcaccgccucuuccuccuccgcugggagcaggagauccagaagcucaccggcgacgagaacuucaccauccccuacugggacuggcgcgacgccgagaagugcgacaucugcaccgacgaguacaugggcggccagcaccccaccaaccccaaccuccucucccccgccuccuucuucuccuccuggcagaucgucugcucccgccucgaggaguacaacucccaccagucccucugcaacggcacccccgagggcccccuccgccgcaaccccggcaaccacgacaagucccgcaccccccgccuccccuccuccgccgacgucgaguucugccucucccucacccaguacgaguccggcuccauggacaaggccgccaacuucuccuuccgcaacacccucgagggcuucgccuccccccucaccggcaucgccgacgccucccaguccuccaugcacaacgcccuccacaucuacaugaacggcaccaugucccagguccagggcuccgccaacgaccccaucuuccuccuccaccacgccuucgucgacuccauguucgagcaguggcuccgccgccaccgcccccuccaggaggucuaccccgaggccaacgcccccaucggccacaaccgcgaguccuacaugguccccuucaucccccucuaccgcaacggcgacuucuucaucuccuccaaggaccucggcuacgacuacuccuaccuccaggacuccgaccccgacuccuuccaggacuacaucaaguccuaccucgagcaggccucccgcaucugguccuggcuccucggcgccgccauggucggcgccguccucaccgcccuccucgccggccucgucucccuccucugccgccacaagcgcaagcagcuccccgaggagaagcagccccuccucauggagaaggaggacuaccacucccucuaccagucccaccucuga

SEQ ID NO: 3790 - RNA, 1590 nt, Artificial Sequence
  derived and/or modified sequence opt3 from tyrosinase__Homo_sapiens__AGV39086
augcugcucgccgugcuuuacugccuguuguggagcuuccagaccuccgcuggccacuuucccagagcaugugucucuucaaagaacuuaauggagaaagaaugcuguccuccauggaguggggacaggagcccgugcggacaacuguccggucggggcucuugucagaauauccuacucucgaacgcccccuuggggccucaguucccauuuacaggaguugaugaccgcgagucauggcccagcguguucuauaaucgaacuugccaguguaguggcaacuuuauggguuucaauugcgggaacuguaaguuuggauucuggggcccuaauugcacggaacguagacuucugguaaggcggaacauuuuugauuuguccgcgccagagaaagacaaguucuuugcuuaccucacccuggccaaacauacaauaucuagcgauuaugugauccccauuggcacuuacgggcaaaugaagaauggauccaccccuauguucaacgacaucaauauuuaugaucuguuugucuggaugcacuacuaugugucaauggacgcacucuuagguggcagugaaaucuggcgcgauauagacuucgcccaugaggcuccagcauuccugccguggcacagacuuuuucugcugaggugggagcaggaaauccagaagcuaacaggggaugagaacuucaccauucccuacugggacuggcgggaugccgaaaaaugugacaucugcacugacgaguacaugggaggccagcauccuacaaauccaaaccuccugagccccgcuuccuuuuucucuucauggcaaauuguuugcagccgccuugaggaauauaauagucaccagucucuguguaacgguaccccugaggggccauugcgaagaaaccccggaaaucacgauaaguccaggacgccgcggcucccuagcucggccgacguggaauuuugccugucuuuaacucaguacgaguccggcucaauggauaaagcggcaaacuucaguuuucguaauacccuggaaggcuucgccagcccccucacagggaucgcugacgccucccagucuagcaugcauaacgcacuucacauauauaugaauggaacuaugucacaaguccaggguagugcuaacgauccaauuuuucuguugcaucacgccuucguggacuccauguuugagcaguggcuacgcagacacaggccucugcaagagguauaccccgaagcgaaugccccaaucggccauaaccgggagagcuauaugguucccuucauuccucucuaccgaaauggggacuuuuucaucucuucaaaggaucugggauaugauuacaguuaccuucaggacagcgauccagacuccuuccaggacuauaucaaaucuuaccuggaacaggcaucgcgcauuuggagcugguugcucggcgcugccauggugggugcuguccugaccgccuuacuggcagggcuagugucccuccuguguagacacaagaggaagcaacuuccggaggaaaaacagcccuugcugauggagaaggaggauuaucauucacucuaccagagucaccuguga

SEQ ID NO: 3791 - RNA, 1590 nt, Artificial Sequence
  derived and/or modified sequence opt4 from tyrosinase__Homo_sapiens__AGV39086
augcugcuggccgugcuguacugccugcuguggagcuuccagaccagcgccggccacuuccccagagccugcgugagcagcaagaaccugauggagaaggagugcugcccccccuggagcggcgacagaagccccugcggccagcugagcggcagaggcagcugccagaacauccugcugagcaacgccccccugggcccccaguuccccuucaccggcguggacgacagagagagcuggcccagcguguucuacaacagaaccugccagugcagcggcaacuucaugggcuucaacugcggcaacugcaaguucggcuucuggggccccaacugcaccgagagaagacugcuggugagaagaaacaucuucgaccugagcgcccccgagaaggacaaguucuucgccuaccugacccuggccaagcacaccaucagcagcgacuacgugauccccaucggcaccuacggccagaugaagaacggcagcacccccauguucaacgacaucaacaucuacgaccuguucguguggaugcacuacuacgugagcauggacgcccugcugggcggcagcgagaucuggagagacaucgacuucgcccacgaggcccccgccuuccugcccuggcacagacuguuccugcugagaugggagcaggagauccagaagcugaccggcgacgagaacuucaccauccccuacugggacuggagagacgccgagaagugcgacaucugcaccgacgaguacaugggcggccagcaccccaccaaccccaaccugcugagccccgccagcuucuucagcagcuggcagaucgugugcagcagacuggaggaguacaacagccaccagagccugugcaacggcacccccgagggcccccugagaagaaaccccggcaaccacgacaagagcagaacccccagacugcccagcagcgccgacguggaguucugccugagccugacccaguacgagagcggcagcauggacaaggccgccaacuucagcuucagaaacacccuggagggcuucgccagcccccugaccggcaucgccgacgccagccagagcagcaugcacaacgcccugcacaucuacaugaacggcaccaugagccaggugcagggcagcgccaacgaccccaucuuccugcugcaccacgccuucguggacagcauguucgagcaguggcugagaagacacagaccccugcaggagguguaccccgaggccaacgcccccaucggccacaacagagagagcuacauggugcccuucaucccccuguacagaaacggcgacuucuucaucagcagcaaggaccugggcuacgacuacagcuaccugcaggacagcgaccccgacagcuuccaggacuacaucaagagcuaccuggagcaggccagcagaaucuggagcuggcugcugggcgccgccauggugggcgccgugcugaccgcccugcuggccggccuggugagccugcugugcagacacaagagaaagcagcugcccgaggagaagcagccccugcugauggagaaggaggacuaccacagccuguaccagagccaccuguga

SEQ ID NO: 3792 - RNA, 1590 nt, Artificial Sequence
  derived and/or modified sequence opt5 from tyrosinase__Homo_sapiens__AGV39086
augcugcucgccgugcuguacugccuucuguggagcuuccagaccuccgcuggccacuuucccagagccugugucucuagcaagaaccucauggagaaagaaugcuguccuccgugguccggggaccggucucccugcggacaacugagcggccgcggguccugucagaauauccuucugucuaacgcgccucucggaccccaguucccuuuuacaggcguugaugacagagagagcuggcccuccguguucuauaaucggacgugccaguguagcgggaacuuuaugggauucaauugcggcaacuguaaguuuggcuucugggggccuaauugcaccgaacgcagacugcuggugcggcgcaacauuuuugaucucucugcuccggagaaagacaaguucuuugccuaccugacacuugccaaacauaccaucuccagcgauuaugucauucccaucggaacauacggccaaaugaagaaugggucuaccccuauguucaacgacauuaauaucuaugaucuguuuguguggaugcacuacuauguuuccauggacgcucuccugggaggcagcgaaaucuggagagauauugacuucgcccaugaggcucccgccuuccuuccuuggcaccggcuguuucuccugcgcugggagcaggaaauccagaagcugacaggggaugagaacuucaccauucccuacugggacuggagagaugcggaaaaaugugacaucugcacggacgaguacaugggaggccagcauccgaccaauccuaaccuccugucucccgccuccuuuuucagcuccuggcaaauugugugcucucggcuugaggaauauaauagccaccagucccuguguaacggcacaccugaggggccccuccgcagaaaccccggaaaucacgauaagagccggaccccucgccugccgucuuccgcugacgucgaauuuugccuuagccugacacaguacgagucuggcagcauggauaaagccgcuaacuucuccuuuagaaauacccucgaaggguucgccucuccccugacgggaaucgcggacgccagccaguccagcaugcauaacgcucugcacauuuauaugaauggcacaaugucucaagugcagggguccgccaacgauccuaucuuucuccugcaucacgcuuucguugacagcauguuugagcaguggcuucggagacaccgcccccugcaagagguguacccugaagccaaugcccccaucggacauaaccgggagucuuauauggucccguucauuccucucuacagaaauggcgacuuuuucaucuccagcaaggaucugggcuaugauuacuccuaccuucaggacucugaucccgacagcuuccaggacuauauuaaauccuaccuggaacaggcuucucgcaucuggagcuggcuccugggggcggccauggugggagcugugcugaccgcccuccuggccggccuugucucccugcucugucggcacaagagaaagcaacugccugaggaaaaacagccccugcuuauggagaaggaggauuaucauagccucuaccagucucaccuguga

SEQ ID NO: 3793 - protein, 537 aa, Artificial Sequence
  TYRP1__Homo_sapiens__P17643
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 3794 - RNA, 1614 nt, Artificial Sequence
  TYRP1__Homo_sapiens__AAC15468
augagugcuccuaaacuccucucucugggcuguaucuucuuccccuugcuacuuuuucagcaggcccgggcucaauucccaagacagugugccacuguugaggcuuugagaagugguauguguugcccagaccuguccccugugucugggccugggacagaccgcuguggcucaucaucagggaggggcagaugugaggcagugacugcagacucccggccccacagcccucaguauccccaugauggcagagaugaucgggaggucuggcccuugcgcuucuucaauaggacaugucacugcaacggcaauuucucaggacacaacugugggacgugccguccuggcuggagaggagcugccugugaccagaggguucucauagucaggagaaaucuucuggacuuaaguaaagaagaaaagaaccacuuuguccgggcccuggauauggcaaagcgcacaacucacccuuuauuugucauugccaccaggagaucagaagaaauacuggggccagauggcaacacgccacaauuugagaacauuuccauuuauaacuacuuuguuuggacacacuauuacucagucaaaaagacuuuccuugggguaggacaggaaagcuuuggugaaguggauuucucucaugagggaccagcuuuucucacauggcacagguaccaccuccugcgucuggagaaagacaugcaggaaauguugcaagagccuucuuucucccuuccuuacuggaauuuugcaacggggaaaaaugucugugauaucugcacggaugacuugaugggauccagaagcaacuuugauuccacucuaauaagcccaaacucugucuuuucucaauggcgaguggucugugacuccuuggaagauuaugauacccugggaacacuuuguaacagcaccgaggaugggccaauuaggagaaauccagcuggaaauguggccagaccaauggugcaacgucuuccugaaccacaggaugucgcucagugcuuggaaguugguuuauuugacacgccuccuuuuuauuccaacucuacaaacaguuuccgaaacacaguggaagguuacagugaccccacgggaaaguaugacccugcuguucgaagucuucacaauuuggcucaucuauuccugaauggaacagggggacaaacccauuugucuccaaaugauccuauuuuuguccuccugcacaccuucacagaugcagucuuugaugaauggcugaggagauacaaugcugauauauccacauuuccauuggaaaaugccccuauuggacauaauagacaauacaacauggugccauucuggcccccagucaccaacacagaaauguuuguuacugcuccagacaaccugggauacacuuaugaaauucaauggccaagucgggaguuuaguguaccugagauaauugccauagcaguaguuggcgcuuuguuacugguugcacucauuuuugggacugcuucuuaucugauucgugccagacgcaguauggaugaagcuaaccagccucuccucacugaucaguaucaaugcuaugcugaagaauaugaaaaacuccagaauccuaaucagucuguggucuaa

SEQ ID NO: 3795 - RNA, 1614 nt, Artificial Sequence
  derived and/or modified sequence opt1 from TYRP1__Homo_sapiens__AAC15468
augagcgcccccaagcugcucucccugggcugcaucuucuucccgcugcuccuguuccagcaggcccgcgcgcaguucccccggcagugcgccaccguggaggcccugcgcagcgggaugugcugccccgaccucucccccgucagcggcccggggaccgaccggugcggcuccagcuccgggcgcggccggugcgaggccgugacggccgacagccgcccccacagcccccaguacccccacgacggccgggacgaccgcgagguguggccgcugcgguucuucaaccggaccugccacugcaacgggaacuucuccggccacaacugcgggaccugccgccccggcuggcgcggggcggccugcgaccagcggguccugaucgugcgccggaaccuccuggaccuguccaaggaggagaagaaccacuucgugcgcgcccucgacauggccaagcggaccacgcacccccuguucgucaucgcgacccgccggagcgaggagauccugggccccgacggcaacaccccgcaguucgagaacaucuccaucuacaacuacuucguguggacccacuacuacagcgugaagaagacguuccucggggucggccaggaguccuucggggagguggacuucagccacgagggccccgccuuccugaccuggcaccgcuaccaccuccugcggcuggagaaggacaugcaggagaugcugcaggagcccuccuucagccuccccuacuggaacuucgccaccggcaagaacgugugcgacaucugcaccgacgaccugauggggucccgcagcaacuucgacagcacgcugaucuccccgaacagcgucuucucccaguggcgcguggugugcgacagccucgaggacuacgacacccugggcacccugugcaacuccaccgaggacgggcccauccggcgcaaccccgccggcaacgucgcccggcccauggugcagcgccucccggagccccaggacguggcgcagugccuggaggucgggcuguucgacacgccgcccuucuacagcaacuccaccaacagcuuccggaacaccguggagggcuacuccgaccccaccggcaaguacgaccccgccgugcgcagccuccacaaccuggcccaccuguuccucaacgggacgggcgggcagacccaccugucccccaacgaccccaucuucguccugcuccacaccuucaccgacgccguguucgacgaguggcugcggcgcuacaacgccgacaucagcacguucccgcuggagaacgcgcccaucggccacaaccggcaguacaacauggugcccuucuggccgcccgucaccaacaccgagauguucgugaccgcccccgacaaccucggguacacguacgagauccaguggcccucccgcgaguucagcgucccggagaucaucgccaucgccguggugggcgcccugcugcucgucgcgcugaucuucggcaccgccuccuaccugauccgggcccgccggagcauggacgaggccaaccagccccuccugaccgaccaguaccagugcuacgccgaggaguacgagaagcugcagaaccccaaccaguccgugguguga

SEQ ID NO: 3796 - RNA, 1614 nt, Artificial Sequence
  derived and/or modified sequence opt2 from TYRP1__Homo_sapiens__AAC15468
auguccgcccccaagcuccucucccucggcugcaucuucuucccccuccuccucuuccagcaggcccgcgcccaguucccccgccagugcgccaccgucgaggcccuccgcuccggcaugugcugccccgaccucucccccgucuccggccccggcaccgaccgcugcggcuccuccuccggccgcggccgcugcgaggccgucaccgccgacucccgcccccacuccccccaguacccccacgacggccgcgacgaccgcgaggucuggccccuccgcuucuucaaccgcaccugccacugcaacggcaacuucuccggccacaacugcggcaccugccgccccggcuggcgcggcgccgccugcgaccagcgcguccucaucguccgccgcaaccuccucgaccucuccaaggaggagaagaaccacuucguccgcgcccucgacauggccaagcgcaccacccacccccucuucgucaucgccacccgccgcuccgaggagauccucggccccgacggcaacaccccccaguucgagaacaucuccaucuacaacuacuucgucuggacccacuacuacuccgucaagaagaccuuccucggcgucggccaggaguccuucggcgaggucgacuucucccacgagggccccgccuuccucaccuggcaccgcuaccaccuccuccgccucgagaaggacaugcaggagaugcuccaggagcccuccuucucccuccccuacuggaacuucgccaccggcaagaacgucugcgacaucugcaccgacgaccucaugggcucccgcuccaacuucgacuccacccucaucucccccaacuccgucuucucccaguggcgcgucgucugcgacucccucgaggacuacgacacccucggcacccucugcaacuccaccgaggacggccccauccgccgcaaccccgccggcaacgucgcccgccccaugguccagcgccuccccgagccccaggacgucgcccagugccucgaggucggccucuucgacaccccccccuucuacuccaacuccaccaacuccuuccgcaacaccgucgagggcuacuccgaccccaccggcaaguacgaccccgccguccgcucccuccacaaccucgcccaccucuuccucaacggcaccggcggccagacccaccucucccccaacgaccccaucuucguccuccuccacaccuucaccgacgccgucuucgacgaguggcuccgccgcuacaacgccgacaucuccaccuucccccucgagaacgcccccaucggccacaaccgccaguacaacaugguccccuucuggccccccgucaccaacaccgagauguucgucaccgcccccgacaaccucggcuacaccuacgagauccaguggcccucccgcgaguucuccguccccgagaucaucgccaucgccgucgucggcgcccuccuccucgucgcccucaucuucggcaccgccuccuaccucauccgcgcccgccgcuccauggacgaggccaaccagccccuccucaccgaccaguaccagugcuacgccgaggaguacgagaagcuccagaaccccaaccaguccgucgucuga

SEQ ID NO: 3797 - RNA, 1614 nt, Artificial Sequence
  derived and/or modified sequence opt3 from TYRP1__Homo_sapiens__AAC15468
augagcgcccccaagcugcucucccuuggcugcaucuucuuuccucuguuguuauuccagcaagcuagagcacaguuuccaaggcagugugccaccguggaggcgcugcggucugggaugugcuguccggaccuaucacccgucaguggaccugguacagaucgcugcggcagcuccucugggcgaggacguugugaagcuguuacugccgacucgagaccacacucaccccaguacccucaugauggcagggacgaucgggagguguggccacuccgcuucuuuaacagaacgugccacuguaaugguaacuucagcgggcauaauugcggaaccuguaggcccggcuggcggggcgcagccugcgaccaacgcguacugauugugcgaagaaaccuucuggauuugaguaaagaagagaagaaucacuuugucagggcucucgacauggcaaaacggacaacucauccucuguucgugauagccacccgucgcuccgaagagauccuggggccagauggaaacacaccgcaguuugagaauauuucuaucuauaacuacuucguuuggacccacuauuacagcgugaagaaaacuuuucucggugucggccaggaauccuucggggagguggacuuuucacacgaaggacccgcuuucuuaacauggcauagauaucaucugcuuagguuggagaaggauaugcaggagaugcugcaagaaccuaguuucagccuaccauacuggaauuuugccaccggcaagaacguaugugacauuugcacggaugaccucauggguucucgguccaauuucgacucaacucugaucagccccaacaguguguuuucucaguggcgaguugucugcgauucccuugaggacuaugauacccuggggacauuguguaauagcacugaagacggaccuauacgcagaaacccagcgggcaauguggcaaggcccauggugcagcggcucccggagccucaggaugucgcccaaugccuggaaguuggcuuauucgacacacccccauuuuacucgaacucuaccaacuccuuccgcaauaccguggagggguacucagauccuacgggaaaauaugaccccgcuguaagaagucugcacaaccucgcccaccuuuuucugaaugguacuggcgggcagacacacuugagcccaaacgaucccaucuucgugcuacugcauaccuuuacugacgcagucuucgaugaguggcucaggcguuacaaugcugacauuuccacauuuccucuggaaaacgccccaaucggacacaaucggcaguauaacauggugccguucuggcccccuguuaccaauacggagauguuugugaccgcgccagacaaccuuggcuacacauaugaaauucaauggcccucucgagaguucagcgucccugaaaucauagccauugcagugguaggugcucuguugcucguugcccugaucuucgggacugcuucauacuuaauuagagccaggcgcaguauggaugaggcaaaucagccacugcuaaccgaccaguaucaguguuacgccgaggaauacgagaagcuccaaaaccccaaucaguccguggucuga

SEQ ID NO: 3798 - RNA, 1614 nt, Artificial Sequence
  derived and/or modified sequence opt4 from TYRP1__Homo_sapiens__AAC15468
augagcgcccccaagcugcugagccugggcugcaucuucuucccccugcugcuguuccagcaggccagagcccaguuccccagacagugcgccaccguggaggcccugagaagcggcaugugcugccccgaccugagccccgugagcggccccggcaccgacagaugcggcagcagcagcggcagaggcagaugcgaggccgugaccgccgacagcagaccccacagcccccaguacccccacgacggcagagacgacagagagguguggccccugagauucuucaacagaaccugccacugcaacggcaacuucagcggccacaacugcggcaccugcagacccggcuggagaggcgccgccugcgaccagagagugcugaucgugagaagaaaccugcuggaccugagcaaggaggagaagaaccacuucgugagagcccuggacauggccaagagaaccacccacccccuguucgugaucgccaccagaagaagcgaggagauccugggccccgacggcaacaccccccaguucgagaacaucagcaucuacaacuacuucguguggacccacuacuacagcgugaagaagaccuuccugggcgugggccaggagagcuucggcgagguggacuucagccacgagggccccgccuuccugaccuggcacagauaccaccugcugagacuggagaaggacaugcaggagaugcugcaggagcccagcuucagccugcccuacuggaacuucgccaccggcaagaacgugugcgacaucugcaccgacgaccugaugggcagcagaagcaacuucgacagcacccugaucagccccaacagcguguucagccaguggagaguggugugcgacagccuggaggacuacgacacccugggcacccugugcaacagcaccgaggacggccccaucagaagaaaccccgccggcaacguggccagacccauggugcagagacugcccgagccccaggacguggcccagugccuggaggugggccuguucgacaccccccccuucuacagcaacagcaccaacagcuucagaaacaccguggagggcuacagcgaccccaccggcaaguacgaccccgccgugagaagccugcacaaccuggcccaccuguuccugaacggcaccggcggccagacccaccugagccccaacgaccccaucuucgugcugcugcacaccuucaccgacgccguguucgacgaguggcugagaagauacaacgccgacaucagcaccuucccccuggagaacgcccccaucggccacaacagacaguacaacauggugcccuucuggccccccgugaccaacaccgagauguucgugaccgcccccgacaaccugggcuacaccuacgagauccaguggcccagcagagaguucagcgugcccgagaucaucgccaucgccguggugggcgcccugcugcugguggcccugaucuucggcaccgccagcuaccugaucagagccagaagaagcauggacgaggccaaccagccccugcugaccgaccaguaccagugcuacgccgaggaguacgagaagcugcagaaccccaaccagagcgugguguga

SEQ ID NO: 3799 - RNA, 1614 nt, Artificial Sequence
  derived and/or modified sequence opt5 from TYRP1__Homo_sapiens__AAC15468
augagcgcccccaagcugcucucccugggcugcaucuucuuuccucuucuccuguuccagcaagcuagagcccaguuuccgcggcagugugcgaccguggaggcucugcgcucugggaugugcugucccgaccuuagcccugucuccggacccggcacagauagaugcgggucuagcuccggacggggccgcugugaagccguuacggccgacucuagaccucacagcccccaguacccucaugaugggcgggacgaucgcgagguguggccgcugagauucuuuaaccggaccugccacuguaauggaaacuucuccggccauaauugcggcacaugucgccccggguggagaggagcugccugcgaccaacgggugcucauuguccgcagaaaccugcuggaucucagcaaagaagagaagaaucacuuugugcgggcucuggacauggccaaacgcaccacacauccucuuuucguuaucgcgaccagacggucugaagagauucugggccccgaugggaacacaccucaguuugagaauaucuccauuuauaacuacuucguguggacccacuauuacagcgucaagaaaacguuucucggagugggccaggaaucuuucggggagguugacuuuucccacgaaggacccgccuuccugaccuggcauagauaucaccuucugcgccucgagaaggauaugcaggagaugcugcaagaaccgagcuucucucugccuuacuggaauuuugcuacaggcaagaacgugugugacaucugcaccgaugaccucaugggcucccggagcaauuucgacuccacacugaucucucccaacagcgucuuuucccaguggagaguggugugcgauagccuugaggacuaugauacccuggggacgcucuguaauucuacagaagacggaccuauucgccggaaccccgccggcaaugucgcuagacccaugguucagcgccugccugagccgcaggauguggcccaaugccuugaaguggggcuguucgacacacccccuuuuuacuccaacagcaccaacucuuuccggaauaccgucgagggauacagcgaucccaccggcaaauaugacccugcggugagaucccuccauaaccuggcccaccuguuucucaaugggacaggaggccagacgcaccugucucccaacgauccgaucuucguucuucugcauaccuuuacagacgcuguguucgaugaguggcuccgccgguacaaugccgacauuagcaccuuuccucuggaaaacgcucccaucggccacaauagacaguauaacauggucccuuucuggcccccugugacaaauaccgagauguuuguuacggcccccgacaaccuuggguacacauaugaaauucaauggccgucccgcgaguucagcgugccugaaaucauugccaucgcugucgugggagcgcugcuccuggucgcccugaucuucggcaccgcuucuuaccucauucgggccagacgguccauggaugaggccaaucagccccugcuuaccgaccaguaucaguguuacgcugaggaauacgagaagcugcaaaaccccaaucagagcgugguuuga

SEQ ID NO: 3800 - protein, 519 aa, Artificial Sequence
  TYRP2__Homo_sapiens__P40126
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 3801 - RNA, 1560 nt, Artificial Sequence
  TYRP2__Homo_sapiens__AAA20870
augagcccccuuugguggggguuucugcucaguugcuugggcugcaaaauccugccaggagcccagggucaguucccccgagucugcaugacgguggacagccuagugaacaaggagugcugcccacgccugggugcagagucggccaaugucuguggcucucagcaaggccgggggcagugcacagaggugcgagccgacacaaggcccuggaguggucccuacauccuacgaaaccaggaugaccgugagcuguggccaagaaaauucuuccaccggaccugcaagugcacaggaaacuuugccggcuauaauuguggagacugcaaguuuggcuggaccggucccaacugcgagcggaagaaaccaccagugauucggcagaacauccauuccuugaguccucaggaaagagagcaguucuugggcgccuuagaucucgcgaagaagagaguacaccccgacuacgugaucaccacacaacacuggcugggccugcuugggcccaauggaacccagccgcaguuugccaacugcaguguuuaugauuuuuuuguguggcuccauuauuauucuguuagagauacauuauuaggaccaggacgccccuacagggccauagauuucucacaucaaggaccugcauuuguuaccuggcaccgguaccauuuguugugucuggaaagagaucuccagcgacucauuggcaaugagucuuuugcuuugcccuacuggaacuuugccacugggaggaacgagugugauguguguacagaccagcuguuuggggcagcgagaccagacgauccgacucugauuagucggaacucaagauucuccagcugggaaacugucugugauagcuuggaugacuacaaccaccuggucaccuugugcaauggaaccuaugaagguuugcugagaagaaaucaaaugggaagaaacagcaugaaauugccaaccuuaaaagacauacgagauugccugucucuccagaaguuugacaauccucccuucuuccagaacucuaccuucaguuucaggaaugcuuuggaaggguuugauaaagcagaugggacucuggauucucaagugaugagccuucauaauuugguucauuccuuccugaacgggacaaacgcuuugccacauucagccgccaaugaucccauuuuugugguucuucauuccuuuacugaugccaucuuugaugaguggaugaaaagauuuaauccuccugcagaugccuggccucaggagcuggccccuauuggucacaaucggauguacaacaugguuccuuucuucccuccagugacuaaugaagaacucuuuuuaaccucagaccaacuuggcuacagcuaugccaucgaucugccaguuucaguugaagaaacuccagguuggcccacaacucucuuaguagucaugggaacacugguggcuuugguuggucuuuuugugcuguuggcuuuucuucaauauagaagacuucgaaaaggauauacaccccuaauggagacacauuuaagcagcaagagauacacagaagaagccuag

SEQ ID NO: 3802 - RNA, 1560 nt, Artificial Sequence
  derived and/or modified sequence opt1 from TYRP2__Homo_sapiens__AAA20870
augagcccccugugguggggcuuccuccuguccugccuggggugcaagauccucccgggcgcccaggggcaguucccccgcgugugcaugaccgucgacagccuggugaacaaggagugcugcccccggcugggcgccgaguccgcgaacgugugcgggagccagcagggccgcggccagugcaccgagguccgggccgacacgcgccccugguccgggccguacauccuccggaaccaggacgaccgcgagcuguggccccggaaguucuuccaccggaccugcaagugcaccggcaacuucgccggguacaacugcggcgacugcaaguucggguggaccggccccaacugcgagcgcaagaagcccccggugauccgccagaacauccacagccugagcccccaggagcgggagcaguuccucggcgcccuggaccuggccaagaagcgcgugcaccccgacuacgucaucacgacccagcacuggcucgggcugcugggccccaacgggacccagccgcaguucgcgaacugcuccguguacgacuucuucguguggcuccacuacuacuccguccgggacacccugcugggccccggccgccccuaccgggccaucgacuucagccaccaggggcccgccuucgugacguggcaccgcuaccaccuccugugccuggagcgggaccuccagcgccugaucggcaacgaguccuucgcccugccguacuggaacuucgcgaccgggcggaacgagugcgacgugugcaccgaccagcuguucggcgccgcccgccccgacgaccccacccucaucagccggaacucccgcuucagcuccugggagacggucugcgacagccuggacgacuacaaccaccucgugacccugugcaacgggaccuacgagggccugcuccgccggaaccagaugggccgcaacuccaugaagcugcccacccugaaggacauccgggacugccucagccugcagaaguucgacaacccgcccuucuuccagaacuccacguucagcuuccgcaacgcccuggagggguucgacaaggccgacggcacccucgacagccaggugaugucccugcacaaccugguccacagcuuccucaacgggaccaacgcgcugccccacuccgccgccaacgaccccaucuucguggugcugcacagcuucaccgacgccaucuucgacgaguggaugaagcgguucaacccgcccgccgacgcguggccccaggagcucgcccccaucggccacaaccgcauguacaacauggucccguucuucccgcccgugacgaacgaggagcuguuccugaccuccgaccagcucggguacagcuacgccaucgaccugcccguguccgucgaggagacccccggcuggcccaccacgcugcucguggugaugggcacccuggucgcccugguggggcuguucguccuccuggccuuccugcaguaccggcgccuccggaagggcuacacgccccugauggagacccaccugagcuccaagcgcuacaccgaggaggcguga

SEQ ID NO: 3803 - RNA, 1560 nt, Artificial Sequence
  derived and/or modified sequence opt2 from TYRP2__Homo_sapiens__AAA20870
auguccccccucugguggggcuuccuccucuccugccucggcugcaagauccuccccggcgcccagggccaguucccccgcgucugcaugaccgucgacucccucgucaacaaggagugcugcccccgccucggcgccgaguccgccaacgucugcggcucccagcagggccgcggccagugcaccgagguccgcgccgacacccgccccugguccggccccuacauccuccgcaaccaggacgaccgcgagcucuggccccgcaaguucuuccaccgcaccugcaagugcaccggcaacuucgccggcuacaacugcggcgacugcaaguucggcuggaccggccccaacugcgagcgcaagaagccccccgucauccgccagaacauccacucccucuccccccaggagcgcgagcaguuccucggcgcccucgaccucgccaagaagcgcguccaccccgacuacgucaucaccacccagcacuggcucggccuccucggccccaacggcacccagccccaguucgccaacugcuccgucuacgacuucuucgucuggcuccacuacuacuccguccgcgacacccuccucggccccggccgccccuaccgcgccaucgacuucucccaccagggccccgccuucgucaccuggcaccgcuaccaccuccucugccucgagcgcgaccuccagcgccucaucggcaacgaguccuucgcccuccccuacuggaacuucgccaccggccgcaacgagugcgacgucugcaccgaccagcucuucggcgccgcccgccccgacgaccccacccucaucucccgcaacucccgcuucuccuccugggagaccgucugcgacucccucgacgacuacaaccaccucgucacccucugcaacggcaccuacgagggccuccuccgccgcaaccagaugggccgcaacuccaugaagcuccccacccucaaggacauccgcgacugccucucccuccagaaguucgacaacccccccuucuuccagaacuccaccuucuccuuccgcaacgcccucgagggcuucgacaaggccgacggcacccucgacucccaggucaugucccuccacaaccucguccacuccuuccucaacggcaccaacgcccucccccacuccgccgccaacgaccccaucuucgucguccuccacuccuucaccgacgccaucuucgacgaguggaugaagcgcuucaacccccccgccgacgccuggccccaggagcucgcccccaucggccacaaccgcauguacaacaugguccccuucuucccccccgucaccaacgaggagcucuuccucaccuccgaccagcucggcuacuccuacgccaucgaccuccccgucuccgucgaggagacccccggcuggcccaccacccuccucgucgucaugggcacccucgucgcccucgucggccucuucguccuccucgccuuccuccaguaccgccgccuccgcaagggcuacaccccccucauggagacccaccucuccuccaagcgcuacaccgaggaggccuga

SEQ ID NO: 3804 - RNA, 1560 nt, Artificial Sequence
  derived and/or modified sequence opt3 from TYRP2__Homo_sapiens__AAA20870
augagcccccugugguggggcuuccuccuuuccugccugggguguaagaucuugccuggagcccagggucaauuuccaagagugugcaugaccgucgacucuuuaguuaacaaagaguguugcccgaggcugggcgcugaaucagcaaaugugugugggagucagcagggacggggccagugcacagagguacgcgccgauacucgacccuggagcgguccuuacauucuacguaaccaagacgauagagaacucuggccaaggaaguucuuucaccggacguguaaaugcaccgggaauuucgcgggauauaacuguggcgacugcaaguuuggcuggacagggcccaauugugagcgcaaaaagccuccagugauaagacagaacauccauucccugucuccccaggaaagggagcaguuccuuggagcucuggauuuggccaagaaacggguccacccugacuacgugauuacuacccaacauuggcucggucugcugggcccaaaugggacacagccgcaguuugcaaacugcucgguuuaugauuucuuuguguggcuccacuacuauucaguccgcgacaccuuacugggacccggccgaccuuacagagccaucgauuucagccaucaggguccagcuuuugugacuuggcacagguaucaccuuuugugccuggagcgggaccuacaacgucucauugggaaugaaaguuucgcacugcccuacuggaacuuugccacaggacgcaaugagugugauguaugcaccgaccagcuuuucggcgcugccagaccugaugacccaacgcugaucuccaggaacucucgguucagcuccugggaaacuguuugugacucauuggaugacuacaaucaucucgugacccugugcaacggcacauaugagggguuacugcgacgcaaucagaugggaagaaacaguaugaagcuccccacucuuaaagauauaagggacugucugagcuugcaaaaguuugauaacccgccuuucuuucaaaauucuaccuucuccuuucggaacgcgcuagaggguuucgacaaagcagauggcacacuggacucacaggucaugagccuccacaaucuggugcauaguuuucuuaacgggaccaaugcccugccccacucugcugccaacgauccaaucuucguggucuugcacuccuuuacggacgcaauuuucgaugaauggaugaagcgcuuuaauccucccgcugacgccuggccacaggagcucgcgcccaucggacauaacagaauguacaauaugguuccuuucuuuccaccggugacuaacgaggaacuguucuuaacaagcgaccagcugggcuauucguacgccauugaucuacccguaucuguggaagagaccccugguuggccaacuacacuccuggucgugauggggacccuuguugcauuggugggccuguucguccuccuggcuuuucuucaguauaggcgucugcggaagggauacacgcccuugauggagacccaccucuccucaaaacgauauacagaagaggccuga

SEQ ID NO: 3805 - RNA, 1560 nt, Artificial Sequence
  derived and/or modified sequence opt4 from TYRP2__Homo_sapiens__AAA20870
augagcccccugugguggggcuuccugcugagcugccugggcugcaagauccugcccggcgcccagggccaguuccccagagugugcaugaccguggacagccuggugaacaaggagugcugccccagacugggcgccgagagcgccaacgugugcggcagccagcagggcagaggccagugcaccgaggugagagccgacaccagacccuggagcggccccuacauccugagaaaccaggacgacagagagcuguggcccagaaaguucuuccacagaaccugcaagugcaccggcaacuucgccggcuacaacugcggcgacugcaaguucggcuggaccggccccaacugcgagagaaagaagccccccgugaucagacagaacauccacagccugagcccccaggagagagagcaguuccugggcgcccuggaccuggccaagaagagagugcaccccgacuacgugaucaccacccagcacuggcugggccugcugggccccaacggcacccagccccaguucgccaacugcagcguguacgacuucuucguguggcugcacuacuacagcgugagagacacccugcugggccccggcagacccuacagagccaucgacuucagccaccagggccccgccuucgugaccuggcacagauaccaccugcugugccuggagagagaccugcagagacugaucggcaacgagagcuucgcccugcccuacuggaacuucgccaccggcagaaacgagugcgacgugugcaccgaccagcuguucggcgccgccagacccgacgaccccacccugaucagcagaaacagcagauucagcagcugggagaccgugugcgacagccuggacgacuacaaccaccuggugacccugugcaacggcaccuacgagggccugcugagaagaaaccagaugggcagaaacagcaugaagcugcccacccugaaggacaucagagacugccugagccugcagaaguucgacaacccccccuucuuccagaacagcaccuucagcuucagaaacgcccuggagggcuucgacaaggccgacggcacccuggacagccaggugaugagccugcacaaccuggugcacagcuuccugaacggcaccaacgcccugccccacagcgccgccaacgaccccaucuucguggugcugcacagcuucaccgacgccaucuucgacgaguggaugaagagauucaacccccccgccgacgccuggccccaggagcuggcccccaucggccacaacagaauguacaacauggugcccuucuucccccccgugaccaacgaggagcuguuccugaccagcgaccagcugggcuacagcuacgccaucgaccugcccgugagcguggaggagacccccggcuggcccaccacccugcugguggugaugggcacccugguggcccuggugggccuguucgugcugcuggccuuccugcaguacagaagacugagaaagggcuacaccccccugauggagacccaccugagcagcaagagauacaccgaggaggccuga

SEQ ID NO: 3806 - RNA, 1560 nt, Artificial Sequence
  derived and/or modified sequence opt5 from TYRP2__Homo_sapiens__AAA20870
augagcccccugugguggggcuuccuccuguccugccuuggguguaagauccugccuggagcccagggccaauuuccgagagugugcaugaccgucgacucucucguuaacaaagaguguugcccccggcugggggcugaaagcgccaauguguguggaucccagcagggccgcgggcagugcacagaggugagagcggauacgcggccuuggucuggacccuacauucuucgcaaccaagacgauagagaacuguggccucggaaguucuuucaccgcaccuguaaaugcacaggcaauuucgcuggcuauaacuguggggacugcaaguuuggauggaccggccccaauugugagcggaaaaagccuccggucaucagacagaacauucauagccucagcccccaggaacgcgagcaguuccugggggcccuggaucucgccaagaaaagagugcacccugacuacguuaucacaacccaacauuggcugggacuucugggccccaaugggacacagccucaguuugcuaacugcucuguguaugauuucuuugucuggcuccacuacuauagcgugcgggacacccugcuuggacccggccgcccguacagagccauugauuucucccaucagggcccugcuuuuguuacguggcaccgguaucaucugcucugccuggagcgcgaccugcaaagacucaucgggaaugaauccuucgcccugcccuacuggaacuuugcgaccggacggaaugagugugaugugugcacagaccagcuuuucggcgccgcuagaccugaugaccccacccugaucucucgcaacucccgguucagcucuugggaaacagucugugacucccucgaugacuacaaucaccuggugacccuuugcaacgggacguaugagggacugcucagacgcaaucagaugggccggaacagcaugaagcugcccacacugaaagauauuagagacugucucucucugcaaaaguuugauaacccuccguucuuucaaaauuccaccuucagcuuucgcaacgcccuugagggguucgacaaagcugauggaacacuggacucccaggugaugucucuccacaaucugguccauagcuuucuuaacggcaccaaugcccugccccacuccgcggccaacgauccuaucuucguugugcuccacagcuuuaccgacgcuauuuucgaugaauggaugaagcgguuuaaucccccugccgacgcuuggccccaggagcuggccccgaucggccauaacagaauguacaauauggugccuuucuuucccccugucacaaacgaggaacuguuccucacgucugaccagcugggguauuccuacgccauugaucuucccgugagcguugaagagaccccuggauggcccacaacccugcucguggucaugggcacacugguggcucugguugggcuuuucgugcuccuggcguuucugcaguaucgccggcucagaaagggauacaccccgcugauggagacgcaccuuucuagcaaacgcuauacagaagaggccuga

SEQ ID NO: 3807 - protein, 151 aa, Artificial Sequence
  UPA__Homo_sapiens__Q96NZ9
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGHVLSPEPDHDSLYHPPPEEDQGEERPRLWVMPNHQVLLGPEEDQDHIYHPQ

SEQ ID NO: 3808 - RNA, 456 nt, Artificial Sequence
  UPA__Homo_sapiens__CCDS7679.1
augaggaggcuccuccuggucaccagccuggugguugugcugcugugggaggcaggugcagucccagcacccaaggucccuaucaagaugcaagucaaacacuggcccucagagcaggacccagagaaggccuggggcgcccgugugguggagccuccggagaaggacgaccagcugguggugcuguucccuguccagaagccgaaacucuugaccaccgaggagaagccacgaggucagggcaggggccccauccuuccaggcaccaaggccuggauggagaccgaggacacccugggccauguccugagucccgagcccgaccaugacagccuguaccacccuccgccugaggaggaccagggcgaggagaggccccgguugugggugaugccaaaucaccaggugcuccugggaccggaggaagaccaagaccacaucuaccacccccaguag

SEQ ID NO: 3809 - RNA, 456 nt, Artificial Sequence
  derived and/or modified sequence opt1 from UPA__Homo_sapiens__CCDS7679.1
augcgccggcugcuccuggugaccagccuggucguggugcuccugugggaggccggcgccguccccgcgcccaaggugcccaucaagaugcaggucaagcacuggcccuccgagcaggaccccgagaaggccuggggcgcccgcgugguggagccgcccgagaaggacgaccagcuggugguccucuuccccgugcagaagcccaagcugcugaccacggaggagaagccgcgggggcaggggcgcggccccauccuccccgggaccaaggccuggauggagaccgaggacacccugggccacgugcugagccccgagccggaccacgacucccucuaccacccgccgcccgaggaggaccagggcgaggagcggccccgccugugggucaugcccaaccaccaggugcugcucgggcccgaggaggaccaggaccacaucuaccacccccaguga

SEQ ID NO: 3810 - RNA, 456 nt, Artificial Sequence
  derived and/or modified sequence opt2 from UPA__Homo_sapiens__CCDS7679.1
augcgccgccuccuccucgucaccucccucgucgucguccuccucugggaggccggcgccguccccgcccccaagguccccaucaagaugcaggucaagcacuggcccuccgagcaggaccccgagaaggccuggggcgcccgcgucgucgagccccccgagaaggacgaccagcucgucguccucuuccccguccagaagcccaagcuccucaccaccgaggagaagccccgcggccagggccgcggccccauccuccccggcaccaaggccuggauggagaccgaggacacccucggccacguccucucccccgagcccgaccacgacucccucuaccaccccccccccgaggaggaccagggcgaggagcgcccccgccucugggucaugcccaaccaccagguccuccucggccccgaggaggaccaggaccacaucuaccacccccaguga

SEQ ID NO: 3811 - RNA, 456 nt, Artificial Sequence
  derived and/or modified sequence opt3 from UPA__Homo_sapiens__CCDS7679.1
augagaaggcugcuccuugugaccagccuggucguuguguuguuaugggaggccggcgcuguacccgcaccuaaagugccaaucaaaaugcaggucaagcacuggccguccgaacaagaccccgagaaagccuggggagcgcgggugguugaaccuccagagaaggaugaccagcuggugguccuauuccccgugcagaaaccuaagcuccugacaacugaagagaagccacgcgggcagggucgaggccccauucuuccugggacgaaggcuuggauggagaccgaagauacacugggacauguauugucuccagagccggaccacgauucacucuaccaucccccuccagaagaggaccaaggcgaggaacgucccagacuguggguuaugccuaaccaccaggugcugcucgguccagaggaagaucaggaccauauauaucacccccaguga

SEQ ID NO: 3812 - RNA, 456 nt, Artificial Sequence
  derived and/or modified sequence opt4 from UPA__Homo_sapiens__CCDS7679.1
augagaagacugcugcuggugaccagccuggugguggugcugcugugggaggccggcgccgugcccgcccccaaggugcccaucaagaugcaggugaagcacuggcccagcgagcaggaccccgagaaggccuggggcgccagagugguggagccccccgagaaggacgaccagcugguggugcuguuccccgugcagaagcccaagcugcugaccaccgaggagaagcccagaggccagggcagaggccccauccugcccggcaccaaggccuggauggagaccgaggacacccugggccacgugcugagccccgagcccgaccacgacagccuguaccaccccccccccgaggaggaccagggcgaggagagacccagacugugggugaugcccaaccaccaggugcugcugggccccgaggaggaccaggaccacaucuaccacccccaguga

SEQ ID NO: 3813 - RNA, 456 nt, Artificial Sequence
  derived and/or modified sequence opt5 from UPA__Homo_sapiens__CCDS7679.1
augagacggcugcuccuggugaccagccuugucguugugcugcucugggaggccggcgcugugcccgccccuaaggucccgaucaaaaugcaagugaagcacuggcccuccgaacaggacccugagaaagcguggggagcucgcguuguggaacccccugagaaggaugaccagcuggucgugcuuuuccccguucagaaaccuaagcugcucacaacggaagagaagccgagagggcagggccgggggcccauucugccuggaaccaaagccuggauggagacagaagauacccugggccaugugcucucucccgagccugaccacgauagccuguaccaucccccgccugaagaggaccaaggggaggaacgccccagacuuugggucaugccuaaccaccaggugcugcucggacccgaggaagaucaggaccauaucuaucacccccaguga

SEQ ID NO: 3814 - protein, 174 aa, Artificial Sequence [sequence omitted]

SEQ ID NO: 3815 - RNA, 525 nt, Artificial Sequence
  VEGFR1__Homo_sapiens__ACF47598
auggucagcuacugggacaccgggguccugcugugcgcgcugcucagcugucugcuucucacaggaucuaguucagguucaaaauuaaaagauccugaacugaguuuaaaaggcacccagcacaucaugcaagcaggccagacacugcaucuccaaugcaggggggaagcagcccauaaauggucuuugccugaaauggugaguaaggaaagcgaaaggcugagcauaacuaaaucugccuguggaagaaauggcaaacaauucugcaguacuuuaaccuugaacacagcucaagcaaaccacacuggcuucuacagcugcaaauaucuagcuguaccuacuucaaagaagaaggaaacagaaucugcaaucuauauauuuauuagugauacagguagaccuuucguagagauguacagugaaauccccgaaauuauacacaugacugaaggaagggagcucgucauucccugccggguuacgucaccuaacaucacuguuacuuuaaaaaagaaaaaggcauaa

SEQ ID NO: 3816 - RNA, 525 nt, Artificial Sequence
  derived and/or modified sequence opt1 from VEGFR1__Homo_sapiens__ACF47598
auggugagcuacugggacaccggcguccugcucugcgcccugcuguccugccuccugcugaccgggagcuccagcggcuccaagcucaaggaccccgagcugagccugaaggggacgcagcacaucaugcaggccggccagacccuccaccuccagugccgcggggaggcggcccacaaguggucccugccggagauggugagcaaggaguccgagcggcugagcaucaccaaguccgccugcggccgcaacggcaagcaguucugcagcacccugacgcugaacaccgcccaggccaaccacaccggguucuacuccugcaaguaccucgcggugcccaccagcaagaagaaggagacggaguccgccaucuacaucuucaucagcgacaccggccggcccuucgucgagauguacuccgagauccccgagaucauccacaugaccgaggggcgcgagcuggugaucccgugccgggugaccagccccaacaucacggucacccugaagaagaagaaggccuga

SEQ ID NO: 3817 - RNA, 525 nt, Artificial Sequence
  derived and/or modified sequence opt2 from VEGFR1__Homo_sapiens__ACF47598
auggucuccuacugggacaccggcguccuccucugcgcccuccucuccugccuccuccucaccggcuccuccuccggcuccaagcucaaggaccccgagcucucccucaagggcacccagcacaucaugcaggccggccagacccuccaccuccagugccgcggcgaggccgcccacaaguggucccuccccgagauggucuccaaggaguccgagcgccucuccaucaccaaguccgccugcggccgcaacggcaagcaguucugcuccacccucacccucaacaccgcccaggccaaccacaccggcuucuacuccugcaaguaccucgccguccccaccuccaagaagaaggagaccgaguccgccaucuacaucuucaucuccgacaccggccgccccuucgucgagauguacuccgagauccccgagaucauccacaugaccgagggccgcgagcucgucauccccugccgcgucaccucccccaacaucaccgucacccucaagaagaagaaggccuga

SEQ ID NO: 3818 - RNA, 525 nt, Artificial Sequence
  derived and/or modified sequence opt3 from VEGFR1__Homo_sapiens__ACF47598
auggugagcuacugggacaccggcguccugcucugcgcccuucuguccuguuuguuacugacagggucuucaaguggaagcaagcuaaaagaucccgagcucucccugaaggguacucagcacaucaugcaagcuggccagacgcuucaucugcagugcagaggggaagcagcccacaaauggucuuugccugagaugguuucgaaggaaucagagaggcucagcauuaccaaaagugcguguggacggaacggcaagcaguucugcuccacacugacucugaauaccgcucaagccaaccauacagguuuuuauucuuguaaguaccucgcagugccaaccagcaaaaagaaagaaacugaguccgccauauauaucuucauuucagacacagggcgcccguuuguagagauguacagugaaauccccgagauuauccacaugaccgaaggacgagaguuagugauaccuugccgugucacgagcccaaauaucacugugacccugaagaaaaagaaggcuuga

SEQ ID NO: 3819 - RNA, 525 nt, Artificial Sequence
  derived and/or modified sequence opt4 from VEGFR1__Homo_sapiens__ACF47598
auggugagcuacugggacaccggcgugcugcugugcgcccugcugagcugccugcugcugaccggcagcagcagcggcagcaagcugaaggaccccgagcugagccugaagggcacccagcacaucaugcaggccggccagacccugcaccugcagugcagaggcgaggccgcccacaaguggagccugcccgagauggugagcaaggagagcgagagacugagcaucaccaagagcgccugcggcagaaacggcaagcaguucugcagcacccugacccugaacaccgcccaggccaaccacaccggcuucuacagcugcaaguaccuggccgugcccaccagcaagaagaaggagaccgagagcgccaucuacaucuucaucagcgacaccggcagacccuucguggagauguacagcgagauccccgagaucauccacaugaccgagggcagagagcuggugauccccugcagagugaccagccccaacaucaccgugacccugaagaagaagaaggccuga

SEQ ID NO: 3820 - RNA, 525 nt, Artificial Sequence
  derived and/or modified sequence opt5 from VEGFR1__Homo_sapiens__ACF47598
auggugagcuacugggacaccggcguccugcucugcgcccugcuuuccugucugcuccugacagggucuagcuccggaucuaaacuuaaggaucccgagcugagccucaagggcacgcagcacaucaugcaagcugggcagacccugcaucugcagugcagaggagaagccgcgcacaaauggucccucccugagaugguuucuaaggaaagcgagcggcuguccauuacaaaaagcgcuuguggccgcaacgggaagcaguucugcucuacccuuacacugaauaccgcccaagccaaccauacaggauuuuauuccuguaaguaccucgcugugccgaccagcaaaaagaaagaaacggagucugccaucuauauuuucaucuccgacaccggcagacccuuuguggagauguacagcgaaauuccugagaucauccacaugacagaaggccgggagcuggucauucccugccgcgugaccucuccuaauaucacaguuacccuuaagaaaaagaaggcuuga

SEQ ID NO: 3821 - protein, 249 aa, Artificial Sequence
  WT1__Homo_sapiens__A0A0H5AUY0
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKG

SEQ ID NO: 3822 - RNA, 750 nt, Artificial Sequence
  WT1__Homo_sapiens__BAR92607
augggcuccgacgugcgggaccugaacgcgcugcugcccgccguccccucccuggguggcggcggcggcugugcccugccugugagcggcgcggcgcagugggcgccggugcuggacuuugcgcccccgggcgcuucggcuuacgggucguugggcggccccgcgccgccaccggcuccgccgccacccccgccgccgccgccucacuccuucaucaaacaggagccgagcuggggcggcgcggagccgcacgaggagcagugccugagcgccuucacuguccacuuuuccggccaguucacuggcacagccggagccugucgcuacgggcccuucgguccuccuccgcccagccaggcgucauccggccaggccaggauguuuccuaacgcgcccuaccugcccagcugccucgagagccagcccgcuauucgcaaucaggguuacagcacggucaccuucgacgggacgcccagcuacggucacacgcccucgcaccaugcggcgcaguuccccaaccacucauucaagcaugaggaucccaugggccagcagggcucgcugggugagcagcaguacucggugccgcccccggucuauggcugccacacccccaccgacagcugcaccggcagccaggcuuugcugcugaggacgcccuacagcagugacaauuuauaccaaaugacaucccagcuugaaugcaugaccuggaaucagaugaacuuaggagccaccuuaaagggguaa

SEQ ID NO: 3823 - RNA, 750 nt, Artificial Sequence
  derived and/or modified sequence opt1 from WT1__Homo_sapiens__BAR92607
augggcagcgacgugcgcgaccugaacgcccuccugcccgccguccccucccucgggggcgggggcgggugcgcgcugcccgugagcggcgccgcccagugggcccccgugcuggacuucgcgccgcccggcgccuccgccuacgggagccugggcgggcccgcgcccccgcccgcgcccccgcccccgcccccgcccccgccccacuccuucaucaagcaggagcccagcuggggcggggccgagccccacgaggagcagugccucuccgccuucaccguccacuucagcggccaguucaccggcacggccggggccugccgguacggccccuucgggccgccgccgcccucccaggccagcuccggccaggcccgcauguuccccaacgcccccuaccugcccagcugccuggagucccagcccgccauccggaaccagggcuacagcaccgugaccuucgacgggacccccuccuacggccacacgcccagccaccacgccgcccaguuccccaaccacuccuucaagcacgaggaccccauggggcagcagggcagccucggggagcagcaguacuccgugcccccgcccgucuacggcugccacacccccaccgacagcugcaccggcagccaggcgcugcugcuccgcacgcccuacuccagcgacaaccuguaccagaugaccucccagcuggagugcaugaccuggaaccagaugaaccucggggccacccugaagggcuga

SEQ ID NO: 3824 - RNA, 750 nt, Artificial Sequence
  derived and/or modified sequence opt2 from WT1__Homo_sapiens__BAR92607
augggcuccgacguccgcgaccucaacgcccuccuccccgccguccccucccucggcggcggcggcggcugcgcccuccccgucuccggcgccgcccagugggcccccguccucgacuucgccccccccggcgccuccgccuacggcucccucggcggccccgcccccccccccgccccccccccccccccccccccccccccccacuccuucaucaagcaggagcccuccuggggcggcgccgagccccacgaggagcagugccucuccgccuucaccguccacuucuccggccaguucaccggcaccgccggcgccugccgcuacggccccuucggcccccccccccccucccaggccuccuccggccaggcccgcauguuccccaacgcccccuaccuccccuccugccucgagucccagcccgccauccgcaaccagggcuacuccaccgucaccuucgacggcacccccuccuacggccacacccccucccaccacgccgcccaguuccccaaccacuccuucaagcacgaggaccccaugggccagcagggcucccucggcgagcagcaguacuccguccccccccccgucuacggcugccacacccccaccgacuccugcaccggcucccaggcccuccuccuccgcacccccuacuccuccgacaaccucuaccagaugaccucccagcucgagugcaugaccuggaaccagaugaaccucggcgccacccucaagggcuga

SEQ ID NO: 3825 - RNA, 750 nt, Artificial Sequence
  derived and/or modified sequence opt3 from WT1__Homo_sapiens__BAR92607
augggcagcgacgugagagaucugaacgcccuccuucccgcugucccuucccugggaggggguggcgggugcgcauugccaguuucuggagccgcgcagugggcuccgguguuagacuucgcacccccuggcgccucagccuacgguagucuagggggaccagcucccccuccagcacccccuccaccgcccccuccacccccucacagcuuuaucaagcaagagccauccuggggcggcgccgaaccccaugaggaacagugucugucugcuuucaccguacacuuuucggggcaguucacaggaacugccggugcgugcagguauggcccguuugggccucccccaccuucacaggcaagcaguggacaagcccggauguuccccaaugcuccauaccuccccuccugucuggagucucagccugccauucgcaaccagggcuauagcacggugaccuuugaugguacaccauccuacgggcauacuccgucacaccaugcagcucaguuccccaaucacaguuuuaaacacgaagacccuaugggacaacagggcagccuuggcgagcagcaguauucugucccacccccuguguacgggugccauaccccaacagauuccuguaccggaucacaagcccuguugcuccgaacucccuauagcagugacaaccuguaccagaugacaucucagcuggagugcaugaccuggaaucaaaugaaccucggugcgacguuaaagggcuga

SEQ ID NO: 3826 - RNA, 750 nt, Artificial Sequence
  derived and/or modified sequence opt4 from WT1__Homo_sapiens__BAR92607
augggcagcgacgugagagaccugaacgcccugcugcccgccgugcccagccugggcggcggcggcggcugcgcccugcccgugagcggcgccgcccagugggcccccgugcuggacuucgccccccccggcgccagcgccuacggcagccugggcggccccgcccccccccccgccccccccccccccccccccccccccccccacagcuucaucaagcaggagcccagcuggggcggcgccgagccccacgaggagcagugccugagcgccuucaccgugcacuucagcggccaguucaccggcaccgccggcgccugcagauacggccccuucggcccccccccccccagccaggccagcagcggccaggccagaauguuccccaacgcccccuaccugcccagcugccuggagagccagcccgccaucagaaaccagggcuacagcaccgugaccuucgacggcacccccagcuacggccacacccccagccaccacgccgcccaguuccccaaccacagcuucaagcacgaggaccccaugggccagcagggcagccugggcgagcagcaguacagcgugcccccccccguguacggcugccacacccccaccgacagcugcaccggcagccaggcccugcugcugagaacccccuacagcagcgacaaccuguaccagaugaccagccagcuggagugcaugaccuggaaccagaugaaccugggcgccacccugaagggcuga

SEQ ID NO: 3827 - RNA, 750 nt, Artificial Sequence
  derived and/or modified sequence opt5 from WT1__Homo_sapiens__BAR92607
augggcagcgacgugagagaucugaacgcccuccugcccgcugucccuucccuugggggaggcgggggaugcgcccugccgguuucuggcgcggcucagugggcccccgugcucgacuucgccccucccggggcuagcgccuacggaucccugggcggcccugcucccccuccggcgcccccucccccucccccgccucccccucacucuuuuaucaagcaagagcccagcuggggaggggccgaaccccaugaggaacagugucuuuccgccuucaccgugcacuuuucuggccaguucacagggacggcuggagccugccgguauggcccuuuugggccgcccccucccagccaggcuuccagcggacaagcccgcauguucccuaaugcgcccuaccugccgucuugucucgagucccagccugccauuagaaaccagggcuauagcaccgucacauuugauggcacccccucuuacgggcauacaccuucccaccaugcugcccaguuccccaaucacagcuuuaaacacgaagacccuaugggacaacagggcucucugggggagcagcaguauuccgugcccccgccuguuuacggaugccauacccccacagauagcuguaccggcucccaagcucugcuccugcggacgcccuauucuagcgacaaccuuuaccagaugaccucccagcuggagugcaugacauggaaucaaaugaaccucggggccacccugaagggauga

SEQ ID NO: 3828 - protein, 449 aa, Artificial Sequence
  WT1__Homo_sapiens__P19544
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 3829 - RNA, 1350 nt, Artificial Sequence
  WT1__Homo_sapiens__AAA61299
augggcuccgacgugcgggaccugaacgcgcugcugcccgccguccccucccuggguggcggcggcggcugugcccugccugugagcggcgcggcgcagugggcgccggugcuggacuuugcgcccccgggcgcuucggcuuacgggucguugggcggccccgcgccgccaccggcuccgccgccacccccgccgccgccgccucacuccuucaucaaacaggagccgagcuggggcggcgcggagccgcacgaggagcagugccugagcgccuucacuguccacuuuuccggccaguucacuggcacagccggagccugucgcuacgggcccuucgguccuccuccgcccagccaggcgucauccggccaggccaggauguuuccuaacgcgcccuaccugcccagcugccucgagagccagcccgcuauucgcaaucaggguuacagcacggucaccuucgacgggacgcccagcuacggucacacgcccucgcaccaugcggcgcaguuccccaaccacucauucaagcaugaggaucccaugggccagcagggcucgcugggugagcagcaguacucggugccgcccccggucuauggcugccacacccccaccgacagcugcaccggcagccaggcuuugcugcugaggacgcccuacagcagugacaauuuauaccaaaugacaucccagcuugaaugcaugaccuggaaucagaugaacuuaggagccaccuuaaagggaguugcugcugggagcuccagcucagugaaauggacagaagggcagagcaaccacagcacaggguacgagagcgauaaccacacaacgcccauccucugcggagcccaauacagaauacacacgcacggugucuucagaggcauucaggaugugcgacgugugccuggaguagccccgacucuuguacggucggcaucugagaccagugagaaacgccccuucaugugugcuuacccaggcugcaauaagagauauuuuaagcugucccacuuacagaugcacagcaggaagcacacuggugagaaaccauaccagugugacuucaaggacugugaacgaagguuuucucguucagaccagcucaaaagacaccaaaggagacauacaggugugaaaccauuccaguguaaaacuugucagcgaaaguucucccgguccgaccaccugaagacccacaccaggacucauacagguaaaacaagugaaaagcccuucagcugucgguggccaaguugucagaaaaaguuugcccggucagaugaauuaguccgccaucacaacaugcaucagagaaacaugaccaaacuccagcuggcgcuuuga

SEQ ID NO: 3830 - RNA, 1350 nt, Artificial Sequence
  derived and/or modified sequence opt1 from WT1__Homo_sapiens__AAA61299
augggcagcgacgugcgcgaccugaacgcccuccugcccgccgucccgucccucgggggcgggggcgggugcgcgcugcccgugagcggcgccgcccagugggcccccgugcuggacuucgcgccgcccggcgccuccgccuacgggagccugggcgggcccgcgcccccgcccgcgcccccgcccccgcccccgcccccgccccacuccuucaucaagcaggagcccagcuggggcggggccgagccccacgaggagcagugccucuccgccuucaccguccacuucagcggccaguucaccggcacggccggggccugccgguacggccccuucgggcccccgccgcccucccaggccagcuccggccaggcccgcauguuccccaacgcccccuaccugcccagcugccuggagucccagcccgccauccggaaccagggcuacagcaccgugaccuucgacgggacccccuccuacggccacacgcccagccaccacgccgcccaguuccccaaccacuccuucaagcacgaggaccccauggggcagcagggcagccucggggagcagcaguacuccgugccgccgcccgucuacggcugccacacccccaccgacagcugcaccggcagccaggcgcugcugcuccgcacgcccuacuccagcgacaaccuguaccagaugaccucccagcuggagugcaugaccuggaaccagaugaaccucggggccacccugaagggcguggccgccgggagcuccagcuccgugaaguggacggagggccagagcaaccacuccaccggguacgagagcgacaaccacaccacccccauccugugcggcgcccaguaccggauccacacgcacggcgucuuccgcgggauccaggacgugcggcgcgugcccggcgucgcgcccacccucgugcgguccgccagcgagaccuccgagaagcgccccuucaugugcgccuaccccgggugcaacaagcgguacuucaagcugagccaccuccagaugcacucccgcaagcacaccggcgagaagccguaccagugcgacuucaaggacugcgagcggcgcuucagccgguccgaccagcugaagcgccaccagcggcgccacacgggggugaagcccuuccagugcaagaccugccagcggaaguucagccgcuccgaccaccugaagacccacacccggacgcacaccggcaagaccagcgagaagcccuucagcugccgcuggcccuccugccagaagaaguucgcccgcagcgacgagcugguccggcaccacaacaugcaccagcgcaacaugaccaagcuccagcuggcccuguga

SEQ ID NO: 3831 - RNA, 1350 nt, Artificial Sequence
  derived and/or modified sequence opt2 from WT1__Homo_sapiens__AAA61299
augggcuccgacguccgcgaccucaacgcccuccuccccgccguccccucccucggcggcggcggcggcugcgcccuccccgucuccggcgccgcccagugggcccccguccucgacuucgccccccccggcgccuccgccuacggcucccucggcggccccgcccccccccccgccccccccccccccccccccccccccccccacuccuucaucaagcaggagcccuccuggggcggcgccgagccccacgaggagcagugccucuccgccuucaccguccacuucuccggccaguucaccggcaccgccggcgccugccgcuacggccccuucggcccccccccccccucccaggccuccuccggccaggcccgcauguuccccaacgcccccuaccuccccuccugccucgagucccagcccgccauccgcaaccagggcuacuccaccgucaccuucgacggcacccccuccuacggccacacccccucccaccacgccgcccaguuccccaaccacuccuucaagcacgaggaccccaugggccagcagggcucccucggcgagcagcaguacuccguccccccccccgucuacggcugccacacccccaccgacuccugcaccggcucccaggcccuccuccuccgcacccccuacuccuccgacaaccucuaccagaugaccucccagcucgagugcaugaccuggaaccagaugaaccucggcgccacccucaagggcgucgccgccggcuccuccuccuccgucaaguggaccgagggccaguccaaccacuccaccggcuacgaguccgacaaccacaccacccccauccucugcggcgcccaguaccgcauccacacccacggcgucuuccgcggcauccaggacguccgccgcguccccggcgucgcccccacccucguccgcuccgccuccgagaccuccgagaagcgccccuucaugugcgccuaccccggcugcaacaagcgcuacuucaagcucucccaccuccagaugcacucccgcaagcacaccggcgagaagcccuaccagugcgacuucaaggacugcgagcgccgcuucucccgcuccgaccagcucaagcgccaccagcgccgccacaccggcgucaagcccuuccagugcaagaccugccagcgcaaguucucccgcuccgaccaccucaagacccacacccgcacccacaccggcaagaccuccgagaagcccuucuccugccgcuggcccuccugccagaagaaguucgcccgcuccgacgagcucguccgccaccacaacaugcaccagcgcaacaugaccaagcuccagcucgcccucuga

SEQ ID NO: 3832 - RNA, 1350 nt, Artificial Sequence
  derived and/or modified sequence opt3 from WT1__Homo_sapiens__AAA61299
augggcagcgacgugagagaucugaacgcccuccuucccgcugucccuucccugggaggggguggcgggugcgcauugccaguuucuggagccgcgcagugggcuccgguguuagacuucgcacccccuggcgccucagccuacgguagucuagggggaccagcucccccuccagcacccccuccaccgcccccuccacccccucacagcuuuaucaagcaagagccauccuggggcggcgccgaaccccaugaggaacagugucugucugcuuucaccguacacuuuucggggcaguucacaggaacugccggugcgugcagguauggcccguuugggccucccccaccuucacaggcaagcaguggacaagcccggauguuccccaaugcuccauaccuccccuccugucuggagucucagccugccauucgcaaccagggcuauagcacggugaccuuugaugguacaccauccuacgggcauacuccgucacaccaugcagcucaguuccccaaucacaguuuuaaacacgaagacccuaugggacaacagggcagccuuggcgagcagcaguauucugucccacccccuguguacgggugccauaccccaacagauuccuguaccggaucacaagcccuguugcuccgaacucccuauagcagugacaaccuguaccagaugacaucucagcuggagugcaugaccuggaaucaaaugaaccucggugcgacguuaaagggcguugccgcaggguccagcucgucugugaaauggacugaaggacaguccaaucacucaaccggcuacgagagugauaaccauacaacuccgauacuguguggugcucaguaucguauccacacccacggggucuucagaggcauucaggacgugaggcggguaccuggaguugccccaacacuugugcgcagcgcuuccgaaaccucugagaagagacccuuuaugugcgccuacccuggcuguaauaaaagguauuucaaguugagccaucugcaaaugcacucacggaagcauacgggggagaaacccuaccagugcgauuuuaaggacugugaacgccgauucaguagauccgaucagcuaaaaaggcaccagcggcgucauacuggagucaagccauuccaaugcaaaacaugccagcgcaaguuuagcagaucugaccaccucaagacccacacuaggacacauaccgguaaaacgucagagaagccuuucaguugucgguggcccagcugccagaaaaaguuugcacgauccgaugaacuggugcgccaccauaacaugcaccagagaaauaugaccaaacuucaacuggccuuguga

SEQ ID NO: 3833 - RNA, 1350 nt, Artificial Sequence
  derived and/or modified sequence opt4 from WT1__Homo_sapiens__AAA61299
augggcagcgacgugagagaccugaacgcccugcugcccgccgugcccagccugggcggcggcggcggcugcgcccugcccgugagcggcgccgcccagugggcccccgugcuggacuucgccccccccggcgccagcgccuacggcagccugggcggccccgcccccccccccgccccccccccccccccccccccccccccccacagcuucaucaagcaggagcccagcuggggcggcgccgagccccacgaggagcagugccugagcgccuucaccgugcacuucagcggccaguucaccggcaccgccggcgccugcagauacggccccuucggcccccccccccccagccaggccagcagcggccaggccagaauguuccccaacgcccccuaccugcccagcugccuggagagccagcccgccaucagaaaccagggcuacagcaccgugaccuucgacggcacccccagcuacggccacacccccagccaccacgccgcccaguuccccaaccacagcuucaagcacgaggaccccaugggccagcagggcagccugggcgagcagcaguacagcgugcccccccccguguacggcugccacacccccaccgacagcugcaccggcagccaggcccugcugcugagaacccccuacagcagcgacaaccuguaccagaugaccagccagcuggagugcaugaccuggaaccagaugaaccugggcgccacccugaagggcguggccgccggcagcagcagcagcgugaaguggaccgagggccagagcaaccacagcaccggcuacgagagcgacaaccacaccacccccauccugugcggcgcccaguacagaauccacacccacggcguguucagaggcauccaggacgugagaagagugcccggcguggcccccacccuggugagaagcgccagcgagaccagcgagaagagacccuucaugugcgccuaccccggcugcaacaagagauacuucaagcugagccaccugcagaugcacagcagaaagcacaccggcgagaagcccuaccagugcgacuucaaggacugcgagagaagauucagcagaagcgaccagcugaagagacaccagagaagacacaccggcgugaagcccuuccagugcaagaccugccagagaaaguucagcagaagcgaccaccugaagacccacaccagaacccacaccggcaagaccagcgagaagcccuucagcugcagauggcccagcugccagaagaaguucgccagaagcgacgagcuggugagacaccacaacaugcaccagagaaacaugaccaagcugcagcuggcccuguga

SEQ ID NO: 3834 - RNA, 1350 nt, Artificial Sequence
  derived and/or modified sequence opt5 from WT1__Homo_sapiens__AAA61299
augggcagcgacgugagagaucugaacgcccuccugcccgcugucccuucccuugggggaggcgggggaugcgcccugccgguuucuggcgcggcucagugggcccccgugcucgacuucgccccucccggggcuagcgccuacggaucccugggcggcccugcucccccuccggcgcccccucccccucccccgccucccccucacucuuuuaucaagcaagagcccagcuggggaggggccgaaccccaugaggaacagugucuuuccgccuucaccgugcacuuuucuggccaguucacagggacggcuggagccugccgguauggcccuuuugggccgcccccucccagccaggcuuccagcggacaagcccgcauguucccuaaugcgcccuaccugccgucuugucucgagucccagccugccauuagaaaccagggcuauagcaccgucacauuugauggcacccccucuuacgggcauacaccuucccaccaugcugcccaguuccccaaucacagcuuuaaacacgaagacccuaugggacaacagggcucucugggggagcagcaguauuccgugcccccgccuguuuacggaugccauacccccacagauagcuguaccggcucccaagcucugcuccugcggacgcccuauucuagcgacaaccuuuaccagaugaccucccagcuggagugcaugacauggaaucaaaugaaccucggggccacccugaagggaguggccgcuggcucuagcuccagcgucaaauggacagaaggccagucuaaucacagcaccggguacgaguccgauaaccauacgacaccuauccuuuguggagcgcaguaucgcauucacacccacggcguguucagagggauccaggacguucggcgcgugccgggagucgcccccacacuggugagaucugcuagcgaaaccuccgagaagcggccuuuuaugugcgccuaccccggcuguaauaaacgcuauuucaagcucagccaucugcaaaugcacucuagaaagcauaccggggagaaaccuuaccagugcgauuuuaaggacugugaacggcgcuucuccagaagcgaucagcugaaacggcaccagcgcagacauacaggcgugaagcccuuccaaugcaaaacgugccagcggaaguuuucuagauccgaccaccucaagacccacacacgcacccauacaggaaaaaccagcgagaagccuuucuccugucgguggcccucuugccagaaaaaguuugccagaagcgaugaacugguccgccaccauaacaugcaccagcggaauaugacgaaacuucaacuggcucucuga

SEQ ID NO: 3835 - protein, 92 aa, Artificial Sequence
  WT1__Homo_sapiens__Q06250
MQRRGQPLENHVALIHWQSAGIPASKVHNYCNMKKSRLGRSRAVRISQPLLSPRRCPLHLTERGAGLLQPQPQGPVRTPGPPSGSHPAAADN

SEQ ID NO: 3836 - RNA, 279 nt, Artificial Sequence
  WT1__Homo_sapiens__AAA63269
augcagaggcgaggacagccccuggaaaaccauguggcguugauacacuggcaaagcgcaggcaucccggccucgaaggugcauaauuauugcaauaugaaaaaaucgaggcuggguaggagcagggcagugaggauuucucaacccuuacuuucaccccggcgcuguccacugcaucugacagagcgcggagcugggcugcuacagccgcaaccccagggaccagugcgcacgccugggccgcccuccgggagucacccagcggccgcggacaacuga

SEQ ID NO: 3837 - RNA, 279 nt, Artificial Sequence
  derived and/or modified sequence opt1 from WT1__Homo_sapiens__AAA63269
augcagcgccggggccagccccuggagaaccacguggcccucauccacuggcagagcgccgggaucccggcguccaagguccacaacuacugcaacaugaagaagucccgccugggccggucccgcgccgugcggaucagccagccccugcucagcccccgccggugcccccugcaccugaccgagcgcggggccggccuccugcagccgcagccccaggggcccgugcggacccccggcccgcccagcggcucccaccccgccgccgcggacaacuga

SEQ ID NO: 3838 - RNA, 279 nt, Artificial Sequence
  derived and/or modified sequence opt2 from WT1__Homo_sapiens__AAA63269
augcagcgccgcggccagccccucgagaaccacgucgcccucauccacuggcaguccgccggcauccccgccuccaagguccacaacuacugcaacaugaagaagucccgccucggccgcucccgcgccguccgcaucucccagccccuccucuccccccgccgcugcccccuccaccucaccgagcgcggcgccggccuccuccagccccagccccagggccccguccgcacccccggcccccccuccggcucccaccccgccgccgccgacaacuga

SEQ ID NO: 3839 - RNA, 279 nt, Artificial Sequence
  derived and/or modified sequence opt3 from WT1__Homo_sapiens__AAA63269
augcagagaaggggccaaccccuggagaaccacguggcccucauccauuggcagagcgcugggauuccugcauccaagguccacaauuacugcaacaugaaaaagucucggcuuggacgcucacgagccguucguauaagucagccacuguugagcccgagaaggugucccuuacaucugaccgaacggggugcgggccuacuccagccucaaccacaggggcccgugcgcacaccuggaccacccuccggcucucacccugcugccgcagacaauuga

SEQ ID NO: 3840 - RNA, 279 nt, Artificial Sequence
  derived and/or modified sequence opt4 from WT1__Homo_sapiens__AAA63269
augcagagaagaggccagccccuggagaaccacguggcccugauccacuggcagagcgccggcauccccgccagcaaggugcacaacuacugcaacaugaagaagagcagacugggcagaagcagagccgugagaaucagccagccccugcugagccccagaagaugcccccugcaccugaccgagagaggcgccggccugcugcagccccagccccagggccccgugagaacccccggcccccccagcggcagccaccccgccgccgccgacaacuga

SEQ ID NO: 3841 - RNA, 279 nt, Artificial Sequence
  derived and/or modified sequence opt5 from WT1__Homo_sapiens__AAA63269
augcagagacggggccaaccccuggagaaccacguggcccucauccauuggcagagcgcugggauuccugccuccaagguccacaauuacugcaacaugaaaaagucucgccugggaagaagccgggcgguucgcaucucccagccgcuucugucucccagacgguguccucuccaucugaccgaacgcggcgcugggcuucugcagccccaaccucagggacccgugagaacaccuggcccgcccagcgggucccacccugccgccgcugacaauuga

SEQ ID NO: 3842 - protein, 81 aa, Artificial Sequence
  XAGE1__Homo_sapiens__Q9HD64
MESPKKKNQQLKVGILHLGSRQKKIRIQLRSQCATWKVICKSCISQTPGINLDLGSGVKVKIIPKEEHCKMPEAGEEQPQV

SEQ ID NO: 3843 - RNA, 246 nt, Artificial Sequence
  XAGE1__Homo_sapiens__AAP35763
auggagagccccaaaaagaagaaccagcagcugaaagucgggauccuacaccugggcagcagacagaagaagaucaggauacagcugagaucccagugcgcgacauggaaggugaucugcaagagcugcaucagucaaacaccggggauaaaucuggauuuggguuccggcgucaaggugaagauaauaccuaaagaggaacacuguaaaaugccagaagcaggugaagagcaaccacaaguuuag

SEQ ID NO: 3844 - RNA, 246 nt, Artificial Sequence
  derived and/or modified sequence opt1 from XAGE1__Homo_sapiens__AAP35763
auggagagccccaagaagaagaaccagcagcugaaggugggcauccuccaccuggggucccgccagaagaagauccggauccagcugcgcagccagugcgccaccuggaaggucaucugcaaguccugcaucagccagaccccgggcaucaaccucgaccugggguccggcgugaaggugaagaucauccccaaggaggagcacugcaagaugcccgaggccggggaggagcagccccaggucuga

SEQ ID NO: 3845 - RNA, 246 nt, Artificial Sequence
  derived and/or modified sequence opt2 from XAGE1__Homo_sapiens__AAP35763
auggagucccccaagaagaagaaccagcagcucaaggucggcauccuccaccucggcucccgccagaagaagauccgcauccagcuccgcucccagugcgccaccuggaaggucaucugcaaguccugcaucucccagacccccggcaucaaccucgaccucggcuccggcgucaaggucaagaucauccccaaggaggagcacugcaagaugcccgaggccggcgaggagcagccccaggucuga

SEQ ID NO: 3846 - RNA, 246 nt, Artificial Sequence
  derived and/or modified sequence opt3 from XAGE1__Homo_sapiens__AAP35763
auggagagccccaagaaaaagaaccagcaacugaaagugggcauccuccaccuuggguccagacagaagaaaauuaggauacagcugcggucucagugcgccaccuggaaggucaucuguaagucaugcauuagucaaacaccuggaaucaauuuggacuuagguagcggcguuaaagugaagauuaucccaaaagaggaacauuguaagaugccggaagcuggggaggaacagccccagguauga

SEQ ID NO: 3847 - RNA, 246 nt, Artificial Sequence
  derived and/or modified sequence opt4 from XAGE1__Homo_sapiens__AAP35763
auggagagccccaagaagaagaaccagcagcugaaggugggcauccugcaccugggcagcagacagaagaagaucagaauccagcugagaagccagugcgccaccuggaaggugaucugcaagagcugcaucagccagacccccggcaucaaccuggaccugggcagcggcgugaaggugaagaucauccccaaggaggagcacugcaagaugcccgaggccggcgaggagcagccccagguguga

SEQ ID NO: 3848 - RNA, 246 nt, Artificial Sequence
  derived and/or modified sequence opt5 from XAGE1__Homo_sapiens__AAP35763
auggagagccccaagaaaaagaaccagcaacugaaagugggcauccuccaccugggguccagacagaagaaaauucggauccagcuucgcucucagugcgccaccuggaaggucauuuguaagagcugcaucucccaaacaccuggaauuaaucuggaccucggcucugggguuaaagugaagaucaucccgaaagaggaacauuguaagaugcccgaagcuggagaggaacagccucagguguga

SEQ ID NO: 3849 - protein, 254 aa, Artificial Sequence
  4-1BBL__Homo_sapiens__P41273
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 3850 - RNA, 765 nt, Artificial Sequence
  4-1BBL__Homo_sapiens__AAA53134
auggaauacgccucugacgcuucacuggaccccgaagccccguggccucccgcgccccgcgcucgcgccugccgcguacugccuugggcccuggucgcggggcugcugcugcugcugcugcucgcugccgccugcgccgucuuccucgccugccccugggccguguccggggcucgcgccucgcccggcuccgcggccagcccgagacuccgcgagggucccgagcuuucgcccgacgaucccgccggccucuuggaccugcggcagggcauguuugcgcagcugguggcccaaaauguucugcugaucgaugggccccugagcugguacagugacccaggccuggcaggcgugucccugacggggggccugagcuacaaagaggacacgaaggagcuggugguggccaaggcuggagucuacuaugucuucuuucaacuagagcugcggcgcgugguggccggcgagggcucaggcuccguuucacuugcgcugcaccugcagccacugcgcucugcugcuggggccgccgcccuggcuuugaccguggaccugccacccgccuccuccgaggcucggaacucggccuucgguuuccagggccgcuugcugcaccugagugccggccagcgccugggcguccaucuucacacugaggccagggcacgccaugccuggcagcuuacccagggcgccacagucuugggacucuuccgggugacccccgaaaucccagccggacucccuucaccgaggucggaauaa

SEQ ID NO: 3851 - RNA, 765 nt, Artificial Sequence
  derived and/or modified sequence opt1 from 4-1BBL__Homo_sapiens__AAA53134
auggaguacgccagcgacgccucccuggaccccgaggcgccguggccgcccgcgccccgcgcccgggccugccgcgugcuccccugggcccuggucgccggccugcuccugcugcuccugcuggccgccgccugcgcgguguuccucgccugccccugggccgugagcggggcccgggccucccccggcagcgcggccagcccccgccugcgggaggggccggagcugucccccgacgaccccgccggccuccuggaccugcgccaggggauguucgcccagcucgucgcccagaacgugcugcugaucgacggcccccucuccugguacagcgacccgggccuggcgggggugucccugaccggcgggcucagcuacaaggaggacaccaaggagcuggucguggccaaggccggcguguacuacgucuucuuccagcuggagcuccggcgcgugguggccggggagggcuccggcagcgucucccuggcccugcaccuccagccccugcggagcgcggccggggccgccgcccuggcgcucacgguggaccugccgcccgccuccagcgaggcccgcaacuccgccuucggcuuccaggggcggcugcuccaccugagcgcgggccagcgccugggcgugcaccuccacaccgaggcccgggcccgccacgccuggcagcugacccagggggccaccguccugggccucuuccgggugacgcccgagauccccgcggggcugcccagcccccgcuccgaguga

SEQ ID NO: 3852 - RNA, 765 nt, Artificial Sequence
  derived and/or modified sequence opt2 from 4-1BBL__Homo_sapiens__AAA53134
auggaguacgccuccgacgccucccucgaccccgaggcccccuggccccccgccccccgcgcccgcgccugccgcguccuccccugggcccucgucgccggccuccuccuccuccuccuccucgccgccgccugcgccgucuuccucgccugccccugggccgucuccggcgcccgcgccucccccggcuccgccgccuccccccgccuccgcgagggccccgagcucucccccgacgaccccgccggccuccucgaccuccgccagggcauguucgcccagcucgucgcccagaacguccuccucaucgacggcccccucuccugguacuccgaccccggccucgccggcgucucccucaccggcggccucuccuacaaggaggacaccaaggagcucgucgucgccaaggccggcgucuacuacgucuucuuccagcucgagcuccgccgcgucgucgccggcgagggcuccggcuccgucucccucgcccuccaccuccagccccuccgcuccgccgccggcgccgccgcccucgcccucaccgucgaccucccccccgccuccuccgaggcccgcaacuccgccuucggcuuccagggccgccuccuccaccucuccgccggccagcgccucggcguccaccuccacaccgaggcccgcgcccgccacgccuggcagcucacccagggcgccaccguccucggccucuuccgcgucacccccgagauccccgccggccuccccuccccccgcuccgaguga

SEQ ID NO: 3853 - RNA, 765 nt, Artificial Sequence
  derived and/or modified sequence opt3 from 4-1BBL__Homo_sapiens__AAA53134
auggaguacgccagcgacgcuucccuggaucccgaagcaccuuggccaccggcccccagagcgagggcuugccgggugcucccuugggcccuugucgcaggccuguuguuacugcuacuccuggccgcugcaugugccguuuuccuugcuugcccaugggccgugucuggggcgcgcgcaucacccggaagugccgcuagcccucgacugcgugaggguccagaauugucccccgacgauccugccggccuccuggaccugagacaggggauguuugcacaacucguagcucagaacguguuacugaucgauggaccacuuucuugguauucggacccgggcuuggccggugucucacugaccgggggacuaagcuacaaggaggauacaaaagaacucgugguugcgaaggccggcguguauuacgucuucuuucagcuggagcuuaggcgggugguagcaggcgaggggaguggauccguuucucuggcuuugcaccuccagccccugcgcagcgccgcuggugccgcagccuuagcucugacuguggaccucccuccagcguccucagaagcaagaaauagugccuucggcuuucaagggaggcuucugcauuugagcgcuggacagcggcuaggcguccaucugcacacggaggcccgcgcacgacacgccuggcagcucacccagggugcuacagugcuggggcuuuucagagugacucccgaaauuccugccggacugccaucucccagguccgaguga

SEQ ID NO: 3854 - RNA, 765 nt, Artificial Sequence
  derived and/or modified sequence opt4 from 4-1BBL__Homo_sapiens__AAA53134
auggaguacgccagcgacgccagccuggaccccgaggcccccuggccccccgcccccagagccagagccugcagagugcugcccugggcccugguggccggccugcugcugcugcugcugcuggccgccgccugcgccguguuccuggccugccccugggccgugagcggcgccagagccagccccggcagcgccgccagccccagacugagagagggccccgagcugagccccgacgaccccgccggccugcuggaccugagacagggcauguucgcccagcugguggcccagaacgugcugcugaucgacggcccccugagcugguacagcgaccccggccuggccggcgugagccugaccggcggccugagcuacaaggaggacaccaaggagcuggugguggccaaggccggcguguacuacguguucuuccagcuggagcugagaagagugguggccggcgagggcagcggcagcgugagccuggcccugcaccugcagccccugagaagcgccgccggcgccgccgcccuggcccugaccguggaccugccccccgccagcagcgaggccagaaacagcgccuucggcuuccagggcagacugcugcaccugagcgccggccagagacugggcgugcaccugcacaccgaggccagagccagacacgccuggcagcugacccagggcgccaccgugcugggccuguucagagugacccccgagauccccgccggccugcccagccccagaagcgaguga

SEQ ID NO: 3855 - RNA, 765 nt, Artificial Sequence
  derived and/or modified sequence opt5 from 4-1BBL__Homo_sapiens__AAA53134
auggaguacgccagcgacgcuucccuggaucccgaagccccuuggccgcccgcgccuagagcucgggccugccgcgugcuccccugggcccuggucgcuggccuucugcuccugcuucugcucgccgcugccugugcgguuuuccuggccugcccuugggcugugucuggggccagagcuagccccggauccgccgcgucuccucggcugcgcgagggcccggaacucagccccgacgauccugccgggcugcuugaccugagacagggaauguuugcucaacucguggcccagaacguccugcuuaucgauggcccccuguccugguauucugacccugggcucgcuggagugagccugaccggcggccuguccuacaaggaggauacaaaagaacucguuguggccaaggccggggucuauuacguguucuuucagcuggagcuucggcgcguuguggcuggagagggcagcgggucugucucccuggcgcuccaucugcagccccuuagaagcgccgcuggagccgccgcucuggcccucacgguggaccugccgccugcgucuuccgaagcucggaauagcgccuucggcuuucaagggcgccugcuccaccugucugccggacagagacuuggcgugcaucugcacaccgaggcucgggcccgccacgcuuggcagcucacacagggcgccaccguccuggggcuuuucagaguuacacccgaaauuccugcgggacugcccagcccccgguccgaguga

SEQ ID NO: 3856 - RNA, 765 nt, Artificial Sequence
  derived and/or modified sequence opt6 from 4-1BBL__Homo_sapiens__AAA53134
auggaauacgcaucagaugcaucacuagauccagaagcaccauggccuccagcuccaagagcaagagccuguagaguacuaccaugggcauuaguugcaggauuauuacuauuauuauuacuagcagcagcaugcgcaguauuucuagcauguccaugggcuguuucuggagcuagagcaagcccgggcucagcagcaagcccuagauuaagagaaggaccagaauuaagcccagaugauccagcaggauuacuugauuuaagacaagguauguuugcacaacuaguagcucaaaauguauuacuaauagauggaccacuaaguugguauucagauccaggauuagcaggaguaagucuaacagguggauuaaguuauaaagaagacacaaaagaacuaguagucgcaaaagcgggaguauacuauguauuuuuccaauuagaguuaagaagaguuguagcgggcgaaggaucaggaucaguaucauuagcuuuacaucuacaaccacuaagaucagccgcuggcgcagcugcauuagcacucacaguagaucuuccaccagcaaguucagaagcaagaaauagugcauucggauuccaaggaagauuauuacaucuuagcgcgggacaacgauuagguguacacuuacacacagaagcacgagcaagacaugcauggcaauuaacacaaggagcaacaguauuaggacuauuuagaguaaccccagaaauaccagcaggauuacccucaccaagaucagaauaa

SEQ ID NO: 3857 - protein, 250 aa, Artificial Sequence [sequence omitted]

SEQ ID NO: 3858 - RNA, 753 nt, Artificial Sequence
  APRIL__Homo_sapiens__AAC61312
augccagccucaucuccuuucuugcuagcccccaaagggccuccaggcaacauggggggcccagucagagagccggcacucucaguugcccucugguugaguuggggggcagcucugggggccguggcuugugccauggcucugcugacccaacaaacagagcugcagagccucaggagagaggugagccggcugcaggggacaggaggccccucccagaauggggaaggguaucccuggcagagucucccggagcagaguuccgaugcccuggaagccugggagaauggggagagaucccggaaaaggagagcagugcucacccaaaaacagaagaagcagcacucuguccugcaccugguucccauuaacgccaccuccaaggaugacuccgaugugacagaggugauguggcaaccagcucuuaggcgugggagaggccuacaggcccaaggauaugguguccgaauccaggaugcuggaguuuaucugcuguauagccagguccuguuucaagacgugacuuucaccaugggucagguggugucucgagaaggccaaggaaggcaggagacucuauuccgauguauaagaaguaugcccucccacccggaccgggccuacaacagcugcuauagcgcaggugucuuccauuuacaccaaggggauauucugagugucauaauuccccgggcaagggcgaaacuuaaccucucuccacauggaaccuuccugggguuugugaaacuguga

SEQ ID NO: 3859 - RNA, 753 nt, Artificial Sequence
  derived and/or modified sequence opt1 from APRIL__Homo_sapiens__AAC61312
augcccgccagcuccccguuccugcucgcccccaagggcccgcccgggaacaugggcgggcccgugcgcgagcccgcgcugagcgucgcccuguggcucuccuggggcgccgcccugggggccguggcgugcgccauggcccugcucacccagcagaccgagcugcagagccugcggcgcgaggugucccggcuccagggcacgggcgggcccagccagaacggcgagggguaccccuggcagucccugccggagcagagcuccgacgcccuggaggcgugggagaacggcgagcgcagccggaagcgccgggccguccucacccagaagcagaagaagcagcacuccgugcugcaccuggugcccaucaacgccaccagcaaggacgacuccgacgucaccgaggugauguggcagcccgcccuccgccgggggcgcggccugcaggcccagggcuacggggugcggauccaggacgcgggcgucuaccugcucuacagccaggugcuguuccaggacgugacguucaccauggggcaggucgugucccgcgagggccagggccggcaggagacccuguuccgcugcauccggagcaugcccucccacccggaccgcgccuacaacagcugcuacuccgccgggguguuccaccuccaccagggcgacauccugagcgucaucaucccccgggcccgcgccaagcugaaccucagcccccacgggaccuuccugggcuucgugaagcuguga

SEQ ID NO: 3860 - RNA, 753 nt, Artificial Sequence
  derived and/or modified sequence opt2 from APRIL__Homo_sapiens__AAC61312
augcccgccuccucccccuuccuccucgcccccaagggcccccccggcaacaugggcggccccguccgcgagcccgcccucuccgucgcccucuggcucuccuggggcgccgcccucggcgccgucgccugcgccauggcccuccucacccagcagaccgagcuccagucccuccgccgcgaggucucccgccuccagggcaccggcggccccucccagaacggcgagggcuaccccuggcagucccuccccgagcaguccuccgacgcccucgaggccugggagaacggcgagcgcucccgcaagcgccgcgccguccucacccagaagcagaagaagcagcacuccguccuccaccucguccccaucaacgccaccuccaaggacgacuccgacgucaccgaggucauguggcagcccgcccuccgccgcggccgcggccuccaggcccagggcuacggcguccgcauccaggacgccggcgucuaccuccucuacucccagguccucuuccaggacgucaccuucaccaugggccaggucgucucccgcgagggccagggccgccaggagacccucuuccgcugcauccgcuccaugcccucccaccccgaccgcgccuacaacuccugcuacuccgccggcgucuuccaccuccaccagggcgacauccucuccgucaucaucccccgcgcccgcgccaagcucaaccucuccccccacggcaccuuccucggcuucgucaagcucuga

SEQ ID NO: 3861 - RNA, 753 nt, Artificial Sequence
  derived and/or modified sequence opt3 from APRIL__Homo_sapiens__AAC61312
augcccgccagcuccccuuuccugcucgcuccaaagggcccgcccgggaacaugggagguccugugagagagccagcacuuucugucgcccugugguugucauggggcgcggcuuuaggggccguugcaugcgccauggcucugcuaacccagcaaacagaacuccagagucugaggcgggaggugagccgccuucagggaacuggcggucccucccagaauggggaaggauacccuuggcaaucucugccagagcagucgucagacgcauuggaagccugggagaacggcgagcgaagccguaaaagaagggcuguacucacgcagaagcagaaaaagcaacacagugugcugcaucugguccccaucaaugccaccuccaaagaugacucugaugugacagaaguuauguggcagccugcgcuccggcgcggcagaggguuacaggcacagggauauggugugaggauucaagacgccggcgucuaccugcuuuauagccagguguuguuucaggauguaacuuucaccauggggcaaguugugucccgggagggacagggccgccaggaaacacuguuucgauguauaagaucaaugccaagucacccggacagggcuuacaacagcugcuauucugccggugucuuccaucuacaccagggggauauccucuccgugauuaucccccgggcacgugcuaagcugaaucuuucaccucauggaaccuuucugggcuucgugaaguuguga

SEQ ID NO: 3862 - RNA, 753 nt, Artificial Sequence
  derived and/or modified sequence opt4 from APRIL__Homo_sapiens__AAC61312
augcccgccagcagccccuuccugcuggcccccaagggcccccccggcaacaugggcggccccgugagagagcccgcccugagcguggcccuguggcugagcuggggcgccgcccugggcgccguggccugcgccauggcccugcugacccagcagaccgagcugcagagccugagaagagaggugagcagacugcagggcaccggcggccccagccagaacggcgagggcuaccccuggcagagccugcccgagcagagcagcgacgcccuggaggccugggagaacggcgagagaagcagaaagagaagagccgugcugacccagaagcagaagaagcagcacagcgugcugcaccuggugcccaucaacgccaccagcaaggacgacagcgacgugaccgaggugauguggcagcccgcccugagaagaggcagaggccugcaggcccagggcuacggcgugagaauccaggacgccggcguguaccugcuguacagccaggugcuguuccaggacgugaccuucaccaugggccagguggugagcagagagggccagggcagacaggagacccuguucagaugcaucagaagcaugcccagccaccccgacagagccuacaacagcugcuacagcgccggcguguuccaccugcaccagggcgacauccugagcgugaucauccccagagccagagccaagcugaaccugagcccccacggcaccuuccugggcuucgugaagcuguga

SEQ ID NO: 3863 - RNA, 753 nt, Artificial Sequence
  derived and/or modified sequence opt5 from APRIL__Homo_sapiens__AAC61312
augcccgccagcuccccuuuccugcucgcuccgaaggggcccccugggaacaugggaggccccgugagagagccugcccugucugucgcgcuuuggcugagcuggggcgcugcccucggagccguugcuugcgccauggcucugcuuacccagcaaacagaacugcagucccuccggcgcgaggugucuagacugcagggcaccgggggacccagccagaauggcgaaggcuacccuuggcaaucccugccggagcagucuagcgacgcccucgaagcgugggagaacggggagcggucccgcaaaagacgggccgugcugacgcagaagcagaaaaagcaacacagcguccuucaucuggugcccaucaaugcuacaucuaaagaugacuccgauguuaccgaagugauguggcagccugcccuccgcagaggacggggccugcaggcucagggguauggaguccgcauucaagacgccggcguguaccuucuguauagccagguucucuuucaggaugugacauucaccauggggcaagucgugucuagagagggacagggccggcaggaaacacuguuucgcuguaucagauccaugcccagccacccugaccgggcguacaacucuugcuauuccgccggcguguuccaucugcaccagggggauauucucagcgucaucauuccccgcgcuagagccaagcugaaucuuuccccgcauggaaccuuucugggcuucguuaagcucuga

SEQ ID NO: 3864 - RNA, 753 nt, Artificial Sequence
  derived and/or modified sequence opt6 from APRIL__Homo_sapiens__AAC61312
augccagcaucaagcccauuuuuauuagcaccaaaaggaccaccaggaaauaugggaggaccaguaagagaaccagcauuaucaguagcauuaugguuaucguggggagcagcauuaggagcaguagcaugcgcaauggcauuauuaacacaacaaacagaauuacaaagcuuaagaagagaaguaucaagauuacaaggaaccggaggaccaagccaaaacggagaaggguaccccuggcaaucauuaccagaacaaucaucagaugcauuagaagcaugggaaaauggagaaagaucaagaaaaagaagagcaguauuaacacaaaaacaaaaaaaacaacauaguguauuacaucucguaccaauaaaugcaacaucaaaagaugauucagacguaacagaaguaauguggcaaccagcacuaagaagaggaagaggauuacaagcacaaggguacggaguaagaauacaagaugcaggaguauauuuauuauauucacaaguacuauuucaagauguaacuuucacaaugggacaaguaguaucaagagaaggacaaggacgacaagaaacauuauuuagaugcauaagaucaaugccaucacacccagacagagcauacaauucauguuauucagcaggaguauuucacuuacaccaaggagauauauuaaguguaauaauaccaagagcaagagcaaaauuaaaucuaucaccacacggaacauucuuaggauuuguaaaauuauaa

SEQ ID NO: 3865 - protein, 184 aa, Artificial Sequence
  BAFF__Homo_sapiens__Q5H8V1
MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGASSAEAPDGDKDAPEPLDKVIILSPGISDATAPAWPPPGEDPGTTPPGHSVPVPATELGSTELVTTKTAGPEQQ

SEQ ID NO: 3866 - RNA, 555 nt, Artificial Sequence
  BAFF__Homo_sapiens__AAI05124
augaggcgagggccccggagccugcggggcagggacgcgccagcccccacgcccugcgucccggccgagugcuucgaccugcugguccgccacugcguggccugcgggcuccugcgcacgccgcggccgaaaccggccggggccagcagcccugcgcccaggacggcgcugcagccgcaggagucggugggcgcgggggccggcgaggcggcgcugccccugcccgggcugcucuuuggcgcccccgcgcugcugggccuggcacugguccuggcgcugguccuggugggucuggugagcuggaggcggcgacagcggcggcuucgcggcgcguccuccgcagaggcccccgacggagacaaggacgccccagagccccuggacaaggucaucauucugucuccgggaaucucugaugccacagcuccugccuggccuccuccuggggaagacccaggaaccaccccaccuggccacagugucccugugccagccacagagcugggcuccacugaacuggugaccaccaagacggccggcccugagcaacaauag

SEQ ID NO: 3867 - RNA, 555 nt, Artificial Sequence
  derived and/or modified sequence opt1 from BAFF__Homo_sapiens__AAI05124
augcgccggggcccccgcagccugcgggggcgcgacgccccggcccccacccccugcgugcccgcggagugcuucgaccuccugguccggcacugcguggccugcggccugcuccgcaccccgcggcccaagcccgccggggccuccagccccgccccgcgcacggcgcugcagccccaggaguccgugggcgccggggccggcgaggccgcgcugccccuccccggccugcuguucggggccccggcccuccugggccuggcccucguccuggcccuggugcucguggggcuggucagcuggcggcgccggcagcgccggcugcgcggcgcguccagcgccgaggcccccgacggggacaaggacgcccccgagccccucgacaaggugaucauccuguccccgggcaucagcgacgccaccgcgcccgccuggcccccgcccggcgaggaccccgggaccaccccgcccggccacuccgugcccguccccgccacggagcuggggagcaccgagcucgugaccaccaagacggccggccccgagcagcaguga

SEQ ID NO: 3868 - RNA, 555 nt, Artificial Sequence
  derived and/or modified sequence opt2 from BAFF__Homo_sapiens__AAI05124
augcgccgcggcccccgcucccuccgcggccgcgacgcccccgcccccacccccugcguccccgccgagugcuucgaccuccucguccgccacugcgucgccugcggccuccuccgcaccccccgccccaagcccgccggcgccuccucccccgccccccgcaccgcccuccagccccaggaguccgucggcgccggcgccggcgaggccgcccucccccuccccggccuccucuucggcgcccccgcccuccucggccucgcccucguccucgcccucguccucgucggccucgucuccuggcgccgccgccagcgccgccuccgcggcgccuccuccgccgaggcccccgacggcgacaaggacgcccccgagccccucgacaaggucaucauccucucccccggcaucuccgacgccaccgcccccgccuggcccccccccggcgaggaccccggcaccaccccccccggccacuccguccccguccccgccaccgagcucggcuccaccgagcucgucaccaccaagaccgccggccccgagcagcaguga

SEQ ID NO: 3869 - RNA, 555 nt, Artificial Sequence
  derived and/or modified sequence opt3 from BAFF__Homo_sapiens__AAI05124
augagaaggggcccccggagccugcgcgggcgagacgccccugcuccaaccccgugcgugcccgcagaguguuucgaucuccuuguccgucacugcguugccuguggacuguugagaacaccuaggccaaagcccgcgggugcuuccucuccugccccacggacugcauuacagccccaagaaucagugggcgccggggcuggagaggcagcccugccucuaccaggccuccuguuuggugcuccggcccuucugggguuggcgcucguacuggcacuggugcucgucggauuagugaguuggcgcagaaggcagcggcgccugcgaggcgccagcuccgcugaagcccccgacggcgauaaagacgcaccugagccacuugauaagguuaucauuuugucucccgggauaucggacgcuacggccccugcguggccacccccgggagaagauccugguaccacacccccaggccauucagugccuguccccgccacugagcuggggagcaccgagcuagugacaaccaaaacugcaggaccagaacagcaguga

SEQ ID NO: 3870 - RNA, 555 nt, Artificial Sequence
  derived and/or modified sequence opt4 from BAFF__Homo_sapiens__AAI05124
augagaagaggccccagaagccugagaggcagagacgcccccgcccccacccccugcgugcccgccgagugcuucgaccugcuggugagacacugcguggccugcggccugcugagaacccccagacccaagcccgccggcgccagcagccccgcccccagaaccgcccugcagccccaggagagcgugggcgccggcgccggcgaggccgcccugccccugcccggccugcuguucggcgcccccgcccugcugggccuggcccuggugcuggcccuggugcuggugggccuggugagcuggagaagaagacagagaagacugagaggcgccagcagcgccgaggcccccgacggcgacaaggacgcccccgagccccuggacaaggugaucauccugagccccggcaucagcgacgccaccgcccccgccuggcccccccccggcgaggaccccggcaccaccccccccggccacagcgugcccgugcccgccaccgagcugggcagcaccgagcuggugaccaccaagaccgccggccccgagcagcaguga

SEQ ID NO: 3871 - RNA, 555 nt, Artificial Sequence
  derived and/or modified sequence opt5 from BAFF__Homo_sapiens__AAI05124
augagacggggcccccgcagccugagagggcgggacgccccugcuccgacccccugcgugccugccgaguguuucgaucuccugguccgccacugcguugcguguggacuucugagaacaccccggccuaagcccgcuggcgccuccucuccugccccgcgcacggcucuccagccccaagaaagcgugggggccggagcuggcgaggccgcgcugccucuucccgggcugcucuuuggagccccugcucugcugggccucgcccuggugcuugcucugguccucgugggccugguuuccuggagacggcgccagagacggcuucgcggggccucuagcgcggaagcccccgacggagauaaagacgcuccggagccucuggauaaggugaucauucucucccccggcaucucugacgccaccgcuccugccuggcccccucccggggaagauccgggaacaacacccccuggccauagcguccccgugccugccaccgagcugggguccaccgagcugguuacaaccaaaacggcuggacccgaacagcaguga

SEQ ID NO: 3872 - RNA, 555 nt, Artificial Sequence
  derived and/or modified sequence opt6 from BAFF__Homo_sapiens__AAI05124
augagaagaggaccaagaucauuaagaggaagagaugcaccagcaccaacaccauguguaccagcagaauguuucgaucuauuaguaagacauuguguagcauguggauuauuaagaacaccaagaccaaaaccagcaggagcaucaucaccagcaccaagaacagcauuacaaccacaagaaucaguaggagcuggagccggagaagcagcauuaccacuaccaggauuauuauuuggagcacccgcauuauuaggauuagcauuaguacuagcauuaguauuaguugguuuaguaucauggagaagaagacaaagaagauuaagaggagcuucaucagcagaagcaccugauggagauaaagaugcaccagaaccauuagauaaaguaauaauauuaucaccaggaauaagugaugcaacagcaccagcauggccaccaccaggagaagauccaggaacaacaccaccaggccauagcguaccaguaccagcaacagaauuaggaucaacagaacuaguaacaacaaaaacagcaggaccagaacaacaauaa

SEQ ID NO: 3873 - protein, 285 aa, Artificial Sequence
  BAFF__Homo_sapiens__Q9Y275
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 3874 - RNA, 858 nt, Artificial Sequence
  BAFF__Homo_sapiens__AAD21092
auggaugacuccacagaaagggagcagucacgccuuacuucuugccuuaagaaaagagaagaaaugaaacugaaggaguguguuuccauccucccacggaaggaaagccccucuguccgauccuccaaagacggaaagcugcuggcugcaaccuugcugcuggcacugcugucuugcugccucacgguggugucuuucuaccagguggccgcccugcaaggggaccuggccagccuccgggcagagcugcagggccaccacgcggagaagcugccagcaggagcaggagcccccaaggccggccuggaggaagcuccagcugucaccgcgggacugaaaaucuuugaaccaccagcuccaggagaaggcaacuccagucagaacagcagaaauaagcgugccguucaggguccagaagaaacagucacucaagacugcuugcaacugauugcagacagugaaacaccaacuauacaaaaaggaucuuacacauuuguuccauggcuucucagcuuuaaaaggggaagugcccuagaagaaaaagagaauaaaauauuggucaaagaaacugguuacuuuuuuauauauggucagguuuuauauacugauaagaccuacgccaugggacaucuaauucagaggaagaagguccaugucuuuggggaugaauugagucuggugacuuuguuucgauguauucaaaauaugccugaaacacuacccaauaauuccugcuauucagcuggcauugcaaaacuggaagaaggagaugaacuccaacuugcaauaccaagagaaaaugcacaaauaucacuggauggagaugucacauuuuuuggugcauugaaacugcuguga

SEQ ID NO: 3875 - RNA, 858 nt, Artificial Sequence
  derived and/or modified sequence opt1 from BAFF__Homo_sapiens__AAD21092
auggacgacagcaccgagcgcgagcagucccggcugaccagcugccucaagaagcgcgaggagaugaagcugaaggagugcguguccauccugccccggaaggagagcccguccguccgcagcuccaaggacggcaagcuccuggccgccacgcugcuccuggcgcugcucagcugcugccugaccgugguguccuucuaccaggucgccgcccugcagggggaccucgccagccugcgggccgagcugcagggccaccacgcggagaagcuccccgccggggccggcgcccccaaggcggggcuggaggaggcccccgccgugaccgccggccugaagaucuucgagccgcccgcccccggcgaggggaacuccagccagaacucccgcaacaagcgggcggugcagggccccgaggagaccgucacgcaggacugccuccagcugaucgccgacagcgagaccccgaccauccagaagggguccuacaccuucgugcccuggcugcucagcuucaagcgcggcuccgcccuggaggagaaggagaacaagauccuggugaaggagacgggguacuucuucaucuacggccagguccucuacaccgacaagaccuacgccaugggccaccugauccagcggaagaaggugcacguguucggggacgagcugagccucgucacccuguuccgcugcauccagaacaugcccgagacgcugcccaacaacuccugcuacagcgccggcaucgcgaagcucgaggagggggacgagcugcagcuggccaucccgcgggagaacgcccagaucagccucgacggcgacgugaccuucuucggcgcccugaagcugcucuga

SEQ ID NO: 3876 - RNA, 858 nt, Artificial Sequence
  derived and/or modified sequence opt2 from BAFF__Homo_sapiens__AAD21092
auggacgacuccaccgagcgcgagcagucccgccucaccuccugccucaagaagcgcgaggagaugaagcucaaggagugcgucuccauccucccccgcaaggagucccccuccguccgcuccuccaaggacggcaagcuccucgccgccacccuccuccucgcccuccucuccugcugccucaccgucgucuccuucuaccaggucgccgcccuccagggcgaccucgccucccuccgcgccgagcuccagggccaccacgccgagaagcuccccgccggcgccggcgcccccaaggccggccucgaggaggcccccgccgucaccgccggccucaagaucuucgagccccccgcccccggcgagggcaacuccucccagaacucccgcaacaagcgcgccguccagggccccgaggagaccgucacccaggacugccuccagcucaucgccgacuccgagacccccaccauccagaagggcuccuacaccuucguccccuggcuccucuccuucaagcgcggcuccgcccucgaggagaaggagaacaagauccucgucaaggagaccggcuacuucuucaucuacggccagguccucuacaccgacaagaccuacgccaugggccaccucauccagcgcaagaagguccacgucuucggcgacgagcucucccucgucacccucuuccgcugcauccagaacaugcccgagacccuccccaacaacuccugcuacuccgccggcaucgccaagcucgaggagggcgacgagcuccagcucgccaucccccgcgagaacgcccagaucucccucgacggcgacgucaccuucuucggcgcccucaagcuccucuga

SEQ ID NO: 3877 - RNA, 858 nt, Artificial Sequence
  derived and/or modified sequence opt3 from BAFF__Homo_sapiens__AAD21092
auggacgauagcaccgagagagaacaguccaggcugacaucuugccucaagaaacgggaggaaaugaaacuuaaggagugugugucaauccugccccgcaaggaaaguccuagcguccgauccucuaaagacggcaaguuguuagccgcuacucugcuacucgcacugcuuucgugcugucugacgguugugucauucuaccaaguagccgcguugcagggggaucucgcuagccugcgugccgagcugcagggacaccaugcagagaagcucccagccggugcuggcgcaccgaaagccggguuagaagaggcucccgccgugaccgcgggacugaagauuuuugaaccuccagcacccggcgaggguaacaguucccaaaauucuagaaacaaaagggccguccaggggccugaggaaacagugacucaggacugccuucaguugauagcugauagcgagaccccaacaauccagaagggauccuauaccuucguucccuggcugcuaucauuuaaacggggcagugcccucgaagagaaggaaaauaagauucuggugaaagagacuggcuacuucuuuaucuaugggcaaguccuuuacacagacaagaccuaugcaaugggacaccugauucagcgcaaaaaggugcauguauucggugaugaguugagccucguuacgcuguuuagauguauccagaacaugccugaaacuuuaccaaauaacucuugcuacuccgcuggcauagccaaacuggaggaaggggacgagcuccagcuugcgaucccgagggaaaaugcccaaauuucacuggauggagacgugaccuucuuuggcgcauugaagcuacuguga

SEQ ID NO: 3878 - RNA, 858 nt, Artificial Sequence
  derived and/or modified sequence opt4 from BAFF__Homo_sapiens__AAD21092
auggacgacagcaccgagagagagcagagcagacugaccagcugccugaagaagagagaggagaugaagcugaaggagugcgugagcauccugcccagaaaggagagccccagcgugagaagcagcaaggacggcaagcugcuggccgccacccugcugcuggcccugcugagcugcugccugaccguggugagcuucuaccagguggccgcccugcagggcgaccuggccagccugagagccgagcugcagggccaccacgccgagaagcugcccgccggcgccggcgcccccaaggccggccuggaggaggcccccgccgugaccgccggccugaagaucuucgagccccccgcccccggcgagggcaacagcagccagaacagcagaaacaagagagccgugcagggccccgaggagaccgugacccaggacugccugcagcugaucgccgacagcgagacccccaccauccagaagggcagcuacaccuucgugcccuggcugcugagcuucaagagaggcagcgcccuggaggagaaggagaacaagauccuggugaaggagaccggcuacuucuucaucuacggccaggugcuguacaccgacaagaccuacgccaugggccaccugauccagagaaagaaggugcacguguucggcgacgagcugagccuggugacccuguucagaugcauccagaacaugcccgagacccugcccaacaacagcugcuacagcgccggcaucgccaagcuggaggagggcgacgagcugcagcuggccauccccagagagaacgcccagaucagccuggacggcgacgugaccuucuucggcgcccugaagcugcuguga

SEQ ID NO: 3879 - RNA, 858 nt, Artificial Sequence
  derived and/or modified sequence opt5 from BAFF__Homo_sapiens__AAD21092
auggacgauagcaccgagagagaacagucccggcugacaucuugccucaagaaacgcgaggaaaugaagcugaaagagugugugagcauccuucccagaaaggaauccccuucuguccggagcuccaaagacggcaagcugcucgccgcuacgcugcuucuggcccuccugucuugcugucugaccguugugagcuucuaccaaguggcggcucuccagggggaucuggccucccuucgcgccgagcugcagggacaccaugcugagaagcucccggccggcgcuggggcccccaaagcgggacuggaagaggccccugcugucacagccggccuuaagauuuuugaacccccugcucccggggagggaaacagcucucaaaauuccagaaacaaacgggccgugcagggcccugaggaaaccguuacacaggacugccugcagcucaucgcggauagcgagaccccgacaauucagaagggcucuuauaccuucgugcccuggcugcuguccuuuaaacgcgggagcgcccucgaagagaaggaaaauaagauccuggucaaagagacgggauacuucuuuauuuauggccaagugcuuuacaccgacaagacauaugcuauggggcaccugauccagagaaagaagguucauguguucggagaugagcucucucuggucacccuuuuucgguguauccagaacaugccugaaacacugcccaauaacuccugcuacagcgccggcauugcuaaacucgaggaaggggacgagcugcagcuggccaucccucgcgaaaaugcccaaauuucccucgauggagacgugaccuucuuuggcgcucugaaacuucuguga

SEQ ID NO: 3880 - RNA, 858 nt, Artificial Sequence
  derived and/or modified sequence opt6 from BAFF__Homo_sapiens__AAD21092
auggacgacucaacagaaagagaacaaucaagacuaacaagcugccuaaaaaaaagagaagaaaugaaacuaaaagaaugcguaagcauacuaccaagaaaagaaucucccucaguaagaucaucaaaagacggaaaacuacuagcagcaacacuacuccuagcacuccuaucaugcugccuaacuguaguaucauucuaccaaguagcagcacuacaaggagaccuagcaagucuaagagcagaauuacaaggacaccacgcugaaaaacucccagcaggagccggagcaccaaaagcagguuuagaagaagcaccagcaguaaccgcaggacuaaaaauauucgaaccaccagcaccaggagaaggaaacuccucacaaaacuccagaaauaaaagagcaguacaaggaccagaagaaacaguaacacaagacugccuacaauuaauagcagacucagaaacaccaaccauacaaaaaggaaguuauacauuuguaccaugguuauuaucauucaaaagaggaagcgcauuagaagaaaaagaaaacaaaauacuaguaaaagaaaccggauacuucuuuauauacggccaaguacuauacacagacaaaacauaugcaaugggacacuuaauacaaagaaaaaaaguacauguauucggcgacgaacuauccuuaguaacacuauucagaugcauacaaaauaugccagaaacacuaccaaacaacucauguuacucagcaggaauagccaaacuagaagaaggugacgaacuacaauuagcaauaccaagagaaaacgcacaaauaucauuagacggcgacguaacuuucuuuggagcauuaaaacuauuauaa

SEQ ID NO: 3881 - protein, 193 aa, Artificial Sequence
  CD27L__Homo_sapiens__P32970
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 3882 - RNA, 582 nt, Artificial Sequence
  CD27L__Homo_sapiens__AAB30121
augccggaggaggguucgggcugcucggugcggcgcaggcccuaugggugcguccugcgggcugcuuuggucccauuggucgcgggcuuggugaucugccucguggugugcauccagcgcuucgcacaggcucagcagcagcugccgcucgagucacuugggugggacguagcugagcugcagcugaaucacacaggaccucagcaggaccccaggcuauacuggcaggggggcccagcacugggccgcuccuuccugcauggaccagagcuggacaaggggcagcuacguauccaucgugauggcaucuacaugguacacauccaggugacgcuggccaucugcuccuccacgacggccuccaggcaccaccccaccacccuggccgugggaaucugcucucccgccucccguagcaucagccugcugcgucucagcuuccaccaagguuguaccauugccucccagcgccugacgccccuggcccgaggggacacacucugcaccaaccucacugggacacuuuugccuucccgaaacacugaugagaccuucuuuggagugcagugggugcgccccuga

SEQ ID NO: 3883 - RNA, 582 nt, Artificial Sequence
  derived and/or modified sequence opt1 from CD27L__Homo_sapiens__AAB30121
augcccgaggagggcagcgggugcuccgugcgccggcgcccguacggcugcguccugcgggccgcccucgugccccugguggcggggcuggucaucugccucguggugugcauccagcgcuucgcccaggcccagcagcagcugccccuggagagccucggcugggacgucgccgagcugcagcugaaccacaccgggccccagcaggacccgcggcucuacuggcagggcggccccgcccuggggcgcuccuuccugcacggccccgagcucgacaaggggcagcugcggauccaccgcgacggcaucuacauggugcacauccaggugacccuggcgaucugcagcuccacgaccgccagccggcaccaccccaccacccucgccgucgggaucugcuccccggccagccgcuccaucagccugcugcggcucuccuuccaccagggcugcacgaucgcgagccagcgccugacgccccuggcccggggcgacacccucugcaccaaccugaccgggacccugcuccccucccgcaacaccgacgagaccuucuucggcgugcagugggugcggcccuga

SEQ ID NO: 3884 - RNA, 582 nt, Artificial Sequence
  derived and/or modified sequence opt2 from CD27L__Homo_sapiens__AAB30121
augcccgaggagggcuccggcugcuccguccgccgccgccccuacggcugcguccuccgcgccgcccucgucccccucgucgccggccucgucaucugccucgucgucugcauccagcgcuucgcccaggcccagcagcagcucccccucgagucccucggcugggacgucgccgagcuccagcucaaccacaccggcccccagcaggacccccgccucuacuggcagggcggccccgcccucggccgcuccuuccuccacggccccgagcucgacaagggccagcuccgcauccaccgcgacggcaucuacaugguccacauccaggucacccucgccaucugcuccuccaccaccgccucccgccaccaccccaccacccucgccgucggcaucugcucccccgccucccgcuccaucucccuccuccgccucuccuuccaccagggcugcaccaucgccucccagcgccucaccccccucgcccgcggcgacacccucugcaccaaccucaccggcacccuccuccccucccgcaacaccgacgagaccuucuucggcguccaguggguccgccccuga

SEQ ID NO: 3885 - RNA, 582 nt, Artificial Sequence
  derived and/or modified sequence opt3 from CD27L__Homo_sapiens__AAB30121
augcccgaggaaggcagcgggugcuccgugagaaggcggccuuacggauguguccugcgcgccgcucucguuccacuuguggcaggucugguaaucugcuugguggucuguauucagcgauucgcccaagcgcagcagcaguuaccgcuggagucucuaggcugggacguggcugaacuccaacugaaccacaccgggccccagcaggauccucgucuuuauuggcagggaggcccagcccuggguagaucauuuuugcaugggcccgagcucgacaagggacaacugaggauacaccgggauggcaucuacaugguucauauucaggugacacuggcaaucugcaguagcacuacggccucccgccaccauccuaccacacucgcugucggcauuuguucuccagcaucgagaucaaucagcuuacugaggcuuaguuuccaccaggggugcacuauagccucccagcgguugacaccccuggcucgcggagacacccuauguaccaaucucacugguacacugcuuccuucucgaaacaccgaugaaacguuuuucggcgugcaauggguaagaccauga

SEQ ID NO: 3886 - RNA, 582 nt, Artificial Sequence
  derived and/or modified sequence opt4 from CD27L__Homo_sapiens__AAB30121
augcccgaggagggcagcggcugcagcgugagaagaagacccuacggcugcgugcugagagccgcccuggugccccugguggccggccuggugaucugccugguggugugcauccagagauucgcccaggcccagcagcagcugccccuggagagccugggcugggacguggccgagcugcagcugaaccacaccggcccccagcaggaccccagacuguacuggcagggcggccccgcccugggcagaagcuuccugcacggccccgagcuggacaagggccagcugagaauccacagagacggcaucuacauggugcacauccaggugacccuggccaucugcagcagcaccaccgccagcagacaccaccccaccacccuggccgugggcaucugcagccccgccagcagaagcaucagccugcugagacugagcuuccaccagggcugcaccaucgccagccagagacugaccccccuggccagaggcgacacccugugcaccaaccugaccggcacccugcugcccagcagaaacaccgacgagaccuucuucggcgugcagugggugagacccuga

SEQ ID NO: 3887 - RNA, 582 nt, Artificial Sequence
  derived and/or modified sequence opt5 from CD27L__Homo_sapiens__AAB30121
augcccgaggaaggcagcgggugcuccgugagacggcgcccuuacggauguguccugagagccgcucucguuccgcugguggccggccuugugaucugccuggucguguguauucagcgguucgcgcaagcucagcagcagcucccccuggagucucuugggugggacguugccgaacugcaacucaaccacaccggaccucagcaggauccccgccuguauuggcagggcgggccugcccugggacggagcuuucuccauggccccgagcuggacaagggccaacuucggauccaccgcgaugggauuuacauggugcauauccaggucacacuggcuauuugcuccucuacgaccgccagcagacaccauccuacaacccucgcugugggaaucuguuccccggccucucggagcaucucccugcuucgccugagcuuccaccagggcugcacaauugcgucucagagacucacaccccuggccagaggggacacccuguguaccaaucucacgggaacccugcuuccuucccgcaacacagaugaaaccuuuuucggcguucaaugggugagacccuga

SEQ ID NO: 3888 - RNA, 582 nt, Artificial Sequence
  derived and/or modified sequence opt6 from CD27L__Homo_sapiens__AAB30121
augccagaagaaggcucaggauguucaguacgaagaagaccauacggaugcguacuaagagcagcacuaguaccauuaguagcaggacuaguaauaugcuuaguaguaugcauacaaagauucgcacaagcacaacaacaauuaccacuagaaucacuaggaugggacguagcagaacuacaauuaaaccauacaggaccccaacaagacccaagacuauacuggcaaggaggaccagcauuaggacgaucauucuuacacggaccugaacuagacaaaggacaauuaagaauacacagagacggaauauacaugguacacauacaaguaacacuagcaauauguuccagcacaacagcaaguagacaucauccaacaacacuagcaguaggcauaugcucaccagcaucaagauccauaaguuuacuaagacuaucauuccaucaaggauguacaauagccagccaacgauuaacaccacuagcaagaggagacacauuauguacaaauuuaacaggaacauuacuaccaucaagaaauacagacgaaacauuuuucggaguacaauggguaagaccauaa

SEQ ID NO: 3889 - protein, 234 aa, Artificial Sequence
  CD30L__Homo_sapiens__P32971
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 3890 - RNA, 705 nt, Artificial Sequence
  CD30L__Homo_sapiens__AAA74594
auggacccagggcugcagcaagcacucaacggaauggccccuccuggagacacagccaugcaugugccggcgggcuccguggccagccaccuggggaccacgagccgcagcuauuucuauuugaccacagccacucuggcucugugccuugucuucacgguggccacuauuaugguguuggucguucagaggacggacuccauucccaacucaccugacaacgucccccucaaaggaggaaauugcucagaagaccucuuauguauccugaaaagagcuccauucaagaagucaugggccuaccuccaaguggcaaagcaucuaaacaaaaccaaguugucuuggaacaaagauggcauucuccauggagucagauaucaggaugggaaucuggugauccaauucccugguuuguacuucaucauuugccaacugcaguuucuuguacaaugcccaaauaauucugucgaucugaaguuggagcuucucaucaacaagcauaucaaaaaacaggcccuggugacagugugugagucuggaaugcaaacgaaacacguauaccagaaucucucucaauucuugcuggauuaccugcaggucaacaccaccauaucagucaauguggauacauuccaguacauagauacaagcaccuuuccucuugagaauguguuguccaucuucuuauacaguaauucagacuga

SEQ ID NO: 3891 - RNA, 705 nt, Artificial Sequence
  derived and/or modified sequence opt1 from CD30L__Homo_sapiens__AAA74594
auggaccccggccugcagcaggcccucaacgggauggccccgcccggcgacaccgcgaugcacgugcccgccgggagcgucgccucccaccugggcaccacgagccgcuccuacuucuaccugaccaccgccacccucgcccugugccugguguucacgguggcgaccaucaugguccucguggugcagcggaccgacagcauccccaacuccccggacaacgucccccugaagggcgggaacugcagcgaggaccugcucugcauccugaagcgcgcccccuucaagaaguccugggccuaccuccagguggccaagcaccugaacaagaccaagcugagcuggaacaaggacggcauccugcacggggugcgguaccaggacggcaaccucgucauccaguuccccgggcuguacuucaucaucugccagcugcaguuccucgugcagugcccgaacaacuccguggaccugaagcuggagcuccugaucaacaagcacaucaagaagcaggcgcuggucacggugugcgagagcggcaugcagaccaagcacguguaccagaaccucucccaguuccugcuggacuaccuccaggucaacaccaccaucagcgugaacguggacacguuccaguacaucgacaccuccaccuucccccuggagaacguccugagcaucuuccucuacuccaacagcgacuga

SEQ ID NO: 3892 - RNA, 705 nt, Artificial Sequence
  derived and/or modified sequence opt2 from CD30L__Homo_sapiens__AAA74594
auggaccccggccuccagcaggcccucaacggcauggccccccccggcgacaccgccaugcacguccccgccggcuccgucgccucccaccucggcaccaccucccgcuccuacuucuaccucaccaccgccacccucgcccucugccucgucuucaccgucgccaccaucaugguccucgucguccagcgcaccgacuccauccccaacucccccgacaacgucccccucaagggcggcaacugcuccgaggaccuccucugcauccucaagcgcgcccccuucaagaaguccugggccuaccuccaggucgccaagcaccucaacaagaccaagcucuccuggaacaaggacggcauccuccacggcguccgcuaccaggacggcaaccucgucauccaguuccccggccucuacuucaucaucugccagcuccaguuccucguccagugccccaacaacuccgucgaccucaagcucgagcuccucaucaacaagcacaucaagaagcaggcccucgucaccgucugcgaguccggcaugcagaccaagcacgucuaccagaaccucucccaguuccuccucgacuaccuccaggucaacaccaccaucuccgucaacgucgacaccuuccaguacaucgacaccuccaccuucccccucgagaacguccucuccaucuuccucuacuccaacuccgacuga

SEQ ID NO: 3893 - RNA, 705 nt, Artificial Sequence
  derived and/or modified sequence opt3 from CD30L__Homo_sapiens__AAA74594
auggaccccggccugcagcaagcccucaacgggauggcuccuccaggagauaccgcaaugcacgugccggccgguagcgucgcgucccaucuuggcacaacuucuagaucauacuucuaucugacgaccgcuacauuggccuuaugccugguuuuuacuguggcaaccaucauggugcuaguaguccagaggacagacaguauucccaauagcccugauaacgugccacucaaagggggaaauuguuccgaggaccugcuuugcauacugaaacgggcccccuucaagaaaucuugggcuuacuugcagguugcaaagcaccucaacaaaaccaagcugucguggaauaaggauggcauccugcauggugugcgcuaucaggacgggaaccucgucauucaauuuccuggauuauacuucaucauuugucagcugcaguuucuugugcagugcccaaauaacucaguagauuugaaacuggaacuacucaucaauaagcacauaaagaagcaagcccugguuacugugugugagagcggcaugcagacaaaacaugucuaucagaaccuuagucaguuccuguuggacuaccuccaagugaauaccacgaucuccgugaacgucgauacuuuucaguauauugacaccucuacauucccccuggaaaauguuuuaagcaucuuucuguacuccaacucagauuga

SEQ ID NO: 3894 - RNA, 705 nt, Artificial Sequence
  derived and/or modified sequence opt4 from CD30L__Homo_sapiens__AAA74594
auggaccccggccugcagcaggcccugaacggcauggccccccccggcgacaccgccaugcacgugcccgccggcagcguggccagccaccugggcaccaccagcagaagcuacuucuaccugaccaccgccacccuggcccugugccugguguucaccguggccaccaucauggugcugguggugcagagaaccgacagcauccccaacagccccgacaacgugccccugaagggcggcaacugcagcgaggaccugcugugcauccugaagagagcccccuucaagaagagcugggccuaccugcagguggccaagcaccugaacaagaccaagcugagcuggaacaaggacggcauccugcacggcgugagauaccaggacggcaaccuggugauccaguuccccggccuguacuucaucaucugccagcugcaguuccuggugcagugccccaacaacagcguggaccugaagcuggagcugcugaucaacaagcacaucaagaagcaggcccuggugaccgugugcgagagcggcaugcagaccaagcacguguaccagaaccugagccaguuccugcuggacuaccugcaggugaacaccaccaucagcgugaacguggacaccuuccaguacaucgacaccagcaccuucccccuggagaacgugcugagcaucuuccuguacagcaacagcgacuga

SEQ ID NO: 3895 - RNA, 705 nt, Artificial Sequence
  derived and/or modified sequence opt5 from CD30L__Homo_sapiens__AAA74594
auggaccccggccugcagcaagcccucaacgggauggcuccuccgggagauaccgccaugcacgugcccgcgggcagcgucgcuucccaucuggggacaacgucuagaagcuacuucuaucuuaccacagccacccuggcccucugccugguuuuuacaguggcuaccaucauggugcuugucgugcagcggacagacuccauuccuaauucucccgauaacguuccucugaagggaggcaauuguagcgaggaccuccugugcauccugaaacgcgcccccuucaagaaauccugggcuuaccuccagguggccaagcaccugaacaaaaccaaacuuucuuggaauaaggaugggauucugcauggagucagauaucaggacggcaaccucgugauccaauuuccuggccuguacuucauuaucugucagcuucaguuucugguucagugcccgaauaacagcguggaucucaagcuggaacugcucaucaauaagcacauuaaaaagcaagcgcuggucacggugugugaguccgggaugcagaccaaacauguguaucagaaccuuagccaguuccugcucgacuaccugcaagucaauacaaccaucucuguuaacguggauacauuucaguauauugacaccuccacguucccccuugaaaaugugcugagcaucuuucucuacucuaacuccgauuga

SEQ ID NO: 3896 - RNA, 705 nt, Artificial Sequence
  derived and/or modified sequence opt6 from CD30L__Homo_sapiens__AAA74594
auggaccccggacuccaacaagcacuaaacggaauggcaccaccaggagacacagcaaugcacguaccagcaggaucagucgcaucacacuuaggaacaacaucuagaucauacuucuaccucacaaccgcaacauuagcacuaugccuaguauucacaguagcaaccauaaugguacuaguaguacaaagaacagacuccauacccaacuccccagauaacgucccauuaaaaggaggaaacugcucagaagaccuccucugcauauuaaaaagagcaccauucaaaaaaucaugggcauaccuacaaguagcaaaacacuuaaacaaaaccaaacuaucauggaacaaagacggaauacuacacggaguaagauaccaagacggaaacuuaguaauacaauucccaggacuauacuucauaauaugucaacuacaauuccuaguacaaugcccaaacaauucaguagaccuaaaauuagaacuacuaaucaacaaacacauaaaaaaacaagcacuaguaaccguaugcgaaucaggaaugcaaaccaaacacguauaccaaaaccuaucacaauuccuucucgacuaccuacaaguaaacacaacaauaucaguaaacguagacacauuccaauacauagacacaucuacauucccacuagaaaacguacuaucaaucuuccucuacuccaacucagacuaa

SEQ ID NO: 3897 - protein, 261 aa, Artificial Sequence
  CD40L_(CD154)__Homo_sapiens__P29965
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 3898 - RNA, 786 nt, Artificial Sequence
  CD40L_(CD154)__Homo_sapiens__AAA35662
augaucgaaacauacaaccaaacuucuccccgaucugcggccacuggacugcccaucagcaugaaaauuuuuauguauuuacuuacuguuuuucuuaucacccagaugauugggucagcacuuuuugcuguguaucuucauagaagguuggacaagauagaagaugaaaggaaucuucaugaagauuuuguauucaugaaaacgauacagagaugcaacacaggagaaagauccuuauccuuacugaacugugaggagauuaaaagccaguuugaaggcuuugugaaggauauaauguuaaacaaagaggagacgaagaaagaaaacagcuuugaaaugcaaaaaggugaucagaauccucaaauugcggcacaugucauaagugaggccagcaguaaaacaacaucuguguuacagugggcugaaaaaggauacuacaccaugagcaacaacuugguaacccuggaaaaugggaaacagcugaccguuaaaagacaaggacucuauuauaucuaugcccaagucaccuucuguuccaaucgggaagcuucgagucaagcuccauuuauagccagccucugccuaaagucccccgguagauucgagagaaucuuacucagagcugcaaauacccacaguuccgccaaaccuugcgggcaacaauccauucacuugggaggaguauuugaauugcaaccaggugcuucgguguuugucaaugugacugauccaagccaagugagccauggcacuggcuucacguccuuuggcuuacucaaacucuga

SEQ ID NO: 3899 - RNA, 786 nt, Artificial Sequence
  derived and/or modified sequence opt1 from CD40L_(CD154)__Homo_sapiens__AAA35662
augaucgagaccuacaaccagaccagcccccgcuccgccgccacgggccugccgaucagcaugaagaucuucauguaccuccugaccguguuccugaucacccagaugaucggguccgcgcuguucgccgucuaccugcaccggcgccuggacaagaucgaggacgagcggaaccuccacgaggacuucguguucaugaagaccauccagcgcugcaacacgggcgagcggagccugucccugcucaacugcgaggagaucaagagccaguucgagggguucgugaaggacaucaugcugaacaaggaggagaccaagaaggagaacuccuucgagaugcagaagggcgaccagaacccccagaucgccgcccacgucaucagcgaggccuccagcaagaccaccuccgugcugcagugggcggagaagggguacuacacgaugagcaacaaccucgugacccuggagaacggcaagcagcugaccgucaagcgccagggccucuacuacaucuacgcccaggugaccuucugcuccaaccgggaggccagcucccaggcccccuucaucgcgagccugugccugaagucccccgggcgcuucgagcggauccuccugcgcgccgccaacacgcacagcuccgccaagccgugcggccagcagagcauccaccucgggggcguguucgagcuccagcccggggccagcgucuucgugaacgugaccgaccccucccaggucagccacggcaccggcuucaccuccuucgggcugcugaagcucuga

SEQ ID NO: 3900 - RNA, 786 nt, Artificial Sequence
  derived and/or modified sequence opt2 from CD40L_(CD154)__Homo_sapiens__AAA35662
augaucgagaccuacaaccagaccuccccccgcuccgccgccaccggccuccccaucuccaugaagaucuucauguaccuccucaccgucuuccucaucacccagaugaucggcuccgcccucuucgccgucuaccuccaccgccgccucgacaagaucgaggacgagcgcaaccuccacgaggacuucgucuucaugaagaccauccagcgcugcaacaccggcgagcgcucccucucccuccucaacugcgaggagaucaagucccaguucgagggcuucgucaaggacaucaugcucaacaaggaggagaccaagaaggagaacuccuucgagaugcagaagggcgaccagaacccccagaucgccgcccacgucaucuccgaggccuccuccaagaccaccuccguccuccagugggccgagaagggcuacuacaccauguccaacaaccucgucacccucgagaacggcaagcagcucaccgucaagcgccagggccucuacuacaucuacgcccaggucaccuucugcuccaaccgcgaggccuccucccaggcccccuucaucgccucccucugccucaagucccccggccgcuucgagcgcauccuccuccgcgccgccaacacccacuccuccgccaagcccugcggccagcaguccauccaccucggcggcgucuucgagcuccagcccggcgccuccgucuucgucaacgucaccgaccccucccaggucucccacggcaccggcuucaccuccuucggccuccucaagcucuga

SEQ ID NO: 3901 - RNA, 786 nt, Artificial Sequence
  derived and/or modified sequence opt3 from CD40L_(CD154)__Homo_sapiens__AAA35662
augaucgagaccuacaaccagacaagccccagauccgccgcuacuggccugccuauuucuaugaagauauucauguaucuccuuacgguguuucugaucacccaaaugauugggucagcauuguucgccgucuacuuacacaggcggcuggacaaaaucgaagaugagcgcaaucuacaugaagacuuuguuuucaugaagacaauucagcgaugcaacacuggagagcguagucucagccugcuuaauugugaagagaucaaaucccaguuugaggguuucgugaaggauauaaugcugaacaaagaagagaccaagaaggaaaauucuuuugagaugcagaaaggcgaccaaaacccacagaucgcggcucacguaauuucggaggccucaagcaagacaaccaguguguugcagugggcagaaaaaggguauuacacuauguccaauaaccucgucacacuggagaauggaaagcagcugaccgugaaaagacaaggccucuauuacaucuaugcccagguuacguucugcucuaacagggaagcuagcucccaggcaccguuuauugccucauuaugucugaagagucccggucgguucgagcgcauccuuuugagagcugccaauacucauagcucugcgaagccuugcgggcagcaauccauacaccugggaggcguguuugaacuacagccaggcgcaucagucuucgugaacguaaccgaucccagccagguuagucaugggacaggauuuacuucuuucggucuccugaaacuuuga

SEQ ID NO: 3902 - RNA, 786 nt, Artificial Sequence
  derived and/or modified sequence opt4 from CD40L_(CD154)__Homo_sapiens__AAA35662
augaucgagaccuacaaccagaccagccccagaagcgccgccaccggccugcccaucagcaugaagaucuucauguaccugcugaccguguuccugaucacccagaugaucggcagcgcccuguucgccguguaccugcacagaagacuggacaagaucgaggacgagagaaaccugcacgaggacuucguguucaugaagaccauccagagaugcaacaccggcgagagaagccugagccugcugaacugcgaggagaucaagagccaguucgagggcuucgugaaggacaucaugcugaacaaggaggagaccaagaaggagaacagcuucgagaugcagaagggcgaccagaacccccagaucgccgcccacgugaucagcgaggccagcagcaagaccaccagcgugcugcagugggccgagaagggcuacuacaccaugagcaacaaccuggugacccuggagaacggcaagcagcugaccgugaagagacagggccuguacuacaucuacgcccaggugaccuucugcagcaacagagaggccagcagccaggcccccuucaucgccagccugugccugaagagccccggcagauucgagagaauccugcugagagccgccaacacccacagcagcgccaagcccugcggccagcagagcauccaccugggcggcguguucgagcugcagcccggcgccagcguguucgugaacgugaccgaccccagccaggugagccacggcaccggcuucaccagcuucggccugcugaagcuguga

SEQ ID NO: 3903 - RNA, 786 nt, Artificial Sequence
  derived and/or modified sequence opt5 from CD40L_(CD154)__Homo_sapiens__AAA35662
augaucgagaccuacaaccagacaagccccagauccgccgcuacgggccugccuauuucuaugaagaucuucauguaucuccugaccguguuucuuauuacacaaaugaucgggagcgcccuguucgcggucuaccuccaccggcgccuggacaaaauugaagaugagagaaaucuucaugaagacuuuguuuucaugaagaccauccagcggugcaacacaggagagcgcucccugucucuccugaauugugaagagaucaaaagccaguuugagggcuucgugaaggauauuaugcugaacaaagaagagaccaagaaggaaaauuccuuugagaugcagaaaggggaccaaaacccgcagaucgcugcccacgugauuucugaggccagcuccaagacaaccagcguccuccagugggcugaaaaaggauauuacacgaugucuaauaaccuggugacccuugagaauggcaagcagcugacaguuaaaagacaagggcucuauuacaucuaugcccaggugaccuucugcuccaaccgggaagcuagcucucaggcccccuuuauugcgucccugugucuuaagagcccuggacgcuucgagagaauccugcuccgggccgcuaauacacauucuuccgccaagcccugcggccagcaaagcauucaccugggcggggucuuugaacugcagccuggagcuuccguguucguuaacgugaccgaucccucucaggucagccauggcacgggguuuacauccuucggacuccugaaacuuuga

SEQ ID NO: 3904 - RNA, 786 nt, Artificial Sequence
  derived and/or modified sequence opt6 from CD40L_(CD154)__Homo_sapiens__AAA35662
augauagaaacauauaaucaaacaagcccaagaucagcagcaacaggacuaccaauaucaaugaaaauauucauguaccuacucacagucuuccuaauaacacaaaugauaggaucugcccuauuugcaguauaccuacacagaagacuagauaaaauagaagacgaaagaaaccuacaugaagacuucguauucaugaaaacaauacaaagaugcaacaccggagaaagaucccuaucacuacuaaacugcgaagaaauaaaaucacaauucgaaggauucguaaaagacauaaugcuaaacaaagaagaaacaaaaaaagaaaacucuuucgaaaugcaaaaaggagaccaaaacccacaaauagcugcacacgucauaucagaagcaucaucaaaaacaacaucaguacuucaaugggcagaaaaaggauacuauacaaugucaaacaaucuaguaacccuagaaaacggaaaacaacuaacaguaaaaagacaaggacuauacuauauauacgcacaaguaacauucugcucaaacagagaagcaucaucacaagcaccauucaucgcaucacuaugccuaaaauccccaggaagauucgaacgaauccuacuaagagcagcaaacacacacucaucagcaaaaccaugcggccaacaaucaauacaccuaggaggaguauucgaacuacaaccaggagcaucaguauucguaaacguaacagaccccucacaaguaagccacggcacaggauucacaucauuuggacuauuaaaauuauaa

SEQ ID NO: 3905 - protein, 197 aa, Artificial Sequence
  EL-17C__Homo_sapiens__Q9P0M4
MTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 3906 - RNA, 594 nt, Artificial Sequence
  EL-17C__Homo_sapiens__AAF28105
augacgcuccuccccggccuccuguuucugaccuggcugcacacaugccuggcccaccaugaccccucccucagggggcacccccacagucacgguaccccacacugcuacucggcugaggaacugccccucggccaggcccccccacaccugcuggcucgaggugccaagugggggcaggcuuugccuguagcccugguguccagccuggaggcagcaagccacagggggaggcacgagaggcccucagcuacgacccagugcccggugcugcggccggaggagguguuggaggcagacacccaccagcgcuccaucucacccuggagauaccguguggacacggaugaggaccgcuauccacagaagcuggccuucgccgagugccugugcagaggcuguaucgaugcacggacgggccgcgagacagcugcgcucaacuccgugcggcugcuccagagccugcuggugcugcgccgccggcccugcucccgcgacggcucggggcuccccacaccuggggccuuugccuuccacaccgaguucauccacguccccgucggcugcaccugcgugcugccccguucaguguga

SEQ ID NO: 3907 - RNA, 594 nt, Artificial Sequence
  derived and/or modified sequence opt1 from EL-17C__Homo_sapiens__AAF28105
augacccugcuccccggccugcuguuccucaccuggcugcacacgugccuggcccaccacgacccgagccuccgcgggcacccccacucccacggcacgccccacugcuacagcgccgaggagcugccccuggggcaggcgccgccccaccuccuggcccggggcgccaagugggggcaggcccugcccguggcccucgucuccagccuggaggcggccucccaccgcggccggcacgagcgccccagcgccaccacccagugcccggugcugcggcccgaggaggugcucgaggccgacacccaccagcgcuccaucagccccuggcgguaccgcgucgacaccgacgaggaccgguacccccagaagcuggcguucgccgagugccugugccgcggcugcaucgacgcccggaccgggcgcgagaccgccgcccucaacuccgugcggcugcugcagagccuccuggugcugcgccggcgcccgugcucccgggacggcagcgggcuccccacccccggcgcguucgccuuccacaccgaguucauccacguccccguggggugcacgugcgugcugccgcgcuccgucuga

SEQ ID NO: 3908 - RNA, 594 nt, Artificial Sequence
  derived and/or modified sequence opt2 from EL-17C__Homo_sapiens__AAF28105
augacccuccuccccggccuccucuuccucaccuggcuccacaccugccucgcccaccacgaccccucccuccgcggccacccccacucccacggcaccccccacugcuacuccgccgaggagcucccccucggccaggcccccccccaccuccucgcccgcggcgccaaguggggccaggcccuccccgucgcccucgucuccucccucgaggccgccucccaccgcggccgccacgagcgccccuccgccaccacccagugccccguccuccgccccgaggagguccucgaggccgacacccaccagcgcuccaucucccccuggcgcuaccgcgucgacaccgacgaggaccgcuacccccagaagcucgccuucgccgagugccucugccgcggcugcaucgacgcccgcaccggccgcgagaccgccgcccucaacuccguccgccuccuccagucccuccucguccuccgccgccgccccugcucccgcgacggcuccggccuccccacccccggcgccuucgccuuccacaccgaguucauccacguccccgucggcugcaccugcguccucccccgcuccgucuga

SEQ ID NO: 3909 - RNA, 594 nt, Artificial Sequence
  derived and/or modified sequence opt3 from EL-17C__Homo_sapiens__AAF28105
augacccugcuccccggccuucuguucuugacaugguuacacacuugccuggcccaucacgacccuagccuaagagggcauccacacucccauggaacgccgcacuguuacucugcugaagaacucccccugggucaggcaccuccacaccuucuggccaggggcgcgaagugggggcaggcuuugcccguggcccucgucucaagucuggaggcagccagccaucggggacgccacgaacgaccuuccgcuaccacacaaugcccaguucugcgucccgaggaagugcucgaggcagauacucaucagagaucuaucucgccuuggagguaucggguagacaccgaugaggaccgcuacccacagaaauuagccuuugcugaaugucugugcagaggcuguauugaugccaggacaggucgggagaccgcggcacuuaacucagugcgcuugcugcaaagccuacucguccugcgaagaaggccgugcagucgggacggguccggacuucccacuccuggcgccuucgcuuuucacacagaguucauacacgugccaguuggcuguaccugcgugcugccccguucugucuga

SEQ ID NO: 3910 - RNA, 594 nt, Artificial Sequence
  derived and/or modified sequence opt4 from EL-17C__Homo_sapiens__AAF28105
augacccugcugcccggccugcuguuccugaccuggcugcacaccugccuggcccaccacgaccccagccugagaggccacccccacagccacggcaccccccacugcuacagcgccgaggagcugccccugggccaggcccccccccaccugcuggccagaggcgccaaguggggccaggcccugcccguggcccuggugagcagccuggaggccgccagccacagaggcagacacgagagacccagcgccaccacccagugccccgugcugagacccgaggaggugcuggaggccgacacccaccagagaagcaucagccccuggagauacagaguggacaccgacgaggacagauacccccagaagcuggccuucgccgagugccugugcagaggcugcaucgacgccagaaccggcagagagaccgccgcccugaacagcgugagacugcugcagagccugcuggugcugagaagaagacccugcagcagagacggcagcggccugcccacccccggcgccuucgccuuccacaccgaguucauccacgugcccgugggcugcaccugcgugcugcccagaagcguguga

SEQ ID NO: 3911 - RNA, 594 nt, Artificial Sequence
  derived and/or modified sequence opt5 from EL-17C__Homo_sapiens__AAF28105
augacccugcuccccggccugcuuuuccugacauggcuccacacgugccuggcccaucacgacccuagccuuagagggcauccgcacucccauggaacaccccacuguuacucugcugaagaacugccucucggccaggcgcccccucaucugcuggcccgcggggcuaaguggggacaagcccuccccguggcccuggucagcucccuugaggcugccucucaccggggcagacacgaacggccuagcgcuaccacccagugcccgguucugcgccccgaggaagugcucgaggccgauacacaucagagauccaucucuccuuggcgguaucgcguggacaccgaugaggacagauacccccagaaacuggcguuugccgaaugucuuugccggggguguauugaugcucgcacaggaagagagaccgccgcucugaacagcguccggcuccugcaaucccugcucgugcugcgcagacggccuugcagccgcgacggcucuggccuucccacgccgggggccuucgcguuucacaccgaguucauccacguuccugugggauguacaugcguccugcccagauccguguga

SEQ ID NO: 3912 - RNA, 594 nt, Artificial Sequence
  derived and/or modified sequence opt6 from EL-17C__Homo_sapiens__AAF28105
augacauuauuaccaggacuauuauuuuuaacaugguuacauacaugucuagcucaucacgauccaucacuaagaggacauccacauucacacggaacaccucacuguuauucagcagaagaauuaccauuaggacaagcaccaccacauuuacuagcaagaggagcaaaauggggacaagcauuaccaguagcauuaguaagcucacuagaagcagcaucacauagaggaagacaugaaagaccaucagcaacaacacaauguccagucuuaagaccagaagaagucuuagaagcagauacacaucaaagaucaauaucaccauggcgauaccgaguagauacagaugaagauagauauccacaaaaacuagcauuugcagaauguuuauguagaggauguauagaugcaagaacaggaagagaaacagcagcauuaaauuccguaagauuacuacaaaguuuacuaguauuaagaagaagaccauguucaagagacggaucaggacuaccaacuccaggagcauucgccuuucauacagaauuuauacacguaccaguaggauguacuuguguauuaccaagaucaguauaa

SEQ ID NO: 3913 - protein, 178 aa, Artificial Sequence
  FLT3_ligand__Homo_sapiens__AAA90950.1
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPVETVFHRVSQDGLDLLTS

SEQ ID NO: 3914 - RNA, 537 nt, Artificial Sequence
  FLT3_ligand__Homo_sapiens__U29874.1
augacagugcuggcgccagccuggagcccaacaaccuaucuccuccugcugcugcugcugagcucgggacucagugggacccaggacugcuccuuccaacacagccccaucuccuccgacuucgcugucaaaauccgugagcugucugacuaccugcuucaagauuacccagucaccguggccuccaaccugcaggacgaggagcucugcgggggccucuggcggcugguccuggcacagcgcuggauggagcggcucaagacugucgcuggguccaagaugcaaggcuugcuggagcgcgugaacacggagauacacuuugucaccaaaugugccuuucagcccccccccagcugucuucgcuucguccagaccaacaucucccgccuccugcaggagaccuccgagcagcugguggcgcugaagcccuggaucacucgccagaacuucucccggugccuggagcugcagugucagcccguagagacgguguuucaccgugucagccaggauggucucgaucuccugaccucguga

SEQ ID NO: 3915 - RNA, 537 nt, Artificial Sequence
  derived and/or modified sequence opt1 from FLT3_ligand__Homo_sapiens__U29874.1
augaccgugcuggcccccgccuggagcccgaccacguaccuccugcugcuccugcugcucuccagcggccuguccgggacccaggacugcagcuuccagcacucccccaucagcuccgacuucgcggucaagauccgcgagcugagcgacuaccuccugcaggacuaccccgugaccguggccuccaaccugcaggacgaggagcucugcggcgggcuguggcggcugguccucgcccagcgcuggauggagcggcugaagaccguggccggcagcaagaugcaggggcugcucgagcgcgugaacacggagauccacuucgucaccaagugcgccuuccagcccccgcccuccugccugcgguucgugcagaccaacaucagccgccugcuccaggagaccuccgagcagcugguggcgcugaagcccuggaucacgcggcagaacuucagccgcugccucgagcugcagugccagcccgucgagaccguguuccaccgggugucccaggacggccuggaccuccugaccagcuga

SEQ ID NO: 3916 - RNA, 537 nt, Artificial Sequence
  derived and/or modified sequence opt2 from FLT3_ligand__Homo_sapiens__U29874.1
augaccguccucgcccccgccuggucccccaccaccuaccuccuccuccuccuccuccucuccuccggccucuccggcacccaggacugcuccuuccagcacucccccaucuccuccgacuucgccgucaagauccgcgagcucuccgacuaccuccuccaggacuaccccgucaccgucgccuccaaccuccaggacgaggagcucugcggcggccucuggcgccucguccucgcccagcgcuggauggagcgccucaagaccgucgccggcuccaagaugcagggccuccucgagcgcgucaacaccgagauccacuucgucaccaagugcgccuuccagcccccccccuccugccuccgcuucguccagaccaacaucucccgccuccuccaggagaccuccgagcagcucgucgcccucaagcccuggaucacccgccagaacuucucccgcugccucgagcuccagugccagcccgucgagaccgucuuccaccgcgucucccaggacggccucgaccuccucaccuccuga

SEQ ID NO: 3917 - RNA, 537 nt, Artificial Sequence
  derived and/or modified sequence opt3 from FLT3_ligand__Homo_sapiens__U29874.1
augaccgugcuggcccccgcuuggagcccuacaacuuaccuccuucuguuguuacugcuauccucuggccucucagggacgcaggacugcaguuuccaacacagcccaaucuccucugauuuugcagucaagauuagagagcugucggacuaucuucugcaggauuacccgguuaccguggccucaaacuugcaggacgaggaacucuguggaggucuguggaggcugguacucgcgcagcgguggauggaacgcuuaaaaacaguggcuggcagcaagaugcaagggcugcuugagcgagucaauacugaaauacauuucgugaccaaaugcgccuuucagcccccuccaaguuguuugcguuucguucagacaaacaucuccagacugcuacaggagaccucugagcaacucguggcacugaagcccuggauuacuaggcagaauuuuagccggugccuugaacugcagugucagccugucgagacaguguuccaccgcguaucccaagauggauuggaccuccugaccucauga

SEQ ID NO: 3918 - RNA, 537 nt, Artificial Sequence
  derived and/or modified sequence opt4 from FLT3_ligand__Homo_sapiens__U29874.1
augaccgugcuggcccccgccuggagccccaccaccuaccugcugcugcugcugcugcugagcagcggccugagcggcacccaggacugcagcuuccagcacagccccaucagcagcgacuucgccgugaagaucagagagcugagcgacuaccugcugcaggacuaccccgugaccguggccagcaaccugcaggacgaggagcugugcggcggccuguggagacuggugcuggcccagagauggauggagagacugaagaccguggccggcagcaagaugcagggccugcuggagagagugaacaccgagauccacuucgugaccaagugcgccuuccagcccccccccagcugccugagauucgugcagaccaacaucagcagacugcugcaggagaccagcgagcagcugguggcccugaagcccuggaucaccagacagaacuucagcagaugccuggagcugcagugccagcccguggagaccguguuccacagagugagccaggacggccuggaccugcugaccagcuga

SEQ ID NO: 3919 - RNA, 537 nt, Artificial Sequence
  derived and/or modified sequence opt5 from FLT3_ligand__Homo_sapiens__U29874.1
augaccgugcuggcccccgcuuggagcccuacaacguaccuccugcuucugcuccugcuuuccucuggccugagcgggacccaggacugcuccuuccaacacucuccgaucagcuccgauuuugccgucaagauuagagagcucucugacuaucugcugcaggauuaccccguuacaguggcgagcaaccuccaggacgaggaacuguguggaggccuuuggcggcuggugcucgcucagcgcuggauggaaagacugaaaaccgucgccggguccaagaugcaaggacuucuggagcgggugaauacagaaauccauuucguuaccaaaugcgccuuucagccucccccuagcugucuccgcuucgugcagacaaacauuucuagacugcugcaggagaccuccgagcaacucgucgcucugaagcccuggaucacgcggcagaauuuuagccgcugccuugaacugcagugucagccuguggagaccguuuuccacagagugucucaagauggccucgaccugcuuacauccuga

SEQ ID NO: 3920 - RNA, 537 nt, Artificial Sequence
  derived and/or modified sequence opt6 from FLT3_ligand__Homo_sapiens__U29874.1
augacaguacucgcaccagcauggucaccaacaacauaccuacuacuauuacuacuauuauccucaggacuaucaggaacacaagacugcucauuccaacacucaccaauauccucagacuucgcaguaaaaauacgagaacuaucagacuacuuacuacaagacuacccaguaacaguagcauccaaccuacaagacgaagaacuauguggaggacucuggagauuaguacuagcacaaagauggauggaaagacuaaaaacaguagcaggcucaaaaaugcaaggacuacuagaaagagucaacacagaaauccacuuuguaacaaaaugcgcauuucaaccacccccaucaugccuaagauucguacaaacaaacauaucaagauuacuacaagaaacaucagaacaacuaguagcauuaaaaccauggauaacaagacaaaacuucucaagaugccuagaacuccaaugccaacccguagaaacaguauuccacagaguaucacaagacggauuagaccuauuaaccucauaa

SEQ ID NO: 3921 - protein, 235 aa, Artificial Sequence
  FLT3_ligand__Homo_sapiens__P49771
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 3922 - RNA, 708 nt, Artificial Sequence
  FLT3_ligand__Homo_sapiens__CCDS12767.1
augacagugcuggcgccagccuggagcccaacaaccuaucuccuccugcugcugcugcugagcucgggacucagugggacccaggacugcuccuuccaacacagccccaucuccuccgacuucgcugucaaaauccgugagcugucugacuaccugcuucaagauuacccagucaccguggccuccaaccugcaggacgaggagcucugcgggggccucuggcggcugguccuggcacagcgcuggauggagcggcucaagacugucgcuggguccaagaugcaaggcuugcuggagcgcgugaacacggagauacacuuugucaccaaaugugccuuucagcccccccccagcugucuucgcuucguccagaccaacaucucccgccuccugcaggagaccuccgagcagcugguggcgcugaagcccuggaucacucgccagaacuucucccggugccuggagcugcagugucagcccgacuccucaacccugccacccccauggaguccccggccccuggaggccacagccccgacagccccgcagcccccucugcuccuccuacugcugcugcccgugggccuccugcugcuggccgcugccuggugccugcacuggcagaggacgcggcggaggacaccccgcccuggggagcaggugccccccguccccaguccccaggaccugcugcuuguggagcacuga

SEQ ID NO: 3923 - RNA, 708 nt, Artificial Sequence
  derived and/or modified sequence opt1 from FLT3_ligand__Homo_sapiens__CCDS12767.1
augaccgugcuggcccccgccugguccccgaccaccuaccuccugcugcuccugcugcucuccagcggccuguccgggacccaggacugcagcuuccagcacucccccaucagcuccgacuucgcggucaagauccgcgagcugagcgacuaccuccugcaggacuaccccgugaccguggccuccaaccugcaggacgaggagcucugcggcgggcuguggcggcugguccucgcccagcgcuggauggagcggcugaagaccguggccggcagcaagaugcaggggcugcucgagcgcgugaacacggagauccacuucgucaccaagugcgccuuccagcccccgcccuccugccugcgguucgugcagaccaacaucagccgccugcuccaggagaccuccgagcagcugguggcgcugaagcccuggaucacgcggcagaacuucagccgcugccucgagcugcagugccagcccgacuccagcacccugccgccgcccuggagcccccggccccucgaggccaccgcccccaccgcgccccagcccccgcugcugcuccugcugcuccugcccgucggccugcuccugcuggccgccgccuggugccuccacuggcagcgcacgcggcgccggacgccccgccccggcgagcaggucccgcccgugcccagcccccaggaccugcugcucguggagcacuga

SEQ ID NO: 3924 - RNA, 708 nt, Artificial Sequence
  derived and/or modified sequence opt2 from FLT3_ligand__Homo_sapiens__CCDS12767.1
augaccguccucgcccccgccuggucccccaccaccuaccuccuccuccuccuccuccucuccuccggccucuccggcacccaggacugcuccuuccagcacucccccaucuccuccgacuucgccgucaagauccgcgagcucuccgacuaccuccuccaggacuaccccgucaccgucgccuccaaccuccaggacgaggagcucugcggcggccucuggcgccucguccucgcccagcgcuggauggagcgccucaagaccgucgccggcuccaagaugcagggccuccucgagcgcgucaacaccgagauccacuucgucaccaagugcgccuuccagcccccccccuccugccuccgcuucguccagaccaacaucucccgccuccuccaggagaccuccgagcagcucgucgcccucaagcccuggaucacccgccagaacuucucccgcugccucgagcuccagugccagcccgacuccuccacccuccccccccccugguccccccgcccccucgaggccaccgcccccaccgccccccagcccccccuccuccuccuccuccuccuccccgucggccuccuccuccucgccgccgccuggugccuccacuggcagcgcacccgccgccgcaccccccgccccggcgagcaggucccccccguccccuccccccaggaccuccuccucgucgagcacuga

SEQ ID NO: 3925 - RNA, 708 nt, Artificial Sequence
  derived and/or modified sequence opt3 from FLT3_ligand__Homo_sapiens__CCDS12767.1
augaccgugcuggcccccgcuuggagcccuacaacuuaccuccuucuguuguuacugcuauccucuggccucucagggacgcaggacugcaguuuccaacacagcccaaucuccucugauuuugcagucaagauuagagagcugucggacuaucuucugcaggauuacccgguuaccguggccucaaacuugcaggacgaggaacucuguggaggucuguggaggcugguacucgcgcagcgguggauggaacgcuuaaaaacaguggcuggcagcaagaugcaagggcugcuugagcgagucaauacugaaauacauuucgugaccaaaugcgccuuucagcccccuccaaguuguuugcguuucguucagacaaacaucuccagacugcuacaggagaccucugagcaacucguggcacugaagcccuggauuacuaggcagaauuuuagccggugccuugaacugcagugucagccugauuccucaacauugccacccccuuggaguccacgcccgcucgaggccaccgcucccacggcaccucaaccaccccuguuacugcuccuucuguugccugucggacuacugcuccuggccgcugccuggugccuucacuggcagagaacuaggcggcgcaccccacgacccggcgaacaggugccgccuguacccagcccacaagaccuguugcucguugagcauuga

SEQ ID NO: 3926 - RNA, 708 nt, Artificial Sequence
  derived and/or modified sequence opt4 from FLT3_ligand__Homo_sapiens__CCDS12767.1
augaccgugcuggcccccgccuggagccccaccaccuaccugcugcugcugcugcugcugagcagcggccugagcggcacccaggacugcagcuuccagcacagccccaucagcagcgacuucgccgugaagaucagagagcugagcgacuaccugcugcaggacuaccccgugaccguggccagcaaccugcaggacgaggagcugugcggcggccuguggagacuggugcuggcccagagauggauggagagacugaagaccguggccggcagcaagaugcagggccugcuggagagagugaacaccgagauccacuucgugaccaagugcgccuuccagcccccccccagcugccugagauucgugcagaccaacaucagcagacugcugcaggagaccagcgagcagcugguggcccugaagcccuggaucaccagacagaacuucagcagaugccuggagcugcagugccagcccgacagcagcacccugcccccccccuggagccccagaccccuggaggccaccgcccccaccgccccccagcccccccugcugcugcugcugcugcugcccgugggccugcugcugcuggccgccgccuggugccugcacuggcagagaaccagaagaagaacccccagacccggcgagcaggugccccccgugcccagcccccaggaccugcugcugguggagcacuga

SEQ ID NO: 3927 - RNA, 708 nt, Artificial Sequence
  derived and/or modified sequence opt5 from FLT3_ligand__Homo_sapiens__CCDS12767.1
augaccgugcuggcccccgcuuggagcccuaccacguaccuccugcuucugcuccugcuuuccucuggccugagcgggacccaggacugcuccuuccaacacucuccgaucagcuccgauuuugccgucaagauuagagagcucucugacuaucugcugcaggauuaccccguuacaguggcgagcaaccuccaggacgaggaacuguguggaggccuuuggcggcuggugcucgcucagcgcuggauggaaagacugaaaaccgucgccggguccaagaugcaaggacuucuggagcgggugaauacagaaauccauuucguuaccaaaugcgccuuucagccucccccuagcugucuccgcuucgugcagacaaacauuucuagacugcugcaggagaccuccgagcaacucgucgcucugaagcccuggaucacgcggcagaauuuuagccgcugccuugaacugcagugucagccugauucuuccacccucccgcccccuuggagccccagaccucuggaggccacagcucccaccgccccgcaaccuccccuucugcuccugcugcuccugccugugggccuucugcuccuggcggccgcuuggugccuucacuggcagcggacacgcagacggacaccccgccccggggaacagguuccuccggugcccucuccucaagaccugcuccuggucgagcauuga

SEQ ID NO: 3928 - RNA, 708 nt, Artificial Sequence
  derived and/or modified sequence opt6 from FLT3_ligand__Homo_sapiens__CCDS12767.1
augaccguauuagcaccagcauggucuccaacaacauaccuacuacuacuacuauuauuaucuucaggacuaucagguacccaagacugcucauuucaacacuccccaauaucaucagacuucgcuguaaaaauaagagaauuaucagacuacuuacuacaagacuacccaguaacaguagcaucaaaccuacaagaugaagaacuaugcggaggacuauggcgacucguauuagcacaaagauggauggaaagacuaaaaacuguagcaggaucaaaaaugcaaggacuacuagaacgaguaaacacagaaauccacuucguaaccaaaugcgcauuccaaccaccaccauccugcuuaagauucguacaaacaaacauaucaagacuacuacaagaaacaucagaacaacuaguagcauuaaaaccauggauaaccagacaaaacuucuccagaugcuuagaauuacaaugccaaccagacucauccacacuaccaccacccugguccccaagaccccuagaagccacagcaccaacagcaccccaaccacccuuauuauuauuauuacuccuaccagucggacuacuacuucuagcagcugcauggugccuacauuggcaaagaaccagaagacgaacaccaagaccaggagaacaaguaccaccagucccaucaccacaagaccuauuacuaguagaacacuaa

SEQ ID NO: 3929 - protein, 207 aa, Artificial Sequence
  G-CSF__Homo_sapiens__P09919
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 3930 - RNA, 624 nt, Artificial Sequence
  G-CSF__Homo_sapiens__AAK62469
auggcuggaccugccacccagagccccaugaagcugauggcccugcagcugcugcuguggcacagugcacucuggacagugcaggaagccaccccccugggcccugccagcucccugccccagagcuuccugcucaagugcuuagagcaagugaggaagauccagggcgauggcgcagcgcuccaggagaagcuggugagugagugugccaccuacaagcugugccaccccgaggagcuggugcugcucggacacucucugggcauccccugggcuccccugagcagcugccccagccaggcccugcagcuggcaggcugcuugagccaacuccauagcggccuuuuccucuaccaggggcuccugcaggcccuggaagggaucucccccgaguugggucccaccuuggacacacugcagcuggacgucgccgacuuugccaccaccaucuggcagcagauggaagaacugggaauggccccugcccugcagcccacccagggugccaugccggccuucgccucugcuuuccagcgccgggcaggagggguccugguugccucccaucugcagagcuuccuggaggugucguaccgcguucuacgccaccuugcccagcccuga

SEQ ID NO: 3931 - RNA, 624 nt, Artificial Sequence
  derived and/or modified sequence opt1 from G-CSF__Homo_sapiens__AAK62469
auggccggccccgccacccagagcccgaugaagcugauggcgcuccagcugcugcucuggcacuccgcccuguggaccgugcaggaggccacgccccuggggcccgccagcucccucccccagagcuuccugcugaagugccucgagcagguccgcaagauccagggcgacggggccgcgcugcaggagaagcugguguccgagugcgccaccuacaagcucugccacccggaggagcuggugcugcucggccacagccuggggauccccugggcgccccuguccagcugccccucccaggcccuccagcuggccggcugccugagccagcuccacuccggccuguuccuguaccaggggcuccugcaggcccuggagggcaucagcccggagcucgggcccacccuggacacccugcagcucgacgucgccgacuucgccacgaccaucuggcagcagauggaggagcugggcauggcccccgcgcugcagcccacccagggggccaugccggccuucgccuccgccuuccagcggcgcgcgggcggcgugcucguggccagccaccuccaguccuuccuggaggucagcuaccgggugcugcgccaccuggcccagcccuga

SEQ ID NO: 3932 - RNA, 624 nt, Artificial Sequence
  derived and/or modified sequence opt2 from G-CSF__Homo_sapiens__AAK62469
auggccggccccgccacccagucccccaugaagcucauggcccuccagcuccuccucuggcacuccgcccucuggaccguccaggaggccaccccccucggccccgccuccucccucccccaguccuuccuccucaagugccucgagcagguccgcaagauccagggcgacggcgccgcccuccaggagaagcucgucuccgagugcgccaccuacaagcucugccaccccgaggagcucguccuccucggccacucccucggcauccccugggccccccucuccuccugccccucccaggcccuccagcucgccggcugccucucccagcuccacuccggccucuuccucuaccagggccuccuccaggcccucgagggcaucucccccgagcucggccccacccucgacacccuccagcucgacgucgccgacuucgccaccaccaucuggcagcagauggaggagcucggcauggcccccgcccuccagcccacccagggcgccaugcccgccuucgccuccgccuuccagcgccgcgccggcggcguccucgucgccucccaccuccaguccuuccucgaggucuccuaccgcguccuccgccaccucgcccagcccuga

SEQ ID NO: 3933 - RNA, 624 nt, Artificial Sequence
  derived and/or modified sequence opt3 from G-CSF__Homo_sapiens__AAK62469
auggccggccccgcuacccagagcccuaugaagcugauggcacuccaacuucuguuguggcacuccgccuuauggacagugcaggaggcgacuccacuggggccggcuucuucacuaccccagaguuuccuccugaaaugccuugaacaggucagaaagauccaaggagacggugccgcacugcaggagaaauugguuagcgaaugugccacguacaagcucugccauccugaggaacuggugcugcucggccacuccuuagggauuccaugggcuccccugucuucguguccuucacaggcacuucaguuggccggaugccugagccaacuacauaguggccucuuucuguaucagggucuucugcaggcuuuggaggggauauccccagagcucggacccacccuggauacauuacagcuggacguagccgauuucgcgacuaccaucuggcaacagauggaggaacucggcauggccccugcacuucagccaacacaaggcgcuaugccggccuuugcaucugcuuuccagaggcgggccgggggagugcuggucgcgagccacuugcaguccuuucuagaagugucauaccgcguucugcgacaucucgcccagcccuga

SEQ ID NO: 3934 - RNA, 624 nt, Artificial Sequence
  derived and/or modified sequence opt4 from G-CSF__Homo_sapiens__AAK62469
auggccggccccgccacccagagccccaugaagcugauggcccugcagcugcugcuguggcacagcgcccuguggaccgugcaggaggccaccccccugggccccgccagcagccugccccagagcuuccugcugaagugccuggagcaggugagaaagauccagggcgacggcgccgcccugcaggagaagcuggugagcgagugcgccaccuacaagcugugccaccccgaggagcuggugcugcugggccacagccugggcauccccugggccccccugagcagcugccccagccaggcccugcagcuggccggcugccugagccagcugcacagcggccuguuccuguaccagggccugcugcaggcccuggagggcaucagccccgagcugggccccacccuggacacccugcagcuggacguggccgacuucgccaccaccaucuggcagcagauggaggagcugggcauggcccccgcccugcagcccacccagggcgccaugcccgccuucgccagcgccuuccagagaagagccggcggcgugcugguggccagccaccugcagagcuuccuggaggugagcuacagagugcugagacaccuggcccagcccuga

SEQ ID NO: 3935 - RNA, 624 nt, Artificial Sequence
  derived and/or modified sequence opt5 from G-CSF__Homo_sapiens__AAK62469
auggccggccccgcuacccagagcccuaugaagcugauggcccuccaacugcuucuguggcacuccgcgcucuggacagugcaggaggcuacgccgcuggggcccgccucuagccuuccucaguccuuccugcucaaaugccuggaacaggucagaaagauccaaggagacggcgccgcucugcaggagaaacucguuucugaaugugccaccuacaagcugugccaucccgaggaacuugugcugcucgggcacagccugggcauuccuugggcuccccuuuccucuuguccuagccaggcccugcagcucgcgggaugccugucccaacugcauagcgggcucuuucuguaucagggacuucugcaggcccucgagggcaucucuccggagcugggccccacacuugauacccugcagcucgacguggcugauuucgccacaaccauuuggcaacagauggaggaacuggggauggcuccugcccugcagcccacacaaggagcgaugccugccuuugcuuccgccuuccagcggcgcgcuggcgggguccucguggccagccaucugcagucuuuucuugaaguuuccuacagagugcugcggcaccucgcccagcccuga

SEQ ID NO: 3936 - RNA, 624 nt, Artificial Sequence
  derived and/or modified sequence opt6 from G-CSF__Homo_sapiens__AAK62469
auggcaggaccagcaacacaaucaccaaugaaauuaauggcacuacaauuacuauuauggcacucagcacuauggacaguacaagaagcaacaccauuaggaccagcauccucauuaccacaauccuuccuacuaaaaugccuagaacaaguaagaaaaauacaaggagacggagcagcauuacaagaaaaauuaguaucugaaugcgcaacauacaaacuaugucacccagaagaacucguacuauuaggacauucccuaggaauaccaugggcaccacuaucauccugcccaucacaagcacuacaauuagcaggauguuuaucacaauuacacucaggacuauuccucuaccaaggacuacuacaagcacuagaaggaauauccccagaacuaggaccaacccuagacacacuacaauuagacguagcagacuucgcaacaacaauauggcaacaaauggaagaacuaggcauggcaccagcauuacaaccaacacaaggagcaaugccagcauucgcaucagcauuccaacgaagagcaggaggaguauuaguagcaucacaccuucaaucauuccuagaaguaucuuaccgaguacuaagacaccuagcacaaccauaa

SEQ ID NO: 3937 - protein, 199 aa, Artificial Sequence
  GITRL__Homo_sapiens__Q9UNG2
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 3938 - RNA, 600 nt, Artificial Sequence
  GITRL__Homo_sapiens__CCDS1305.2
augacauugcauccuucacccaucacuugugaauuuuuguuuuccacagcucucauuucuccaaaaauguguuugagccacuuggaaaauaugccuuuaagccauucaagaacucaaggagcucagagaucauccuggaagcuguggcucuuuugcucaauaguuauguugcuauuucuuugcuccuucaguuggcuaaucuuuauuuuucuccaauuagagacugcuaaggagcccuguauggcuaaguuuggaccauuacccucaaaauggcaaauggcaucuucugaaccuccuugcgugaauaaggugucugacuggaagcuggagauacuucagaauggcuuauauuuaauuuauggccaaguggcucccaaugcaaacuacaaugauguagcuccuuuugaggugcggcuguauaaaaacaaagacaugauacaaacucuaacaaacaaaucuaaaauccaaaauguaggagggacuuaugaauugcauguuggggacaccauagacuugauauucaacucugagcaucagguucuaaaaaauaauacauacugggguaucauuuuacuagcaaauccccaauucaucuccuag

SEQ ID NO: 3939 - RNA, 600 nt, Artificial Sequence
  derived and/or modified sequence opt1 from GITRL__Homo_sapiens__CCDS1305.2
augacccugcaccccagcccgaucacgugcgaguuccucuucuccaccgcccugaucagccccaagaugugccugucccaccucgagaacaugccccugagccacucccgcacccagggcgcccagcggagcuccuggaagcuguggcuguucugcagcaucgugaugcuccuguuccucugcuccuucagcuggcugaucuucaucuuccugcagcucgagaccgcgaaggagcccugcauggccaaguucgggccgcugcccuccaaguggcagauggccagcuccgagccgcccugcgucaacaaggugagcgacuggaagcuggagauccuccagaacggccuguaccugaucuacgggcaggucgcccccaacgccaacuacaacgacguggcgcccuucgaggugcgccucuacaagaacaaggacaugauccagacccugacgaacaaguccaagauccagaacgugggcgggaccuacgagcugcacgucggcgacaccaucgaccucaucuucaacagcgagcaccaggugcugaagaacaacaccuacuggggcaucauccugcucgccaacccccaguucaucuccuga

SEQ ID NO: 3940 - RNA, 600 nt, Artificial Sequence
  derived and/or modified sequence opt2 from GITRL__Homo_sapiens__CCDS1305.2
augacccuccaccccucccccaucaccugcgaguuccucuucuccaccgcccucaucucccccaagaugugccucucccaccucgagaacaugccccucucccacucccgcacccagggcgcccagcgcuccuccuggaagcucuggcucuucugcuccaucgucaugcuccucuuccucugcuccuucuccuggcucaucuucaucuuccuccagcucgagaccgccaaggagcccugcauggccaaguucggcccccuccccuccaaguggcagauggccuccuccgagccccccugcgucaacaaggucuccgacuggaagcucgagauccuccagaacggccucuaccucaucuacggccaggucgcccccaacgccaacuacaacgacgucgcccccuucgagguccgccucuacaagaacaaggacaugauccagacccucaccaacaaguccaagauccagaacgucggcggcaccuacgagcuccacgucggcgacaccaucgaccucaucuucaacuccgagcaccagguccucaagaacaacaccuacuggggcaucauccuccucgccaacccccaguucaucuccuga

SEQ ID NO: 3941 - RNA, 600 nt, Artificial Sequence
  derived and/or modified sequence opt3 from GITRL__Homo_sapiens__CCDS1305.2
augacccugcaccccagcccuaucacaugcgaguuccucuuuuccacugcccuuauuucuccaaagaugugucugucacauuuggaaaacaugccguuaagucacagcagaacgcagggcgcucaaagguccucuuggaaacuguggcuauucugcucgauagugaugcuccuguuucuuuguucauucagcuggcugaucuuuauuuucuugcagcucgagaccgcaaaggaacccugcauggccaaauuugggccucugccaaguaaguggcagauggcguccucugagcccccuugugucaauaaaguuagcgacuggaagcuggaaauccuccagaacggauuauaccugauuuauggucaaguggcuccaaaugccaacuacaaugauguagcacccuucgaggugcggcuuuauaagaacaaagacaugauccagacauugacuaauaaguccaaaauacagaacgucggcgggaccuacgagcugcaugugggagauacaaucgaccuaauuuuuaauucagaacaccagguucucaagaacaauaccuauuggggcaucauucugcuugccaacccucaauucaucaguuga

SEQ ID NO: 3942 - RNA, 600 nt, Artificial Sequence
  derived and/or modified sequence opt4 from GITRL__Homo_sapiens__CCDS1305.2
augacccugcaccccagccccaucaccugcgaguuccuguucagcaccgcccugaucagccccaagaugugccugagccaccuggagaacaugccccugagccacagcagaacccagggcgcccagagaagcagcuggaagcuguggcuguucugcagcaucgugaugcugcuguuccugugcagcuucagcuggcugaucuucaucuuccugcagcuggagaccgccaaggagcccugcauggccaaguucggcccccugcccagcaaguggcagauggccagcagcgagccccccugcgugaacaaggugagcgacuggaagcuggagauccugcagaacggccuguaccugaucuacggccagguggcccccaacgccaacuacaacgacguggcccccuucgaggugagacuguacaagaacaaggacaugauccagacccugaccaacaagagcaagauccagaacgugggcggcaccuacgagcugcacgugggcgacaccaucgaccugaucuucaacagcgagcaccaggugcugaagaacaacaccuacuggggcaucauccugcuggccaacccccaguucaucagcuga

SEQ ID NO: 3943 - RNA, 600 nt, Artificial Sequence
  derived and/or modified sequence opt5 from GITRL__Homo_sapiens__CCDS1305.2
augacccugcaccccagcccuaucacaugcgaguuccucuuuuccacggcccugauuucuccgaagaugugucuuagccaucuggaaaacaugccccucucccacucuagaacccagggcgcucaacggagcuccuggaaacuguggcuuuucugcucuaucgugaugcugcucuuucuguguagcuucuccuggcugauuuuuaucuuccuccagcuggagacagccaaggaaccuugcauggcgaaauuugggccccuuccuagcaaguggcagauggcuucuuccgagcccccuugugucaauaaaguuagcgacuggaagcuggaaauucuccagaacggacuguaccuuaucuauggccaaguggccccgaaugccaacuacaaugauguggcucccuucgagguccgccuguauaagaacaaagacaugauccagacccucacaaauaagucuaaaauucagaacguugggggaaccuacgagcugcaugugggcgauacaaucgaccugauuuuuaauuccgaacaccaggugcucaagaacaauaccuauugggggaucauucugcuugccaacccucaauucaucagcuga

SEQ ID NO: 3944 - RNA, 600 nt, Artificial Sequence
  derived and/or modified sequence opt6 from GITRL__Homo_sapiens__CCDS1305.2
augacacuacacccaucacccauaacaugcgaauuccuauucucaacagcccuaauaucaccaaaaaugugccuaucacaccuagaaaacaugccacuaucacacucaagaacacaaggagcacaaagaucaucauggaaacucuggcuauucugcucaaucguaauguuacuauuccuaugcuccuucucauggcuaauauucauauuccuccaacuagaaacagcaaaagaaccaugcauggccaaauucggaccauuaccaucuaaauggcaaauggcaucaucagaacccccaugcguaaacaaaguaucagacuggaaacuagaaauauuacaaaacggacucuauuuaauauacggacaaguagcaccaaacgcaaacuacaacgacguagcaccauucgaaguaagacuauacaaaaauaaagacaugauacaaacacuaacaaacaaaucaaaaauacaaaacguaggaggaacauacgaacuacacguaggagacacaauagaccuaaucuucaacucagaacaccaaguacuaaaaaacaacacauacuggggaauaauacuacuagcaaacccacaauucauaucauaa

SEQ ID NO: 3945 - protein, 144 aa, Artificial Sequence
  GM-CSF__Homo_sapiens__P04141
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 3946 - RNA, 435 nt, Artificial Sequence
  GM-CSF__Homo_sapiens__AAA52122
auguggcugcagagccugcugcucuugggcacuguggccugcagcaucucugcacccgcccgcucgcccagccccagcacacagcccugggagcaugugaaugccauccaggaggcccggcgucuccugaaccugaguagagacacugcugcugagaugaaugaaacaguagaagucaucucagaaauguuugaccuccaggagccgaccugccuacagacccgccuggagcuguacaagcagggccugcggggcagccucaccaagcucaagggccccuugaccaugauggccagccacuacaaacagcacugcccuccaaccccggaaacuuccugugcaacccagauuaucaccuuugaaaguuucaaagagaaccugaaggacuuucugcuugucauccccuuugacugcugggagccaguccaggaguga

SEQ ID NO: 3947 - RNA, 435 nt, Artificial Sequence
  derived and/or modified sequence opt1 from GM-CSF__Homo_sapiens__AAA52122
auguggcugcagagccuccugcugcucggcaccguggccugcuccaucagcgcccccgcgcgcuccccgagccccuccacccagcccugggagcacgucaacgccauccaggaggcccggcgccugcugaaccucagccgggacacggccgccgagaugaacgagaccguggaggugaucuccgagauguucgaccugcaggagccgaccugccugcagacccgccucgagcuguacaagcaggggcugcggggcagccucacgaagcugaaggggccccugaccaugauggcgucccacuacaagcagcacugcccgcccacccccgagaccagcugcgccacgcagaucaucaccuucgaguccuucaaggagaaccucaaggacuuccugcuggucauccccuucgacugcugggagcccgugcaggaguga

SEQ ID NO: 3948 - RNA, 435 nt, Artificial Sequence
  derived and/or modified sequence opt2 from GM-CSF__Homo_sapiens__AAA52122
auguggcuccagucccuccuccuccucggcaccgucgccugcuccaucuccgcccccgcccgcucccccucccccuccacccagcccugggagcacgucaacgccauccaggaggcccgccgccuccucaaccucucccgcgacaccgccgccgagaugaacgagaccgucgaggucaucuccgagauguucgaccuccaggagcccaccugccuccagacccgccucgagcucuacaagcagggccuccgcggcucccucaccaagcucaagggcccccucaccaugauggccucccacuacaagcagcacugcccccccacccccgagaccuccugcgccacccagaucaucaccuucgaguccuucaaggagaaccucaaggacuuccuccucgucauccccuucgacugcugggagcccguccaggaguga

SEQ ID NO: 3949 - RNA, 435 nt, Artificial Sequence
  derived and/or modified sequence opt3 from GM-CSF__Homo_sapiens__AAA52122
auguggcugcagagccuccuucuguugggcaccguggccugcuccaucucugcucccgcaagaucaccuaguccaagcacacaaccgugggagcacgucaacgccauucaggaagcgaggcgguuacugaaucuaucccgcgacacugcugccgagaugaacgaaacgguugaggugauaucugaaauguucgaucuccaggagcccaccugucugcagacacgacuugagcuguacaagcaaggguugcguggaucgcucacuaaacugaaggguccucugaccaugauggcaucacauuauaaacagcacugcccacccacaccugaaaccagcugugccacucagaucauuacauuugagaguuucaaggaaaaucucaaagacuuuuuacugguaaucccauucgauugcugggagcccgugcaggaguga

SEQ ID NO: 3950 - RNA, 435 nt, Artificial Sequence
  derived and/or modified sequence opt4 from GM-CSF__Homo_sapiens__AAA52122
auguggcugcagagccugcugcugcugggcaccguggccugcagcaucagcgcccccgccagaagccccagccccagcacccagcccugggagcacgugaacgccauccaggaggccagaagacugcugaaccugagcagagacaccgccgccgagaugaacgagaccguggaggugaucagcgagauguucgaccugcaggagcccaccugccugcagaccagacuggagcuguacaagcagggccugagaggcagccugaccaagcugaagggcccccugaccaugauggccagccacuacaagcagcacugcccccccacccccgagaccagcugcgccacccagaucaucaccuucgagagcuucaaggagaaccugaaggacuuccugcuggugauccccuucgacugcugggagcccgugcaggaguga

SEQ ID NO: 3951 - RNA, 435 nt, Artificial Sequence
  derived and/or modified sequence opt5 from GM-CSF__Homo_sapiens__AAA52122
auguggcugcagagccuccugcuucugggcaccguggccugcuccaucucugcucccgccagaagcccuuccccgucuacacaacccugggagcacgucaacgcgauucaggaagcucggcgccuccugaaucuuagcagagacacggccgccgagaugaacgaaaccguugaggugaucuccgaaauguucgaucugcaggagccuacaugucuccagacccggcuggagcuguacaagcaagggcuccgcggaucucugacaaaacuuaagggcccccugaccaugauggcuagccauuauaaacagcacugcccucccacaccugaaaccuccugugccacgcagauuaucaccuuugagagcuucaaggaaaaucucaaagacuuucugcuugugauuccguucgauugcugggagcccguccaggaguga

SEQ ID NO: 3952 - RNA, 435 nt, Artificial Sequence
  derived and/or modified sequence opt6 from GM-CSF__Homo_sapiens__AAA52122
auguggcuccaaucacuacuacuacuaggaacaguagcaugcucaauaucagcaccagcaagaucaccaucaccaucaacacaaccaugggaacacguaaacgcaauacaagaagcaagaagacuacuaaacuuaucaagagacacagcagcagaaaugaacgaaacaguagaagucauaucagaaauguucgaccuacaagaaccaacaugccuacaaacaagacuagaacuauacaaacaaggacuaagaggaucacuaacaaaacuaaaaggaccacuaacaaugauggcaucacacuacaaacaacacugcccaccaacaccagaaacaucaugcgcaacacaaauaauaacauucgaaucauucaaagaaaaccuaaaagacuuccuacuaguaauaccauucgacugcugggaaccaguacaagaauaa

SEQ ID NO: 3953 - protein, 189 aa, Artificial Sequence [sequence omitted]

SEQ ID NO: 3954 - RNA, 570 nt, Artificial Sequence
  IFNalpha__Homo_sapiens__AET86952
auggccucgcccuuugcuuuacugaugguccugguggugcucagcugcaagucaagcugcucuccgggcugugaucucccugagacccacagccuggauaacaggaggaccuugaugcuccuggcacaaaugagcagaaucucuccuuccuccugucugauggacagacaugacuuuggauuuccccaggaggaguuugauggcaaccaguuccagaaggcuccagccaucucuguccuccaagagcugauccagcagaucuucaaccucuuuaccacaaaagauucaucugcugcuugggaugaggaccuccuagacaaauucugcaccgaacucuaccagcagcugaaugacuuggaagccugugugaugcaggaggagagggugggagaaacuccccugaugaaugcggacuccaucuuggcugugaagaaauacuuccgaagaaucacucucuaucugacggagaagaaauacagcccuugugccugggagguugucagagcagaaaucgugagaucccucucuuuaucaacaaacuugcaagaaagauuaaggaggaaggaauaa

SEQ ID NO: 3955 - RNA, 570 nt, Artificial Sequence
  derived and/or modified sequence opt1 from IFNalpha__Homo_sapiens__AET86952
auggccagccccuucgcccugcucauggugcuggucgugcuguccugcaagagcuccugcagcccgggcugcgaccuccccgagacccacucccuggacaaccgccggacccugaugcuccuggcgcagaugagccgcaucucccccagcuccugccugauggaccggcacgacuucggguucccccaggaggaguucgacggcaaccaguuccagaaggccccggccaucagcgugcuccaggagcugauccagcagaucuucaaccuguucacgaccaaggacuccagcgccgccugggacgaggaccuccuggacaaguucugcaccgagcuguaccagcagcucaacgaccuggaggcgugcgucaugcaggaggagcgcgugggggagacgccccugaugaacgccgacuccauccucgccgugaagaaguacuuccggcgcaucacccuguaccugaccgagaagaaguacagccccugcgccugggaggucgugcgggcggagaucgugcgcucccucagccuguccaccaaccugcaggagcggcuccgccggaaggaguga

SEQ ID NO: 3956 - RNA, 570 nt, Artificial Sequence
  derived and/or modified sequence opt2 from IFNalpha__Homo_sapiens__AET86952
auggccucccccuucgcccuccucaugguccucgucguccucuccugcaaguccuccugcucccccggcugcgaccuccccgagacccacucccucgacaaccgccgcacccucaugcuccucgcccagaugucccgcaucucccccuccuccugccucauggaccgccacgacuucggcuucccccaggaggaguucgacggcaaccaguuccagaaggcccccgccaucuccguccuccaggagcucauccagcagaucuucaaccucuucaccaccaaggacuccuccgccgccugggacgaggaccuccucgacaaguucugcaccgagcucuaccagcagcucaacgaccucgaggccugcgucaugcaggaggagcgcgucggcgagaccccccucaugaacgccgacuccauccucgccgucaagaaguacuuccgccgcaucacccucuaccucaccgagaagaaguacucccccugcgccugggaggucguccgcgccgagaucguccgcucccucucccucuccaccaaccuccaggagcgccuccgccgcaaggaguga

SEQ ID NO: 3957 - RNA, 570 nt, Artificial Sequence
  derived and/or modified sequence opt3 from IFNalpha__Homo_sapiens__AET86952
auggccagccccuucgcucugcucauggugcuugucguucuguccugcaagucuucauguaguccuggcugcgacuugccagagacccacagcuuagauaacagaaggacacugaugcuacucgcacagaugucccggaucucuccgucgucaugucugauggaccgccaugauuuuggguucccccaagaagaguuugacggaaaucaguuccagaaagccccugcgauuagcgugcuucaggaacugauacaacagaucuuuaacuuguucacuacgaaggauaguuccgcugccugggacgaggaucuccuggacaaauuuugcaccgaacuguaccagcagcucaaugauuuagaggcauguguaaugcaagaggaacgagugggugagacaccacugaugaacgccgacucuauucuugcugucaagaaauauuuccguagaaucacuuuguaccugaccgaaaagaaguauagccccugcgcaugggaggugguuagggccgagauugugcggucccuaucacucaguacaaaucugcaggaacgccuuagaaggaaagaguga

SEQ ID NO: 3958 - RNA, 570 nt, Artificial Sequence
  derived and/or modified sequence opt4 from IFNalpha__Homo_sapiens__AET86952
auggccagccccuucgcccugcugauggugcugguggugcugagcugcaagagcagcugcagccccggcugcgaccugcccgagacccacagccuggacaacagaagaacccugaugcugcuggcccagaugagcagaaucagccccagcagcugccugauggacagacacgacuucggcuucccccaggaggaguucgacggcaaccaguuccagaaggcccccgccaucagcgugcugcaggagcugauccagcagaucuucaaccuguucaccaccaaggacagcagcgccgccugggacgaggaccugcuggacaaguucugcaccgagcuguaccagcagcugaacgaccuggaggccugcgugaugcaggaggagagagugggcgagaccccccugaugaacgccgacagcauccuggccgugaagaaguacuucagaagaaucacccuguaccugaccgagaagaaguacagccccugcgccugggagguggugagagccgagaucgugagaagccugagccugagcaccaaccugcaggagagacugagaagaaaggaguga

SEQ ID NO: 3959 - RNA, 570 nt, Artificial Sequence
  derived and/or modified sequence opt5 from IFNalpha__Homo_sapiens__AET86952
auggccagccccuucgcucugcucauggugcuggucguucuuuccugcaagucuagcuguuccccuggcugcgaccugccggagacccacucucucgauaacagacggacacugaugcuucuggcccagaugagccgcaucucccccucuagcugucucauggacagacaugauuuuggguucccucaagaagaguuugacggaaaucaguuccagaaagcgcccgcuauuuccgugcugcaggaacugauccaacagauuuuuaaccucuucacgaccaaggauagcucugccgccugggacgaggaucugcuugacaaauuuugcacagaacuguaccagcagcucaaugaucuggaggcuugugugaugcaagaggaacgggucggcgagaccccucuuaugaacgccgacuccauccuggcugugaagaaauauuuccgcagaauuacacucuaccugaccgaaaagaaguauagccccugcgccugggagguugugcgggcggagaucguccgcucucugucccucagcacaaaucugcaggaaagacuucggcgcaaagaguga

SEQ ID NO: 3960 - RNA, 570 nt, Artificial Sequence
  derived and/or modified sequence opt6 from IFNalpha__Homo_sapiens__AET86952
auggcaucaccauucgcauuacuuaugguacuaguaguauuaucuugcaaaucaucaugcuccccaggaugcgaccuaccagaaacacacucacuagacaacagaagaacauuaaugcuacuagcacaaaugucacgaauaagcccaucaucaugccuaauggacagacacgacuucggauucccacaagaagaauucgacggaaaccaauuucaaaaagccccagcaauaucaguacuacaagaacuaauacaacaaauauucaaccuauucacaacaaaagacagcucagcagcaugggacgaagaccuauuagacaaauucugcacagaacuauaccaacaacuaaacgaccuagaagcaugcguaaugcaagaagaaagaguaggcgaaacaccauuaaugaacgcagacucaauacuagcaguaaaaaaauacuuuagaagaauaacauuauacuuaacagaaaaaaaauacagcccaugugccugggaaguaguaagagcagaaauaguaagaucacuaucacuaucaacaaacuuacaagaaagauuaagaagaaaagaauaa

SEQ ID NO: 3961 - protein, 189 aa, Artificial Sequence
  IFNalpha__Homo_sapiens__P01562
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 3962 - RNA, 570 nt, Artificial Sequence
  IFNalpha__Homo_sapiens__AAB59403
auggccucgcccuuugcuuuacugaugguccugguggugcucagcugcaagucaagcugcucucugggcugugaucucccugagacccacagccuggauaacaggaggaccuugaugcuccuggcacaaaugagcagaaucucuccuuccuccugucugauggacagacaugacuuuggauuuccccaggaggaguuugauggcaaccaguuccagaaggcuccagccaucucuguccuccaugagcugauccagcagaucuucaaccucuuuaccacaaaagauucaucugcugcuugggaugaggaccuccuagacaaauucugcaccgaacucuaccagcagcugaaugacuuggaagccugugugaugcaggaggagagggugggagaaacuccccugaugaaugcggacuccaucuuggcugugaagaaauacuuccgaagaaucacucucuaucugacagagaagaaauacagcccuugugccugggagguugucagagcagaaaucaugagaucccucucuuuaucaacaaacuugcaagaaagauuaaggaggaaggaauaa

SEQ ID NO: 3963 - RNA, 570 nt, Artificial Sequence
  derived and/or modified sequence opt1 from IFNalpha__Homo_sapiens__AAB59403
auggccagccccuucgcccugcucauggugcuggucgugcuguccugcaagagcuccugcagccucggcugcgaccugccggagacccacucccuggacaaccgccggacccucaugcugcuggcgcagaugagccgcaucucccccagcuccugccucauggaccggcacgacuucggguucccccaggaggaguucgacggcaaccaguuccagaaggcccccgccaucagcgugcugcacgagcugauccagcagaucuucaaccucuucacgaccaaggacuccagcgccgccugggacgaggaccugcuggacaaguucugcaccgagcucuaccagcagcugaacgaccuggaggcgugcgucaugcaggaggagcgcgugggggagaccccgcucaugaacgccgacuccauccuggccgugaagaaguacuuccggcgcaucacgcuguaccucaccgagaagaaguacagccccugcgccugggaggucgugcgggcggagaucaugcgcucccugagccuguccaccaaccuccaggagcggcugcgccggaaggaguga

SEQ ID NO: 3964 - RNA, 570 nt, Artificial Sequence
  derived and/or modified sequence opt2 from IFNalpha__Homo_sapiens__AAB59403
auggccucccccuucgcccuccucaugguccucgucguccucuccugcaaguccuccugcucccucggcugcgaccuccccgagacccacucccucgacaaccgccgcacccucaugcuccucgcccagaugucccgcaucucccccuccuccugccucauggaccgccacgacuucggcuucccccaggaggaguucgacggcaaccaguuccagaaggcccccgccaucuccguccuccacgagcucauccagcagaucuucaaccucuucaccaccaaggacuccuccgccgccugggacgaggaccuccucgacaaguucugcaccgagcucuaccagcagcucaacgaccucgaggccugcgucaugcaggaggagcgcgucggcgagaccccccucaugaacgccgacuccauccucgccgucaagaaguacuuccgccgcaucacccucuaccucaccgagaagaaguacucccccugcgccugggaggucguccgcgccgagaucaugcgcucccucucccucuccaccaaccuccaggagcgccuccgccgcaaggaguga

SEQ ID NO: 3965 - RNA, 570 nt, Artificial Sequence
  derived and/or modified sequence opt3 from IFNalpha__Homo_sapiens__AAB59403
auggccagccccuucgcucugcucauggugcuugucguucuguccugcaagucuucauguaguuugggcugcgacuuaccugagacccacagccuggauaacagaaggacacuaaugcuccuggcacagaugucccggaucucuccaucgucaugucuuauggaccgccaugauuuuggguucccgcaagaagaguuugacggaaaucaguuccagaaagcccccgcgauuagcgugcugcacgaauugauacagcaaaucuuuaaccucuucacuacgaaggauaguuccgcugccugggacgaggaucugcuggacaaauuuugcaccgaacucuaccagcaguuaaaugaucuggaggcauguguaaugcaggaggaacgagugggugagacaccucuuaugaacgccgacucuauuuuggcugucaagaaauauuuccguagaaucacucuguaccuaaccgaaaagaaguauagcccaugcgcaugggaggugguuagggccgagauuaugcggucccucucacugaguacaaaucuucaagaacgccugagaaggaaagaguga

SEQ ID NO: 3966 - RNA, 570 nt, Artificial Sequence
  derived and/or modified sequence opt4 from IFNalpha__Homo_sapiens__AAB59403
auggccagccccuucgcccugcugauggugcugguggugcugagcugcaagagcagcugcagccugggcugcgaccugcccgagacccacagccuggacaacagaagaacccugaugcugcuggcccagaugagcagaaucagccccagcagcugccugauggacagacacgacuucggcuucccccaggaggaguucgacggcaaccaguuccagaaggcccccgccaucagcgugcugcacgagcugauccagcagaucuucaaccuguucaccaccaaggacagcagcgccgccugggacgaggaccugcuggacaaguucugcaccgagcuguaccagcagcugaacgaccuggaggccugcgugaugcaggaggagagagugggcgagaccccccugaugaacgccgacagcauccuggccgugaagaaguacuucagaagaaucacccuguaccugaccgagaagaaguacagccccugcgccugggagguggugagagccgagaucaugagaagccugagccugagcaccaaccugcaggagagacugagaagaaaggaguga

SEQ ID NO: 3967 - RNA, 570 nt, Artificial Sequence
  derived and/or modified sequence opt5 from IFNalpha__Homo_sapiens__AAB59403
auggccagccccuucgcucugcucauggugcuggucguucuuuccugcaagucuagcuguucccugggcugcgaccucccugagacccacucucuggauaacagacggacacuuaugcugcucgcccagaugagccgcaucuccccgucuagcugucugauggacagacaugauuuuggguucccccaagaagaguuugacggaaaucaguuccagaaagcgccugcuauuuccgugcugcacgaacucauccagcaaauuuuuaaccuguucacgaccaaggauagcucugccgccugggacgaggaucuucuggacaaauuuugcacagaacucuaccagcagcugaaugaucuugaggcuugugugaugcaggaggaacgggucggcgagacaccccugaugaacgccgacuccauccucgcugugaagaaauauuuccgcagaauuacccuguaccugaccgaaaagaaguauagcccuugcgccugggagguugugcgggcggagaucaugcgcucucucucccugagcacaaaucuucaagaaagacugcggcgcaaagaguga

SEQ ID NO: 3968 - RNA, 570 nt, Artificial Sequence
  derived and/or modified sequence opt6 from IFNalpha__Homo_sapiens__AAB59403
auggcaucaccauucgcccuacuaaugguccuaguaguacuaucaugcaaaucaucaugcucacuaggaugcgaccuaccagaaacacacucacuagauaacagaagaacacuaaugcuacuagcacaaaugucacgaauaucaccaagcucaugccuaauggacagacacgacuucggauucccacaagaagaauucgauggaaaccaauuccaaaaagcaccagcaauaagcguacuacacgaacuaauacaacaaauauucaaucuauucacaacaaaagacucaucagcagcaugggacgaagaccuacuagacaaauucugcacagaacuauaccaacaauuaaacgacuuagaagcaugcguaaugcaagaagaaagaguaggagaaacaccacuaaugaacgccgacucaauacuagcaguaaaaaaauauuucagaagaaucacauuauaccuaacagaaaaaaaauacucaccaugcgcaugggaaguaguaagagcagaaauaaugagaucauuaucauuaucaacaaaccuacaagaaagauuaagacgaaaagaauaa

SEQ ID NO: 3969 - protein, 188 aa, Artificial Sequence [sequence omitted]

SEQ ID NO: 3970 - RNA, 567 nt, Artificial Sequence
  IFNalpha__Homo_sapiens__AAA59181
auggccuugaccuuugcuuuacugguggcccuccuggugcucagcugcaagucaagcugcucugugggcugugaucugccucaaacccacagccuggguagcaggaggaccuugaugcuccuggcacagaugaggaaaaucucucuuuucuccugcuugaaggacagacaugacuuuggauuuccccaggaggaguuuggcaaccaguuccaaaaggcugaaaccaucccuguccuccaugagaugauccagcagaucuucaaucucuucagcacaaaggacucaucugcugcuugggaugagacccuccuagacaaauucuacacugaacucuaccagcagcugaaugaccuggaagccugugugauacagggggugggggugacagagacuccccugaugaaggaggacuccauucuggcugugaggaaauacuuccaaagaaucacucucuaucugaaagagaagaaauacagcccuugugccugggagguugucagagcagaaaucaugagaucuuuuucuuugucaacaaacuugcaagaaaguuuaagaaguaaggaauga

SEQ ID NO: 3971 - RNA, 567 nt, Artificial Sequence
  derived and/or modified sequence opt1 from IFNalpha__Homo_sapiens__AAA59181
auggcccugaccuucgcccuccugguggcgcugcucguccugagcugcaaguccagcugcuccgugggcugcgaccugccccagacccacagccucgggucccgccggacgcugaugcugcucgcccagaugcgcaagaucagccuguucuccugccugaaggaccggcacgacuucggcuucccgcaggaggaguucgggaaccaguuccagaaggccgagaccauccccgugcuccacgagaugauccagcagaucuucaaccuguucagcaccaaggacuccagcgccgccugggacgagacccugcucgacaaguucuacacggagcuguaccagcagcugaacgaccucgaggcgugcgucauccagggcgugggggugaccgagacgccccugaugaaggaggacuccauccuggccguccgcaaguacuuccagcggaucacccucuaccugaaggagaagaaguacagccccugcgccugggagguggugcgcgccgagaucaugcgguccuucagccuguccaccaaccuccaggagagccugcgcuccaaggaguga

SEQ ID NO: 3972 - RNA, 567 nt, Artificial Sequence
  derived and/or modified sequence opt2 from IFNalpha__Homo_sapiens__AAA59181
auggcccucaccuucgcccuccucgucgcccuccucguccucuccugcaaguccuccugcuccgucggcugcgaccucccccagacccacucccucggcucccgccgcacccucaugcuccucgcccagaugcgcaagaucucccucuucuccugccucaaggaccgccacgacuucggcuucccccaggaggaguucggcaaccaguuccagaaggccgagaccauccccguccuccacgagaugauccagcagaucuucaaccucuucuccaccaaggacuccuccgccgccugggacgagacccuccucgacaaguucuacaccgagcucuaccagcagcucaacgaccucgaggccugcgucauccagggcgucggcgucaccgagaccccccucaugaaggaggacuccauccucgccguccgcaaguacuuccagcgcaucacccucuaccucaaggagaagaaguacucccccugcgccugggaggucguccgcgccgagaucaugcgcuccuucucccucuccaccaaccuccaggagucccuccgcuccaaggaguga

SEQ ID NO: 3973 - RNA, 567 nt, Artificial Sequence
  derived and/or modified sequence opt3 from IFNalpha__Homo_sapiens__AAA59181
auggcccugaccuucgcucuccuuguggcacuguuggucuuaagcugcaaguccucuuguucaguuggcugcgaccugccccagacacacagucuagggagcagaaggacucucaugcugcuugcccaaaugcggaaaaucucccuguuuucuuguuugaaggaucgccaugacuucggauuuccucaggaggaguucgguaaccaguuucagaaagcggaaacgauuccagugcuccacgaaaugauacaacagaucuucaaucuguuuucgaccaaggauucaagcgcugccugggacgagacacugcucgauaaauucuacacugaauuauaucagcagcugaacgaccuugaggcaugcguaauucaaggcgugggggucaccgagacaccguugaugaaggaagauaguauccuggccgugcgaaaguacuuucagcguauuacccuauaucucaaagagaagaaauacucccccugugcuugggaaguugugagagcagagaucaugaggucuuucagccuguccacuaaucuucaggagucacugcggaguaaggaauga

SEQ ID NO: 3974 - RNA, 567 nt, Artificial Sequence
  derived and/or modified sequence opt4 from IFNalpha__Homo_sapiens__AAA59181
auggcccugaccuucgcccugcugguggcccugcuggugcugagcugcaagagcagcugcagcgugggcugcgaccugccccagacccacagccugggcagcagaagaacccugaugcugcuggcccagaugagaaagaucagccuguucagcugccugaaggacagacacgacuucggcuucccccaggaggaguucggcaaccaguuccagaaggccgagaccauccccgugcugcacgagaugauccagcagaucuucaaccuguucagcaccaaggacagcagcgccgccugggacgagacccugcuggacaaguucuacaccgagcuguaccagcagcugaacgaccuggaggccugcgugauccagggcgugggcgugaccgagaccccccugaugaaggaggacagcauccuggccgugagaaaguacuuccagagaaucacccuguaccugaaggagaagaaguacagccccugcgccugggagguggugagagccgagaucaugagaagcuucagccugagcaccaaccugcaggagagccugagaagcaaggaguga

SEQ ID NO: 3975 - RNA, 567 nt, Artificial Sequence
  derived and/or modified sequence opt5 from IFNalpha__Homo_sapiens__AAA59181
auggcccugaccuucgcucuccugguggcccuucugguccucagcugcaaguccucuuguagcguuggcugcgaccugccccagacacacucccuugggucuagacggacgcugaugcuccuggcgcaaaugcgcaaaaucagccuguuuuccugucucaaggauagacaugacuucggauuuccucaggaggaauuuggcaaccaguuucagaaagcugagaccauuccggugcugcacgaaaugauccaacagauuuucaaucuuuucucuacaaaggauagcuccgccgccugggacgagacccugcucgauaaauucuacacagaacuguaucagcagcuuaacgaccuggaggcuugcgugauccaaggggucggagugaccgagacaccccucaugaaggaagauagcauucuggccguucggaaguacuuucagcgcaucacccuguaucucaaagagaagaaauacucuccuugugcuugggaaguggucagagccgagaucaugcgguccuucagccugucuacgaaucuucaggagucccugcgcagcaaggaauga

SEQ ID NO: 3976 - RNA, 567 nt, Artificial Sequence
  derived and/or modified sequence opt6 from IFNalpha__Homo_sapiens__AAA59181
auggcacuaacauucgcacuacuaguagcauuacuaguauuaucaugcaaaucaucaugcucaguaggaugcgaccuaccacaaacacacucauuaggaucaagaagaacacuaaugcuacuagcacaaaugagaaaaauaucacuauucucaugccuaaaagacagacacgacuucggauucccacaagaagaauucggaaaccaauuccaaaaagcagaaacaauaccaguacuacacgaaaugauacaacaaauauucaacuuauucucaacaaaagacucaucagcagcaugggacgaaacccuacuagacaaauucuacacagaacuauaccaacaacuaaacgaccuagaagcaugcguaauacaaggaguaggagucacagaaacaccacuaaugaaagaagacucaauacuagcaguaagaaaauacuuccaacgaauaacacuauaccuaaaagaaaaaaaauacuccccaugcgcaugggaaguaguaagagcagaaauaaugagauccuucucacuauccaccaaccuacaagaaucccuaagaucaaaagaauaa

SEQ ID NO: 3977 - protein, 189 aa, Artificial Sequence
  IFNalpha__Homo_sapiens__P01566
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 3978 - RNA, 570 nt, Artificial Sequence
  IFNalpha__Homo_sapiens__AAH69409
auggcccuguccuuuucuuuacuuauggccgugcuggugcucagcuacaaauccaucuguucucuaggcugugaucugccucagacccacagccuggguaauaggagggccuugauacuccugggacaaaugggaagaaucucuccuuucuccugccugaaggacagacaugauuuccgaaucccccaggaggaguuugauggcaaccaguuccagaaggcucaagccaucucuguccuccaugagaugauccagcagaccuucaaucucuucagcacagaggacucaucugcugcuugggaacagagccuccuagaaaaauuuuccacugaacuuuaccagcaacugaaugaccuggaagcaugugugauacaggagguugggguggaagagacuccccugaugaaugaggacuccauccuggcugugaggaaauacuuccaaagaaucacucuuuaucuaauagagaggaaauacagcccuugugccugggagguugucagagcagaaaucaugagaucccucucguuuucaacaaacuugcaaaaaagauuaaggaggaaggauuga

SEQ ID NO: 3979 - RNA, 570 nt, Artificial Sequence
  derived and/or modified sequence opt1 from IFNalpha__Homo_sapiens__AAH69409
auggcccugagcuucucccuccugauggccgugcugguccucagcuacaaguccaucugcagccugggcugcgaccugccccagacccacucccucgggaaccgccgggcgcugauccugcucggccagauggggcgcaucagcccguucuccugccugaaggaccggcacgacuuccgcaucccccaggaggaguucgacggcaaccaguuccagaaggcccaggccaucagcgugcugcacgagaugauccagcagaccuucaaccucuucuccacggaggacagcuccgccgccugggagcagagccugcuggagaaguucuccaccgagcucuaccagcagcugaacgaccuggaggcgugcgugauccaggaggucgggguggaggagacgccccucaugaacgaggacagcauccuggccgugcggaaguacuuccagcgcaucacccuguaccucaucgagcggaaguacucccccugcgccugggaggucgugcgcgccgagaucaugcggagccuguccuucagcaccaaccugcagaagcgccuccggcgcaaggacuga

SEQ ID NO: 3980 - RNA, 570 nt, Artificial Sequence
  derived and/or modified sequence opt2 from IFNalpha__Homo_sapiens__AAH69409
auggcccucuccuucucccuccucauggccguccucguccucuccuacaaguccaucugcucccucggcugcgaccucccccagacccacucccucggcaaccgccgcgcccucauccuccucggccagaugggccgcaucucccccuucuccugccucaaggaccgccacgacuuccgcaucccccaggaggaguucgacggcaaccaguuccagaaggcccaggccaucuccguccuccacgagaugauccagcagaccuucaaccucuucuccaccgaggacuccuccgccgccugggagcagucccuccucgagaaguucuccaccgagcucuaccagcagcucaacgaccucgaggccugcgucauccaggaggucggcgucgaggagaccccccucaugaacgaggacuccauccucgccguccgcaaguacuuccagcgcaucacccucuaccucaucgagcgcaaguacucccccugcgccugggaggucguccgcgccgagaucaugcgcucccucuccuucuccaccaaccuccagaagcgccuccgccgcaaggacuga

SEQ ID NO: 3981 - RNA, 570 nt, Artificial Sequence
  derived and/or modified sequence opt3 from IFNalpha__Homo_sapiens__AAH69409
auggcccugagcuucucccuccuuauggcugugcuggucuugucuuacaagucaaucugcaguuuaggcugugaccugccccagacccacagccuagggaacagaagggcacucauucugcuuggacaaaugggucggauauccccuuuuucuugccugaaagaucgccaugacuuccgaaucccacaggaggaauuugauggcaaucaguuccagaaggcccaagcgauuucgguuuugcacgagaugauccagcagacauuuaaccucuucucaacugaagacagcagugcugccugggagcagucccugcuggaaaaauuuucuacggagcucuaucaacaguuaaaugaucuggaggcaugugugauucaggaaguagggguggaggaaaccccgcuuaugaacgaggacagcaucuuggccguccguaaguacuuccagagaauaacacuguaucuaaucgagaggaaauacucccccugcgcuugggaagugguucgggcagagauuaugcgcucacucaguuuuagcacuaaucugcaaaagagacuuaggcggaaggauuga

SEQ ID NO: 3982 - RNA, 570 nt, Artificial Sequence
  derived and/or modified sequence opt4 from IFNalpha__Homo_sapiens__AAH69409
auggcccugagcuucagccugcugauggccgugcuggugcugagcuacaagagcaucugcagccugggcugcgaccugccccagacccacagccugggcaacagaagagcccugauccugcugggccagaugggcagaaucagccccuucagcugccugaaggacagacacgacuucagaaucccccaggaggaguucgacggcaaccaguuccagaaggcccaggccaucagcgugcugcacgagaugauccagcagaccuucaaccuguucagcaccgaggacagcagcgccgccugggagcagagccugcuggagaaguucagcaccgagcuguaccagcagcugaacgaccuggaggccugcgugauccaggaggugggcguggaggagaccccccugaugaacgaggacagcauccuggccgugagaaaguacuuccagagaaucacccuguaccugaucgagagaaaguacagccccugcgccugggagguggugagagccgagaucaugagaagccugagcuucagcaccaaccugcagaagagacugagaagaaaggacuga

SEQ ID NO: 3983 - RNA, 570 nt, Artificial Sequence
  derived and/or modified sequence opt5 from IFNalpha__Homo_sapiens__AAH69409
auggcccugagcuucucccuccugauggcugugcuuguccugucuuacaagagcaucugcucccucggcugugaccugccccagacccacucucuugggaacagacgggcccugauucuccugggacaaaugggccgcaucagcccuuuuuccugccugaaagauagacaugacuuccggauuccgcaggaggaauuugaugggaaucaguuccagaaggcgcaagcuaucucuguucuccacgagaugauucagcagacauuuaaccuguucagcacggaagacuccagcgccgccugggagcagucucuucuggaaaaauuuuccaccgagcucuaucaacagcugaaugaucuugaggcuugugugauccaggaagugggagucgaggaaacaccccugaugaacgaggacagcauccucgccgugcgcaaguacuuccagagaauuacccuguaucugaucgagcggaaauacucuccuugcgcuugggaaguugugcgcgccgagauuaugagaucccucagcuuuucuacaaaucugcaaaagcggcuucgcagaaaggauuga

SEQ ID NO: 3984 - RNA, 570 nt, Artificial Sequence
  derived and/or modified sequence opt6 from IFNalpha__Homo_sapiens__AAH69409
auggcacuaucauucucacuacuaauggcaguacuaguacuaucauacaaauccauaugcucacucggaugcgaccuaccacaaacacacucacuaggaaacagaagagcauuaauacuacuaggacaaaugggaagaauaucaccauucucaugccuaaaagacagacacgacuucagaauaccacaagaagaauucgacggaaaccaauuccaaaaagcacaagccauauccguacuacacgaaaugauacaacaaacauucaacuuauucucaacagaagacagcucagcagcaugggaacaaucacuacuagaaaaauucucaacagaacuauaccaacaauuaaacgaccuagaagcaugcguaauccaagaaguagguguagaagaaacaccacucaugaacgaagacucaauauuagcaguaagaaaauacuuccaaagaaucacacuauacuuaauagaaagaaaauacucaccaugcgcaugggaagucguaagagcagaaauaaugagaucauuaucauucucaacaaaccuacaaaaacgacuaagaagaaaagacuaa

SEQ ID NO: 3985 - protein, 189 aa, Artificial Sequence
  IFNalpha__Homo_sapiens__P01567
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 3986 - RNA, 570 nt, Artificial Sequence
  IFNalpha__Homo_sapiens__AAH74991
auggcccgguccuuuucuuuacugauggucgugcugguacucagcuacaaauccaucugcucucugggcugugaucugccucagacccacagccugcguaauaggagggccuugauacuccuggcacaaaugggaagaaucucuccuuucuccugcuugaaggacagacaugaauucagauucccagaggaggaguuugauggccaccaguuccagaagacucaagccaucucuguccuccaugagaugauccagcagaccuucaaucucuucagcacagaggacucaucugcugcuugggaacagagccuccuagaaaaauuuuccacugaacuuuaccagcaacugaaugaccuggaagcaugugugauacaggagguugggguggaagagacuccccugaugaaugaggacuucauccuggcugugaggaaauacuuccaaagaaucacucuuuaucuaauggagaagaaauacagcccuugugccugggagguugucagagcagaaaucaugagauccuucucuuuuucaacaaacuugaaaaaaggauuaaggaggaaggauuga

SEQ ID NO: 3987 - RNA, 570 nt, Artificial Sequence
  derived and/or modified sequence opt1 from IFNalpha__Homo_sapiens__AAH74991
auggcccgcagcuucucccugcucauggugguccuggugcugagcuacaaguccaucugcagccucggcugcgaccugccccagacccacucccugcggaaccgccgggcccucauccugcuggcgcagauggggcgcaucagcccguucuccugccucaaggaccggcacgaguuccgcuuccccgaggaggaguucgacggccaccaguuccagaagacccaggccaucagcgugcugcacgagaugauccagcagacguucaaccuguucuccaccgaggacagcuccgccgccugggagcagagccuccuggagaaguucuccaccgagcuguaccagcagcucaacgaccuggaggccugcgucauccaggagguggggguggaggagacgccccugaugaacgaggacuucauccucgcgguccggaaguacuuccagcgcaucacccuguaccugauggagaagaaguacagccccugcgccugggagguggugcgggccgagaucaugcgcuccuucagcuucuccaccaaccucaagaagggccugcggcgcaaggacuga

SEQ ID NO: 3988 - RNA, 570 nt, Artificial Sequence
  derived and/or modified sequence opt2 from IFNalpha__Homo_sapiens__AAH74991
auggcccgcuccuucucccuccucauggucguccucguccucuccuacaaguccaucugcucccucggcugcgaccucccccagacccacucccuccgcaaccgccgcgcccucauccuccucgcccagaugggccgcaucucccccuucuccugccucaaggaccgccacgaguuccgcuuccccgaggaggaguucgacggccaccaguuccagaagacccaggccaucuccguccuccacgagaugauccagcagaccuucaaccucuucuccaccgaggacuccuccgccgccugggagcagucccuccucgagaaguucuccaccgagcucuaccagcagcucaacgaccucgaggccugcgucauccaggaggucggcgucgaggagaccccccucaugaacgaggacuucauccucgccguccgcaaguacuuccagcgcaucacccucuaccucauggagaagaaguacucccccugcgccugggaggucguccgcgccgagaucaugcgcuccuucuccuucuccaccaaccucaagaagggccuccgccgcaaggacuga

SEQ ID NO: 3989 - RNA, 570 nt, Artificial Sequence
  derived and/or modified sequence opt3 from IFNalpha__Homo_sapiens__AAH74991
auggccaggagcuucucccugcucauggugguccuuguucugucuuacaagucaaucugcaguuugggcugugacuuaccccagacccacagccugagaaaccggcgcgcucuaauucuccuggcacaaauggggcgaauauccccuuuuucuugccuuaaagaucgucaugaguucagauuuccagaagaggaguucgacggacaccaguuucagaagacacaggccaucucggugcugcaugaaaugauucaacagacuuucaauuuguuuucaacggaagauagcagugcggcuugggagcagucccuccuggagaaauucucuaccgaacuguaucagcaacucaacgacuuagaggccuguguaauccaggaagugggugucgaggagacaccgcugaugaaugaagauuuuauucuugcagugaggaaguacuuccagcggaucacuuuguaucugauggagaaaaaguacagccccugcgccugggaaguugugcgcgcugagauaaugagauccuuuucauucaguaccaaccuaaagaaaggccucaggcggaaggacuga

SEQ ID NO: 3990 - RNA, 570 nt, Artificial Sequence
  derived and/or modified sequence opt4 from IFNalpha__Homo_sapiens__AAH74991
auggccagaagcuucagccugcugaugguggugcuggugcugagcuacaagagcaucugcagccugggcugcgaccugccccagacccacagccugagaaacagaagagcccugauccugcuggcccagaugggcagaaucagccccuucagcugccugaaggacagacacgaguucagauuccccgaggaggaguucgacggccaccaguuccagaagacccaggccaucagcgugcugcacgagaugauccagcagaccuucaaccuguucagcaccgaggacagcagcgccgccugggagcagagccugcuggagaaguucagcaccgagcuguaccagcagcugaacgaccuggaggccugcgugauccaggaggugggcguggaggagaccccccugaugaacgaggacuucauccuggccgugagaaaguacuuccagagaaucacccuguaccugauggagaagaaguacagccccugcgccugggagguggugagagccgagaucaugagaagcuucagcuucagcaccaaccugaagaagggccugagaagaaaggacuga

SEQ ID NO: 3991 - RNA, 570 nt, Artificial Sequence
  derived and/or modified sequence opt5 from IFNalpha__Homo_sapiens__AAH74991
auggcccggagcuucucccugcucauggugguccugguucuuucuuacaagagcaucugcucccugggcugugaccucccccagacccacucucugagaaaccgcagagcucuuauucugcucgcccaaauggggcggaucagcccuuuuuccugccugaaagaucgccaugaguucagauuuccggaagaggaguucgacggacaccaguuucagaagacacaggcgauuucugugcugcaugaaaugauccaacagacguucaaucucuuuagcaccgaagauuccagcgcugccugggagcagucucugcuugagaaauucuccacagaacuguaucagcaacucaacgaccuggaggccugugugauucaggaagucggcguggaggagacaccccuuaugaaugaagauuuuauccuggcuguucggaaguacuuccagcgcaucacccucuaucugauggagaaaaaguacagcccuugcgccugggaaguggucagagcugagauuaugcggucuuuuuccuucagcaccaaccugaagaaagggcuccgcagaaaggacuga

SEQ ID NO: 3992 - RNA, 570 nt, Artificial Sequence
  derived and/or modified sequence opt6 from IFNalpha__Homo_sapiens__AAH74991
auggcacgaagcuucucacuacuaaugguaguacuaguacuaucauacaaaagcauaugcucacucggaugcgaccuaccacaaacacacucacuaagaaacagaagagcacucauacuauuagcacaaaugggacgaauaucaccauucucaugccuaaaagacagacacgaauucagauucccagaagaagaauuugacggacaccaauuucaaaaaacacaagcaauaagcguacuacacgaaaugauacaacaaacauucaacuuauucucaacagaagacagcucagcagcaugggaacaaucacuacuagaaaaauucuccacagaacuauaccaacaacuaaacgaccuagaagcaugcguaauacaagaaguaggaguagaagaaacaccacuaaugaacgaagacuucauauuagcaguaagaaaauacuuccaaagaaucacacuauaccuaauggaaaaaaaauacucaccaugcgcaugggaaguaguaagagcagaaauaaugagaucauucucauucucaacaaacuuaaaaaaaggacuaagaagaaaagacuaa

SEQ ID NO: 3993 - protein, 189 aa, Artificial Sequence
  IFNalpha__Homo_sapiens__P01568
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 3994 - RNA, 570 nt, Artificial Sequence
  IFNalpha__Homo_sapiens__AAA52718
auggcccuguccuuuucuuuacugauggccgugcuggugcucagcuacaaauccaucuguucucugggcugugaucugccucagacccacagccuggguaauaggagggccuugauacuccuggcacaaaugggaagaaucucuccuuucuccugccugaaggacagacaugacuuuggauucccccaggaggaguuugauggcaaccaguuccagaaggcucaagccaucucuguccuccaugagaugauccagcagaccuucaaucucuucagcacaaaggacucaucugcuacuugggaacagagccuccuagaaaaauuuuccacugaacuuaaccagcagcugaaugaccuggaagccugcgugauacaggagguugggguggaagagacuccccugaugaauguggacuccauccuggcugugaagaaauacuuccaaagaaucacucuuuaucugacagagaagaaauacagcccuugugccugggagguugucagagcagaaaucaugagauccuucucuuuaucaaaaauuuuucaagaaagauuaaggaggaaggaauga

SEQ ID NO: 3995 - RNA, 570 nt, Artificial Sequence
  derived and/or modified sequence opt1 from IFNalpha__Homo_sapiens__AAA52718
auggcccugagcuucucccuccugauggccgugcugguccucagcuacaaguccaucugcagccugggcugcgaccugccccagacccacucccucgggaaccgccgggcgcugauccugcucgcccagaugggccgcaucagcccguucuccugccugaaggaccggcacgacuucggguucccccaggaggaguucgacggcaaccaguuccagaaggcccaggccaucagcgugcugcacgagaugauccagcagaccuucaaccucuucuccacgaaggacagcuccgccaccugggagcagagccugcuggagaaguucuccaccgagcucaaccagcagcugaacgaccuggaggcgugcgugauccaggaggucgggguggaggagacgccccucaugaacguggacagcauccuggccgucaagaaguacuuccagcgcaucacccuguaccucaccgagaagaaguacucccccugcgccugggagguggugcgggccgagaucaugcgcagcuucucccugagcaagaucuuccaggagcggcugcgccggaaggaguga

SEQ ID NO: 3996 - RNA, 570 nt, Artificial Sequence
  derived and/or modified sequence opt2 from IFNalpha__Homo_sapiens__AAA52718
auggcccucuccuucucccuccucauggccguccucguccucuccuacaaguccaucugcucccucggcugcgaccucccccagacccacucccucggcaaccgccgcgcccucauccuccucgcccagaugggccgcaucucccccuucuccugccucaaggaccgccacgacuucggcuucccccaggaggaguucgacggcaaccaguuccagaaggcccaggccaucuccguccuccacgagaugauccagcagaccuucaaccucuucuccaccaaggacuccuccgccaccugggagcagucccuccucgagaaguucuccaccgagcucaaccagcagcucaacgaccucgaggccugcgucauccaggaggucggcgucgaggagaccccccucaugaacgucgacuccauccucgccgucaagaaguacuuccagcgcaucacccucuaccucaccgagaagaaguacucccccugcgccugggaggucguccgcgccgagaucaugcgcuccuucucccucuccaagaucuuccaggagcgccuccgccgcaaggaguga

SEQ ID NO: 3997 - RNA, 570 nt, Artificial Sequence
  derived and/or modified sequence opt3 from IFNalpha__Homo_sapiens__AAA52718
auggcccugagcuucucccuccuuauggcugugcuggucuugucuuacaagucaaucugcaguuuaggcugugaccugccccagacccacagccuagggaacagaagggcacucauucugcuugcccaaaugggacggauauccccuuuuucuugccugaaagaucgccaugacuucgguuuuccacaggaggaguucgauggcaaucaguuucagaaggcgcaagcuaucucgguuuugcacgaaaugauucagcagacauucaaccucuuuucaacuaaagacagcagugccacgugggaacagucccugcuggagaaguucucuaccgaacucaaucaacaguuaaacgaucuggaggcaugugugauccaggagguagggguggaagagacaccgcuuaugaaugucgacagcauuuuggccgugaaaaaguauuuucagcgaaucacucuguaccuaaccgaaaagaaauauucccccugcgcuugggagguugugcgugcagagauaaugagaucauucagucucagcaagaucuuucaagaaaggcugcggcgcaaagaguga

SEQ ID NO: 3998 - RNA, 570 nt, Artificial Sequence
  derived and/or modified sequence opt4 from IFNalpha__Homo_sapiens__AAA52718
auggcccugagcuucagccugcugauggccgugcuggugcugagcuacaagagcaucugcagccugggcugcgaccugccccagacccacagccugggcaacagaagagcccugauccugcuggcccagaugggcagaaucagccccuucagcugccugaaggacagacacgacuucggcuucccccaggaggaguucgacggcaaccaguuccagaaggcccaggccaucagcgugcugcacgagaugauccagcagaccuucaaccuguucagcaccaaggacagcagcgccaccugggagcagagccugcuggagaaguucagcaccgagcugaaccagcagcugaacgaccuggaggccugcgugauccaggaggugggcguggaggagaccccccugaugaacguggacagcauccuggccgugaagaaguacuuccagagaaucacccuguaccugaccgagaagaaguacagccccugcgccugggagguggugagagccgagaucaugagaagcuucagccugagcaagaucuuccaggagagacugagaagaaaggaguga

SEQ ID NO: 3999 - RNA, 570 nt, Artificial Sequence
  derived and/or modified sequence opt5 from IFNalpha__Homo_sapiens__AAA52718
auggcccugagcuucucccuccugauggcugugcuuguccugucuuacaagagcaucugcucccucggcugugaccugccccagacccacucucuugggaacagacgggcccugauucuccuggcgcaaaugggacgcaucagcccuuuuuccugccugaaagauagacaugacuucggcuuuccgcaggaggaguucgaugggaaucaguuucagaaggcucaagccauuucuguucuccacgaaaugauccagcagacauucaaccuguuuagcacgaaagacuccagcgccaccugggaacagucucuucuggagaaguucuccacagaacucaaucaacagcugaacgaucuugaggcuugugugauucaggaggugggagucgaagagacaccccugaugaauguggacagcauccucgccguuaaaaaguauuuucagcggaucacccuguaccugaccgaaaagaaauauucuccuugcgcuugggaggugguccgcgccgagauuaugagauccuucagccucucuaagaucuuucaagaacggcugcgcagaaaagaguga

SEQ ID NO: 4000 - RNA, 570 nt, Artificial Sequence
  derived and/or modified sequence opt6 from IFNalpha__Homo_sapiens__AAA52718
auggcacuaucauucucacuccuaauggcaguacucguacuaucauacaaaucaauaugcucacuaggaugcgaccuaccacaaacacacucacucggaaaccgaagagcacuaauacuacuagcacaaaugggacgaauaucaccauucucaugccuaaaagaccgacacgacuucggauuuccacaagaagaauucgauggaaaccaauuccaaaaagcccaagcaauaucaguauuacacgaaaugauacaacaaacauucaaccuauuuucaacaaaagacucaucagcaacaugggaacaaucacuauuagaaaaauucucaacagaacuaaaccaacaacuaaacgaccuagaagcaugcguaauacaagaaguaggaguagaagaaacaccacuaaugaacguagacucaauacuagcaguaaaaaaauacuuccaaagaauaacacuauaccuaacagaaaaaaaauacucacccugcgcaugggaaguaguacgagcagaaauaaugagaucauucucauuaucaaaaauauuucaagaaagacuaagaagaaaagaauaa

SEQ ID NO: 4001 - protein, 189 aa, Artificial Sequence
  IFNalpha__Homo_sapiens__P01569
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 4002 - RNA, 570 nt, Artificial Sequence
  IFNalpha__Homo_sapiens__AAH93755
auggccuugcccuuuguuuuacugauggcccugguggugcucaacugcaagucaaucuguucucugggcugugaucugccucagacccacagccugaguaacaggaggacuuugaugauaauggcacaaaugggaagaaucucuccuuucuccugccugaaggacagacaugacuuuggauuuccucaggaggaguuugauggcaaccaguuccagaaggcucaagccaucucuguccuccaugagaugauccagcagaccuucaaucucuucagcacaaaggacucaucugcuacuugggaugagacacuucuagacaaauucuacacugaacuuuaccagcagcugaaugaccuggaagccuguaugaugcaggagguuggaguggaagacacuccucugaugaauguggacucuauccugacugugagaaaauacuuucaaagaaucacccucuaucugacagagaagaaauacagcccuugugcaugggagguugucagagcagaaaucaugagauccuucucuuuaucagcaaacuugcaagaaagauuaaggaggaaggaauga

SEQ ID NO: 4003 - RNA, 570 nt, Artificial Sequence
  derived and/or modified sequence opt1 from IFNalpha__Homo_sapiens__AAH93755
auggcccugcccuucgugcuccugauggcccuggucgugcucaacugcaagagcaucugcucccugggcugcgaccugccgcagacccacagccucuccaaccgccggacccugaugaucauggcgcagauggggcgcaucagccccuucuccugccugaaggaccggcacgacuucggcuucccccaggaggaguucgacgggaaccaguuccagaaggcccaggccaucagcgugcuccacgagaugauccagcagacguucaaccuguucuccaccaaggacagcuccgccaccugggacgagacccugcucgacaaguucuacacggagcuguaccagcagcugaacgaccucgaggccugcaugaugcaggaggucggcguggaggacacgccccugaugaacguggacagcauccugaccguccgcaaguacuuccagcggaucacccucuaccugaccgagaagaaguacuccccgugcgcgugggagguggugcgcgccgagaucaugcggagcuucucccugagcgccaaccuccaggagcgccugcggcgcaaggaguga

SEQ ID NO: 4004 - RNA, 570 nt, Artificial Sequence
  derived and/or modified sequence opt2 from IFNalpha__Homo_sapiens__AAH93755
auggcccuccccuucguccuccucauggcccucgucguccucaacugcaaguccaucugcucccucggcugcgaccucccccagacccacucccucuccaaccgccgcacccucaugaucauggcccagaugggccgcaucucccccuucuccugccucaaggaccgccacgacuucggcuucccccaggaggaguucgacggcaaccaguuccagaaggcccaggccaucuccguccuccacgagaugauccagcagaccuucaaccucuucuccaccaaggacuccuccgccaccugggacgagacccuccucgacaaguucuacaccgagcucuaccagcagcucaacgaccucgaggccugcaugaugcaggaggucggcgucgaggacaccccccucaugaacgucgacuccauccucaccguccgcaaguacuuccagcgcaucacccucuaccucaccgagaagaaguacucccccugcgccugggaggucguccgcgccgagaucaugcgcuccuucucccucuccgccaaccuccaggagcgccuccgccgcaaggaguga

SEQ ID NO: 4005 - RNA, 570 nt, Artificial Sequence
  derived and/or modified sequence opt3 from IFNalpha__Homo_sapiens__AAH93755
auggcccugcccuucgugcuccuuauggcucuggucguuuugaacugcaagagcaucuguuccuuaggcugcgaccugccucagacccacucucuaucaaauagaaggacacucaugauuauggcacaaauggggcggauaaguccauuuagcugucugaaagaucgccaugacuucggauuuccgcaggaggaguucgaugguaaccaguuucagaaggcccaagcgaucuccgugcuucacgaaaugauucagcagacuuucaaucuguuuucuacgaaagacucgucagcuaccugggaugaaacauugcucgacaaguucuacacugagcuguaucagcaacugaacgaucucgaagccugcaugaugcaggagguaggcguggaggacacccccuuaaugaaugucgauagcauccugacagugcgaaaauacuuucagcguauuacccuuuauuugacugaaaagaaguacaguccuugugcaugggagguugugagagccgaaaucaugagguccuucucucugagcgcuaaccuacaggagcggcuccgcagaaaagaguga

SEQ ID NO: 4006 - RNA, 570 nt, Artificial Sequence
  derived and/or modified sequence opt4 from IFNalpha__Homo_sapiens__AAH93755
auggcccugcccuucgugcugcugauggcccugguggugcugaacugcaagagcaucugcagccugggcugcgaccugccccagacccacagccugagcaacagaagaacccugaugaucauggcccagaugggcagaaucagccccuucagcugccugaaggacagacacgacuucggcuucccccaggaggaguucgacggcaaccaguuccagaaggcccaggccaucagcgugcugcacgagaugauccagcagaccuucaaccuguucagcaccaaggacagcagcgccaccugggacgagacccugcuggacaaguucuacaccgagcuguaccagcagcugaacgaccuggaggccugcaugaugcaggaggugggcguggaggacaccccccugaugaacguggacagcauccugaccgugagaaaguacuuccagagaaucacccuguaccugaccgagaagaaguacagccccugcgccugggagguggugagagccgagaucaugagaagcuucagccugagcgccaaccugcaggagagacugagaagaaaggaguga

SEQ ID NO: 4007 - RNA, 570 nt, Artificial Sequence
  derived and/or modified sequence opt5 from IFNalpha__Homo_sapiens__AAH93755
auggcccugcccuucgugcuccugauggcucuugucguucugaacugcaagagcaucuguucccucggcugcgaccugccucagacccacucucuuagcaauagacggacacugaugauuauggcccaaauggggcgcaucuccccguuuucuugucucaaagauagacaugacuucggauuuccccaggaggaguucgauggcaaccaguuucagaaggcgcaagcuauuagcgugcugcacgaaaugauccagcagacguucaaucuguuuuccaccaaagacucuagcgccacaugggaugaaacccuccuggacaaguucuacacagagcuuuaucagcaacugaacgaucucgaagccugcaugaugcaggaggugggggucgaggacaccccucugaugaauguggauuccauucuuacaguucggaaauacuuucagcgcaucacccuguaucucacggaaaagaaguacagccccugugcuugggagguggucagagccgaaaucaugcggucuuucucccugagcgcuaaccugcaggagcgccucagacggaaagaguga

SEQ ID NO: 4008 - RNA, 570 nt, Artificial Sequence
  derived and/or modified sequence opt6 from IFNalpha__Homo_sapiens__AAH93755
auggcacuaccauucguacuacuaauggcacuaguaguacucaauugcaaaucaauaugcucacuaggaugcgacuuaccacaaacacacucacuaucaaacagaagaacacuaaugauaauggcacaaaugggacgaauaagcccauucucaugccuaaaagacagacacgauuucggauucccacaagaagaauucgacggaaaccaauuccaaaaagcacaagcaauaucaguauuacacgaaaugauacaacaaacauucaaccuauucucaacaaaagacucaucagcaacaugggacgaaacacuucuagacaaauucuacacagaacuauaucaacaacuaaacgaccuagaagcaugcaugaugcaagaaguaggaguagaagacacaccacuaaugaacguagacucaauucuaacaguacgaaaauacuuccaaagaauaacacuauacuuaacagaaaaaaaauacucaccaugcgcaugggaaguaguaagagccgaaauaaugagaucauucucacuaucagcaaaccuacaagaaagacuaagaagaaaagaauaa

SEQ ID NO: 4009 - protein, 189 aa, Artificial Sequence
  IFNalpha__Homo_sapiens__P01570
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 4010 - RNA, 570 nt, Artificial Sequence
  IFNalpha__Homo_sapiens__AAH74956
auggcauugcccuuugcuuuaaugauggcccugguggugcucagcugcaagucaagcugcucucugggcuguaaucugucucaaacccacagccugaauaacaggaggacuuugaugcucauggcacaaaugaggagaaucucuccuuucuccugccugaaggacagacaugacuuugaauuuccccaggaggaauuugauggcaaccaguuccagaaagcucaagccaucucuguccuccaugagaugaugcagcagaccuucaaucucuucagcacaaagaacucaucugcugcuugggaugagacccuccuagaaaaauucuacauugaacuuuuccagcaaaugaaugaccuggaagccugugugauacaggagguugggguggaagagacuccccugaugaaugaggacuccauccuggcugugaagaaauacuuccaaagaaucacucuuuaucugauggagaagaaauacagcccuugugccugggagguugucagagcagaaaucaugagaucccucucuuuuucaacaaacuugcaaaaaagauuaaggaggaaggauuga

SEQ ID NO: 4011 - RNA, 570 nt, Artificial Sequence
  derived and/or modified sequence opt1 from IFNalpha__Homo_sapiens__AAH74956
auggcccugcccuucgcccucaugauggcgcuggugguccugagcugcaaguccagcugcucccucggcugcaaccugagccagacccacucccugaacaaccgccggacccucaugcugauggcccagaugcgccggaucagcccguucuccugccugaaggaccgccacgacuucgaguucccccaggaggaguucgacgggaaccaguuccagaaggcccaggccaucagcgugcuccacgagaugaugcagcagacguucaaccuguucuccaccaagaacagcuccgccgcgugggacgagacccugcucgagaaguucuacaucgagcuguuccagcagaugaacgaccuggaggccugcgugauccaggaggucggcguggaggagacgccccucaugaacgaggacagcauccuggccgugaagaaguacuuccagcggaucacccuguaccucauggagaagaaguacucccccugcgccugggaggucgugcgcgcggagaucaugcggagccuguccuucagcaccaaccugcagaagcgccuccggcgcaaggacuga

SEQ ID NO: 4012 - RNA, 570 nt, Artificial Sequence
  derived and/or modified sequence opt2 from IFNalpha__Homo_sapiens__AAH74956
auggcccuccccuucgcccucaugauggcccucgucguccucuccugcaaguccuccugcucccucggcugcaaccucucccagacccacucccucaacaaccgccgcacccucaugcucauggcccagaugcgccgcaucucccccuucuccugccucaaggaccgccacgacuucgaguucccccaggaggaguucgacggcaaccaguuccagaaggcccaggccaucuccguccuccacgagaugaugcagcagaccuucaaccucuucuccaccaagaacuccuccgccgccugggacgagacccuccucgagaaguucuacaucgagcucuuccagcagaugaacgaccucgaggccugcgucauccaggaggucggcgucgaggagaccccccucaugaacgaggacuccauccucgccgucaagaaguacuuccagcgcaucacccucuaccucauggagaagaaguacucccccugcgccugggaggucguccgcgccgagaucaugcgcucccucuccuucuccaccaaccuccagaagcgccuccgccgcaaggacuga

SEQ ID NO: 4013 - RNA, 570 nt, Artificial Sequence
  derived and/or modified sequence opt3 from IFNalpha__Homo_sapiens__AAH74956
auggcccugcccuucgcucucaugauggcacuugugguccugagcugcaaguccucuuguucauugggcugcaacuuaagucagacccacagccugaauaacagaaggacacuaaugcucauggcccaaaugcggcgcaucuccccuuuuucuugucugaaagaccgacaugauuucgaguuuccacaggaagaguucgacgggaaucaguuucagaaggcgcaagcuauuucgguucuucacgaaaugaugcagcagacuuucaaccuguuuucaacgaaaaauagcagugccgcaugggaugagaccuugcucgaaaaguucuacauagagcuguuucagcaaaugaacgaccuggaggccugcgugauccaggaaguaggaguggaggaaacaccgcucaugaaugaggauuccauuuuagcugucaaaaaguauuuccagcguaucacucuguaccuuauggagaagaaauauucucccugugcaugggaagugguuagagccgagauuaugaggagcuuguccuuuucaaccaaccugcagaagcggcuacgcagaaaagacuga

SEQ ID NO: 4014 - RNA, 570 nt, Artificial Sequence
  derived and/or modified sequence opt4 from IFNalpha__Homo_sapiens__AAH74956
auggcccugcccuucgcccugaugauggcccugguggugcugagcugcaagagcagcugcagccugggcugcaaccugagccagacccacagccugaacaacagaagaacccugaugcugauggcccagaugagaagaaucagccccuucagcugccugaaggacagacacgacuucgaguucccccaggaggaguucgacggcaaccaguuccagaaggcccaggccaucagcgugcugcacgagaugaugcagcagaccuucaaccuguucagcaccaagaacagcagcgccgccugggacgagacccugcuggagaaguucuacaucgagcuguuccagcagaugaacgaccuggaggccugcgugauccaggaggugggcguggaggagaccccccugaugaacgaggacagcauccuggccgugaagaaguacuuccagagaaucacccuguaccugauggagaagaaguacagccccugcgccugggagguggugagagccgagaucaugagaagccugagcuucagcaccaaccugcagaagagacugagaagaaaggacuga

SEQ ID NO: 4015 - RNA, 570 nt, Artificial Sequence
  derived and/or modified sequence opt5 from IFNalpha__Homo_sapiens__AAH74956
auggcccugcccuucgcucucaugauggcccuggugguccuuagcugcaaguccucuuguagccugggcugcaaccucucccagacccacucucugaauaacagacggacacuuaugcugauggcgcaaaugcgcagaaucagcccuuuuuccugucucaaagaccggcaugauuucgaguuuccgcaggaagaguucgacgggaaucaguuucagaaggcucaagccauuucuguucugcacgaaaugaugcagcagacguucaaccuguuuagcaccaaaaauuccagcgccgcuugggaugagacacuccuggaaaaguucuacaucgagcuuuuucagcaaaugaacgaccuggaggccugcgugauucaggaagugggagucgaggaaacaccccucaugaaugaggauucuauccuggcugugaaaaaguauuuccagcgcauuacccuuuaccugauggagaagaaauauuccccuugugccugggaaguugugagagcggagaucaugcggagccucucuuuuuccaccaaccugcagaagcgccugagacggaaagacuga

SEQ ID NO: 4016 - RNA, 570 nt, Artificial Sequence
  derived and/or modified sequence opt6 from IFNalpha__Homo_sapiens__AAH74956
auggcacuaccauucgcacuaaugauggcacuaguaguacuaucaugcaaaucaucaugcucacuaggaugcaaccuaucacaaacacacucacucaacaacagaagaacacuaauguuaauggcacaaaugagaagaauaucaccauucucaugccuaaaagacagacacgacuucgaauucccacaagaagaauucgacggaaaccaauuccaaaaagcacaagcaauaucaguacuacacgaaaugaugcaacaaacauucaaccuauucucaacaaaaaacucaucagcagcaugggacgaaacacuauuagaaaaauucuacauagaacuauuccaacaaaugaacgaccuagaagcaugcguaauacaagaaguaggaguagaagaaacaccauuaaugaacgaagacucaauacuagcaguaaaaaaauacuuccaaagaauaacacuauaccuaauggaaaaaaaauacagcccaugcgcaugggaagucguaagagcagaaauaaugagaagccuaagcuucagcacuaaccuacaaaaaagacuacgaagaaaagacuaa

SEQ ID NO: 4017 - protein, 189 aa, Artificial Sequence
  IFNalpha__Homo_sapiens__P01571
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 4018 - RNA, 570 nt, Artificial Sequence
  IFNalpha__Homo_sapiens__AAA52725
auggcccuguccuuuucuuuacugauggccgugcuggugcucagcuacaaauccaucuguucucuaggcugugaucugccucagacccacagccuggguaauaggagggccuugauacuccuggcacaaaugggaagaaucucuccuuucuccugccugaaggacagacaugacuuuggacuuccccaggaggaguuugauggcaaccaguuccagaagacucaagccaucucuguccuccaugagaugauccagcagaccuucaaucucuucagcacagaggacucaucugcugcuugggaacagagccuccuagaaaaauuuuccacugaacuuuaccagcaacugaauaaccuggaagcaugugugauacaggagguugggauggaagagacuccccugaugaaugaggacuccauccuggcugugaggaaauacuuccaaagaaucacucuuuaucuaacagagaagaaauacagcccuugugccugggagguugucagagcagaaaucaugagaucccucucuuuuucaacaaacuugcaaaaaauauuaaggaggaaggauuga

SEQ ID NO: 4019 - RNA, 570 nt, Artificial Sequence
  derived and/or modified sequence opt1 from IFNalpha__Homo_sapiens__AAA52725
auggcccugagcuucucccuccugauggccgugcugguccucagcuacaaguccaucugcagccugggcugcgaccugccccagacccacucccucgggaaccgccgggcgcugauccugcucgcccagaugggccgcaucagcccguucuccugccugaaggaccggcacgacuucgggcugccccaggaggaguucgacggcaaccaguuccagaagacccaggccaucagcgugcuccacgagaugauccagcagacguucaaccuguucuccaccgaggacagcuccgccgccugggagcagagccugcucgagaaguucuccaccgagcuguaccagcagcugaacaaccucgaggcgugcgugauccaggaggucgggauggaggagacgccccugaugaacgaggacagcauccuggccgugcgcaaguacuuccagcggaucacccucuaccugaccgagaagaaguacucccccugcgccugggaggugguccgcgccgagaucaugcggagccuguccuucagcaccaaccuccagaagauccugcgccggaaggacuga

SEQ ID NO: 4020 - RNA, 570 nt, Artificial Sequence
  derived and/or modified sequence opt2 from IFNalpha__Homo_sapiens__AAA52725
auggcccucuccuucucccuccucauggccguccucguccucuccuacaaguccaucugcucccucggcugcgaccucccccagacccacucccucggcaaccgccgcgcccucauccuccucgcccagaugggccgcaucucccccuucuccugccucaaggaccgccacgacuucggccucccccaggaggaguucgacggcaaccaguuccagaagacccaggccaucuccguccuccacgagaugauccagcagaccuucaaccucuucuccaccgaggacuccuccgccgccugggagcagucccuccucgagaaguucuccaccgagcucuaccagcagcucaacaaccucgaggccugcgucauccaggaggucggcauggaggagaccccccucaugaacgaggacuccauccucgccguccgcaaguacuuccagcgcaucacccucuaccucaccgagaagaaguacucccccugcgccugggaggucguccgcgccgagaucaugcgcucccucuccuucuccaccaaccuccagaagauccuccgccgcaaggacuga

SEQ ID NO: 4021 - RNA, 570 nt, Artificial Sequence
  derived and/or modified sequence opt3 from IFNalpha__Homo_sapiens__AAA52725
auggcccugagcuucucccuccuuauggcugugcuggucuugucuuacaagucaaucugcaguuuaggcugugaccugccccagacccacagccuagggaacagaagggcacucauucugcuugcccaaaugggacggauauccccuuuuucuugccugaaagaucgccaugacuucgguuugccacaggaggaauuugauggcaaucaguuccagaagacacaagcgaucucgguucuccacgagaugauucagcagacuuuuaaccuguucucaacggaagacagcagugcugccugggagcagucccugcucgaaaaauuuucuaccgaguuauaucaacagcugaauaaccuugaggcaugugugauccaggaaguagggauggaggaaacaccguugaugaaugaggauagcauucuggccgugcgaaaguacuuccagcguaucacucuauaucucaccgagaaaaaguacucccccugcgcuugggaagucgugagagcagagauaaugaggucacugaguuuuagcacaaaccuucaaaagauccugcggcgcaaagacuga

SEQ ID NO: 4022 - RNA, 570 nt, Artificial Sequence
  derived and/or modified sequence opt4 from IFNalpha__Homo_sapiens__AAA52725
auggcccugagcuucagccugcugauggccgugcuggugcugagcuacaagagcaucugcagccugggcugcgaccugccccagacccacagccugggcaacagaagagcccugauccugcuggcccagaugggcagaaucagccccuucagcugccugaaggacagacacgacuucggccugccccaggaggaguucgacggcaaccaguuccagaagacccaggccaucagcgugcugcacgagaugauccagcagaccuucaaccuguucagcaccgaggacagcagcgccgccugggagcagagccugcuggagaaguucagcaccgagcuguaccagcagcugaacaaccuggaggccugcgugauccaggaggugggcauggaggagaccccccugaugaacgaggacagcauccuggccgugagaaaguacuuccagagaaucacccuguaccugaccgagaagaaguacagccccugcgccugggagguggugagagccgagaucaugagaagccugagcuucagcaccaaccugcagaagauccugagaagaaaggacuga

SEQ ID NO: 4023 - RNA, 570 nt, Artificial Sequence
  derived and/or modified sequence opt5 from IFNalpha__Homo_sapiens__AAA52725
auggcccugagcuucucccuccugauggcugugcuuguccugucuuacaagagcaucugcucccucggcugugaccugccccagacccacucucuugggaacagacgggcccugauucuccuggcgcaaaugggacgcaucagcccuuuuuccugccugaaagauagacaugacuucggccucccgcaggaggaauuugaugggaaucaguuccagaagacacaagcuauuucuguucugcacgagaugauccagcagacguuuaaccuuuucagcaccgaagacuccagcgccgccugggagcagucucugcucgaaaaauuuuccacagagcuguaucaacagcuuaauaaccuggaggcuugugugauucaggaagugggaauggaggaaacaccccucaugaaugaggauagcauccuggccguccggaaguacuuccagcgcaucacccuguaucucaccgagaaaaaguacucuccuugcgcuugggaagugguuagagccgagauuaugcggucccugagcuuuucuacaaaccuucaaaagauccugcgcagaaaagacuga

SEQ ID NO: 4024 - RNA, 570 nt, Artificial Sequence
  derived and/or modified sequence opt6 from IFNalpha__Homo_sapiens__AAA52725
auggcacuaucauucucacuacuaauggcaguacucguacuaucauacaaaucaauaugcucacucggaugcgaccuaccacaaacacacucauuaggaaacagaagagcacucauacuacuagcacaaaugggaagaauaucaccauucucaugccuaaaagacagacaugacuucggauuaccacaagaagaauucgacggaaaccaauuccaaaaaacacaagcaauaucaguacuccacgaaaugauacaacaaacauucaacuuauucucaacagaagacucaucagcagcaugggaacaaucacuacuagaaaaauucucaacagaacuauaccaacaacuaaacaaccuagaagcaugcguaauacaagaaguaggcauggaagaaacaccacuaaugaacgaagacucaauacuagcaguaagaaaauacuuccaaagaauaacacuauacuuaacagaaaaaaaauauucaccaugcgcaugggaaguaguacgcgcagaaauaaugagaagccuaagcuucuccacaaaccuacaaaaaauauuaagaagaaaagacuaa

SEQ ID NO: 4025 - protein, 189 aa, Artificial Sequence
  IFNalpha__Homo_sapiens__P05013
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 4026 - RNA, 570 nt, Artificial Sequence
  IFNalpha__Homo_sapiens__AAH69471
auggcuuugccuuuugcuuuacugauggcccugguggugcucagcugcaagucaagcugcucucuggacugugaucugccucagacccacagccugggucacaggaggaccaugaugcuccuggcacaaaugaggagaaucucucuuuucuccugucugaaggacagacaugacuucagauuuccccaggaggaguuugauggcaaccaguuccagaaggcugaagccaucucuguccuccaugaggugauucagcagaccuucaaccucuucagcacaaaggacucaucuguugcuugggaugagaggcuucuagacaaacucuauacugaacuuuaccagcagcugaaugaccuggaagccugugugaugcaggaggugugggugggagggacuccccugaugaaugaggacuccauccuggcugugagaaaauacuuccaaagaaucacucucuaccugacagagaaaaaguacagcccuugugccugggagguugucagagcagaaaucaugagauccuucucuucaucaagaaacuugcaagaaagguuaaggaggaaggaauaa

SEQ ID NO: 4027 - RNA, 570 nt, Artificial Sequence
  derived and/or modified sequence opt1 from IFNalpha__Homo_sapiens__AAH69471
auggcccugcccuucgcccuccugauggcgcuggugguccucagcugcaaguccagcugcucccuggacugcgaccugccgcagacccacagccucggccaccgccggaccaugaugcugcuggcccagaugcgccggaucucccucuucagcugccugaaggaccgccacgacuuccgguucccccaggaggaguucgacgggaaccaguuccagaaggccgaggccaucuccgugcugcacgaggugauccagcagacguucaaccucuucagcaccaaggacuccagcgucgccugggacgagcgccugcuggacaagcucuacaccgagcuguaccagcagcugaacgaccucgaggcgugcgugaugcaggaggugugggucggcgggacgccccugaugaacgaggacuccauccuggccgugcggaaguacuuccagcgcaucacccucuaccugaccgagaagaaguacagccccugcgccugggaggugguccgggccgagaucaugcgcuccuucagcuccagccggaaccugcaggagcgccuccggcgcaaggaguga

SEQ ID NO: 4028 - RNA, 570 nt, Artificial Sequence
  derived and/or modified sequence opt2 from IFNalpha__Homo_sapiens__AAH69471
auggcccuccccuucgcccuccucauggcccucgucguccucuccugcaaguccuccugcucccucgacugcgaccucccccagacccacucccucggccaccgccgcaccaugaugcuccucgcccagaugcgccgcaucucccucuucuccugccucaaggaccgccacgacuuccgcuucccccaggaggaguucgacggcaaccaguuccagaaggccgaggccaucuccguccuccacgaggucauccagcagaccuucaaccucuucuccaccaaggacuccuccgucgccugggacgagcgccuccucgacaagcucuacaccgagcucuaccagcagcucaacgaccucgaggccugcgucaugcaggaggucugggucggcggcaccccccucaugaacgaggacuccauccucgccguccgcaaguacuuccagcgcaucacccucuaccucaccgagaagaaguacucccccugcgccugggaggucguccgcgccgagaucaugcgcuccuucuccuccucccgcaaccuccaggagcgccuccgccgcaaggaguga

SEQ ID NO: 4029 - RNA, 570 nt, Artificial Sequence
  derived and/or modified sequence opt3 from IFNalpha__Homo_sapiens__AAH69471
auggcccugcccuucgcucuccuuauggcacugguggucuugagcugcaaguccucuuguucauuagacugcgaucugccucagacccacagucuaggccauagaaggacaaugaugcuccuggcccaaaugcggcgcaucagccuuuucuccugucugaaagaccgacacgauuuccguuuuccacaggaggaauuugacgggaaccaguuucagaaggcggaggcuauuucuguuuugcaugaagugauacaacagacuuucaaucucuuuucgacgaaagauucaagcguagccugggacgagagacugcuggauaagcucuacaccgaauuauaucagcagcugaacgaccuugaggcaugcgugaugcaagaggucugggugggagguacaccguugaugaaugaagauaguauccuggccguuaggaaauacuuccagcggauuacucuauaucucaccgagaagaaguacucccccugugcuugggaagugguccgcgcagagaucaugagaucuuuuagcuccucaaggaaccugcaggagcggcuucgccgaaaagaauga

SEQ ID NO: 4030 - RNA, 570 nt, Artificial Sequence
  derived and/or modified sequence opt4 from IFNalpha__Homo_sapiens__AAH69471
auggcccugcccuucgcccugcugauggcccugguggugcugagcugcaagagcagcugcagccuggacugcgaccugccccagacccacagccugggccacagaagaaccaugaugcugcuggcccagaugagaagaaucagccuguucagcugccugaaggacagacacgacuucagauucccccaggaggaguucgacggcaaccaguuccagaaggccgaggccaucagcgugcugcacgaggugauccagcagaccuucaaccuguucagcaccaaggacagcagcguggccugggacgagagacugcuggacaagcuguacaccgagcuguaccagcagcugaacgaccuggaggccugcgugaugcaggaggugugggugggcggcaccccccugaugaacgaggacagcauccuggccgugagaaaguacuuccagagaaucacccuguaccugaccgagaagaaguacagccccugcgccugggagguggugagagccgagaucaugagaagcuucagcagcagcagaaaccugcaggagagacugagaagaaaggaguga

SEQ ID NO: 4031 - RNA, 570 nt, Artificial Sequence
  derived and/or modified sequence opt5 from IFNalpha__Homo_sapiens__AAH69471
auggcccugcccuucgcucuccugauggcccuugugguccugagcugcaaguccucuuguagccucgacugcgaucugccucagacccacucccuuggccauagacggacaaugaugcugcucgcgcaaaugcgcagaaucucucuguuuagcugucugaaagaccggcacgauuuccgcuuuccgcaggaggaguucgacgggaaccaguuucagaaggcugaagccauuuccguucuccaugaagugauccaacagacguucaaucuguuuucuaccaaagauagcuccguggccugggacgagagacuucuggauaagcucuacacagaacuguaucagcagcuuaacgaccuggaggcuugcgucaugcaagagguguggguuggaggcacaccccucaugaaugaagauagcauucuggccgugcggaaauacuuccagcgcaucacccuguaucucaccgagaagaaguacucuccuugugcuugggaagucgugagagccgagauuaugcgguccuuuucuagcucccgcaaccugcaggagagacuucggcgcaaagaauga

SEQ ID NO: 4032 - RNA, 570 nt, Artificial Sequence
  derived and/or modified sequence opt6 from IFNalpha__Homo_sapiens__AAH69471
auggcauuaccauucgcacuacuaauggcauuaguaguauuaucauguaaaagcucaugcucacuagacugcgaccuaccacaaacacacucauuaggacacagaagaacaaugaugcuccuagcacaaaugagaagaauaucacuauucucaugcuuaaaagacagacacgacuucagauucccacaagaagaauucgacggaaaccaauuccaaaaagcagaagcaauaucaguauuacacgaaguaauacaacaaacauucaaccuauucucaacaaaagacucaucugucgcaugggacgaaagacuacuagacaaacuauacacagaauuauaccaacaacuaaacgacuuagaagcaugcguaaugcaagaaguauggguaggaggaacaccacuaaugaacgaagacucaauacuagcaguaagaaaauacuuccaaagaauaaccuuauaccuaacagaaaaaaaauacucaccaugugcaugggaaguaguaagagcagaaauaaugagaucauucucaucaucaagaaaucuacaagaaagacuacgaagaaaagaauaa

SEQ ID NO: 4033 - protein, 189 aa, Artificial Sequence
  IFNalpha__Homo_sapiens__P05014
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 4034 - RNA, 570 nt, Artificial Sequence
  IFNalpha__Homo_sapiens__AAA52726
auggcccuguccuuuucuuuacugauggccgugcuggugcucagcuacaaauccaucuguucucugggcugugaucugccucagacccacagccuggguaauaggagggccuugauacuccuggcacaaaugggaagaaucucucauuucuccugccugaaggacagacaugauuucggauuccccgaggaggaguuugauggccaccaguuccagaaggcucaagccaucucuguccuccaugagaugauccagcagaccuucaaucucuucagcacagaggacucaucugcugcuugggaacagagccuccuagaaaaauuuuccacugaacuuuaccagcaacugaaugaccuggaagcaugugugauacaggagguugggguggaagagacuccccugaugaaugaggacuccauccuggcugugaggaaauacuuccaaagaaucacucuuuaucuaacagagaagaaauacagcccuugugccugggagguugucagagcagaaaucaugagaucccucucguuuucaacaaacuugcaaaaaagauuaaggaggaaggauuga

SEQ ID NO: 4035 - RNA, 570 nt, Artificial Sequence
  derived and/or modified sequence opt1 from IFNalpha__Homo_sapiens__AAA52726
auggcccugagcuucucccuccugauggccgugcugguccucagcuacaaguccaucugcagccugggcugcgaccugccccagacccacucccucgggaaccgccgggcgcugauccugcucgcccagaugggccgcaucagccacuucuccugccugaaggaccggcacgacuucggguucccggaggaggaguucgacggccaccaguuccagaaggcccaggccaucagcgugcugcacgagaugauccagcagaccuucaaccucuucuccacggaggacagcuccgccgcgugggagcagagccugcuggagaaguucuccaccgagcucuaccagcagcugaacgaccuggaggccugcgugauccaggaggucgggguggaggagacgccccucaugaacgaggacagcauccuggccgugcgcaaguacuuccagcggaucacccuguaccucaccgagaagaaguacucccccugcgccugggaggucgugcgcgcggagaucaugcggagccuguccuucagcaccaaccugcagaagcgccuccggcgcaaggacuga

SEQ ID NO: 4036 - RNA, 570 nt, Artificial Sequence
  derived and/or modified sequence opt2 from IFNalpha__Homo_sapiens__AAA52726
auggcccucuccuucucccuccucauggccguccucguccucuccuacaaguccaucugcucccucggcugcgaccucccccagacccacucccucggcaaccgccgcgcccucauccuccucgcccagaugggccgcaucucccacuucuccugccucaaggaccgccacgacuucggcuuccccgaggaggaguucgacggccaccaguuccagaaggcccaggccaucuccguccuccacgagaugauccagcagaccuucaaccucuucuccaccgaggacuccuccgccgccugggagcagucccuccucgagaaguucuccaccgagcucuaccagcagcucaacgaccucgaggccugcgucauccaggaggucggcgucgaggagaccccccucaugaacgaggacuccauccucgccguccgcaaguacuuccagcgcaucacccucuaccucaccgagaagaaguacucccccugcgccugggaggucguccgcgccgagaucaugcgcucccucuccuucuccaccaaccuccagaagcgccuccgccgcaaggacuga

SEQ ID NO: 4037 - RNA, 570 nt, Artificial Sequence
  derived and/or modified sequence opt3 from IFNalpha__Homo_sapiens__AAA52726
auggcccugagcuucucccuccuuauggcugugcuggucuugucuuacaagucaaucugcaguuuaggcugugaccugccccagacccacagccuagggaacagaagggcacucauucugcuugcccaaaugggacggauaucccauuuuucuugccugaaagaucgccacgacuucgguuuuccugaggaagaguucgauggccaucaguuucagaaggcgcaggcuaucucgguuuugcacgaaaugauucaacagacauucaaucucuuuucaacugaggacagcagugccgcaugggaacagucccugcuggagaaauucucuacggagcucuaucagcaauuaaacgaucuggaagccugugugauccaggagguagggguggaagagaccccacuuaugaaugaggacagcauuuuggcuguccgaaaguacuuucagcguaucacacuguaucuaacugagaaaaaguacuccccgugcgcaugggaagugguuagagccgaaauaaugaggucacucaguuucagcaccaaccugcagaagcggcuucgcagaaaagauuga

SEQ ID NO: 4038 - RNA, 570 nt, Artificial Sequence
  derived and/or modified sequence opt4 from IFNalpha__Homo_sapiens__AAA52726
auggcccugagcuucagccugcugauggccgugcuggugcugagcuacaagagcaucugcagccugggcugcgaccugccccagacccacagccugggcaacagaagagcccugauccugcuggcccagaugggcagaaucagccacuucagcugccugaaggacagacacgacuucggcuuccccgaggaggaguucgacggccaccaguuccagaaggcccaggccaucagcgugcugcacgagaugauccagcagaccuucaaccuguucagcaccgaggacagcagcgccgccugggagcagagccugcuggagaaguucagcaccgagcuguaccagcagcugaacgaccuggaggccugcgugauccaggaggugggcguggaggagaccccccugaugaacgaggacagcauccuggccgugagaaaguacuuccagagaaucacccuguaccugaccgagaagaaguacagccccugcgccugggagguggugagagccgagaucaugagaagccugagcuucagcaccaaccugcagaagagacugagaagaaaggacuga

SEQ ID NO: 4039 - RNA, 570 nt, Artificial Sequence
  derived and/or modified sequence opt5 from IFNalpha__Homo_sapiens__AAA52726
auggcccugagcuucucccuccugauggcugugcuuguccugucuuacaagagcaucugcucccucggcugugaccugccccagacccacucucuugggaacagacgggcccugauucuccuggcgcaaaugggacgcaucagccauuuuuccugccugaaagauagacacgacuucggcuuuccugaggaagaguucgaugggcaucaguuucagaaggcucaggccauuucuguucuccacgaaaugauccaacagacauucaaucuguuuagcacggaggacuccagcgccgcuugggaacagucucuucuggagaaauucuccaccgagcucuaucagcaacugaacgaucuugaagccugugugauucaggaggugggagucgaagagacaccgcugaugaaugaggacagcauccucgcugugcggaaguacuuucagcgcaucacccuguaucugacagagaaaaaguacucucccugcgccugggaaguugugagagcggaaauuaugcggucccucagcuucucuaccaaccugcagaagcgccuuagacggaaagauuga

SEQ ID NO: 4040 - RNA, 570 nt, Artificial Sequence
  derived and/or modified sequence opt6 from IFNalpha__Homo_sapiens__AAA52726
auggcauuaagcuucucacuacucauggccguacuaguacuaucauacaaaucaauaugcucacuaggaugcgaucuaccacaaacacacucccuaggaaacagaagagcacuaauacuccuagcacaaaugggacgaauaagccacuucucaugccuaaaagacagacacgacuucggauucccagaagaagaauucgacggacaccaauuccaaaaagcacaagcaauaucaguacuacacgaaaugauacaacaaacauucaaccucuucucaacagaagacucaucagcagcaugggaacaaucacuacuagaaaaauucucaacagaacuauaccaacaacuaaacgaccuagaagcaugcguaauacaagaaguaggaguagaagaaacaccacuaaugaacgaagacucaauacuagcaguaagaaaauacuuccaaagaauaacacuauaccuaaccgaaaaaaaauacucaccaugcgcaugggaaguaguaagagcagaaauaaugagaagccuaucauucucaacaaaccuacaaaaaagacuaagacgaaaagacuaa

SEQ ID NO: 4041 - protein, 189 aa, Artificial Sequence
  IFNalpha__Homo_sapiens__P05015
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 4042 - RNA, 570 nt, Artificial Sequence
  IFNalpha__Homo_sapiens__AAA36042
auggcccuguccuuuucuuuacugauggccgugcuggugcucagcuacaaauccaucuguucucugggcugugaucugccucagacucacagccuggguaauaggagggccuugauacuccuggcacaaaugggaagaaucucucauuucuccugccugaaggacagauaugauuucggauucccccaggagguguuugauggcaaccaguuccagaaggcucaagccaucucugccuuccaugagaugauccagcagaccuucaaucucuucagcacaaaggauucaucugcugcuugggaugagacccuccuagacaaauucuacauugaacuuuuccagcaacugaaugaccuagaagccugugugacacaggagguugggguggaagagauugcccugaugaaugaggacuccauccuggcugugaggaaauacuuucaaagaaucacucuuuaucugauggggaagaaauacagcccuugugccugggagguugucagagcagaaaucaugagauccuucucuuuuucaacaaacuugcaaaaaggauuaagaaggaaggauuga

SEQ ID NO: 4043 - RNA, 570 nt, Artificial Sequence
  derived and/or modified sequence opt1 from IFNalpha__Homo_sapiens__AAA36042
auggcccugagcuucucccuccugauggccgugcugguccucagcuacaaguccaucugcagccugggcugcgaccugccccagacccacucccucgggaaccgccgggcgcugauccugcucgcccagaugggccgcaucagccacuucuccugccugaaggaccgguacgacuucggguucccgcaggagguguucgacggcaaccaguuccagaaggcccaggccaucagcgccuuccacgagaugauccagcagaccuucaaccuguucuccacgaaggacagcuccgcggccugggacgagacccuccuggacaaguucuacaucgagcuguuccagcagcucaacgaccuggaggccugcgugacccaggaggucgggguggaggagaucgcccugaugaacgaggacagcauccucgcggugcgcaaguacuuccagcggaucacccuguaccugaugggcaagaaguacucccccugcgccugggaggucgugcgcgccgagaucaugcggagcuucuccuucagcacgaaccuccagaagggccugcgccggaaggacuga

SEQ ID NO: 4044 - RNA, 570 nt, Artificial Sequence
  derived and/or modified sequence opt2 from IFNalpha__Homo_sapiens__AAA36042
auggcccucuccuucucccuccucauggccguccucguccucuccuacaaguccaucugcucccucggcugcgaccucccccagacccacucccucggcaaccgccgcgcccucauccuccucgcccagaugggccgcaucucccacuucuccugccucaaggaccgcuacgacuucggcuucccccaggaggucuucgacggcaaccaguuccagaaggcccaggccaucuccgccuuccacgagaugauccagcagaccuucaaccucuucuccaccaaggacuccuccgccgccugggacgagacccuccucgacaaguucuacaucgagcucuuccagcagcucaacgaccucgaggccugcgucacccaggaggucggcgucgaggagaucgcccucaugaacgaggacuccauccucgccguccgcaaguacuuccagcgcaucacccucuaccucaugggcaagaaguacucccccugcgccugggaggucguccgcgccgagaucaugcgcuccuucuccuucuccaccaaccuccagaagggccuccgccgcaaggacuga

SEQ ID NO: 4045 - RNA, 570 nt, Artificial Sequence
  derived and/or modified sequence opt3 from IFNalpha__Homo_sapiens__AAA36042
auggcccugagcuucucccuccuuauggcugugcuggucuugucuuacaagucaaucugcaguuuaggcugugaccugccccagacccacagccuagggaacagaagggcacucauucugcuugcccaaaugggacggauaucccauuuuucuugccugaaagaucgcuaugacuucgguuuuccucaggagguuuucgauggcaaucaguuucagaaggcgcaagcuaucucggccuuccacgaaaugauucagcagacauuuaacuuguucucaacuaaagacagcagugcagccugggaugagacgcuccuggacaaguuuuacaucgaacuguuccagcaacucaaugauuuagaggcuugugugacccaggaaguagggguggaggagauugcacugaugaacgaagacuccauccuugccguccgaaaauauuuucagcguauaacauuguaccugaugggaaagaaguauucuccaugcgcuugggaggugguuagagccgaaaucaugaggagcuucuccuuuucaacuaaucuacagaaaggccuccggcgcaaggauuga

SEQ ID NO: 4046 - RNA, 570 nt, Artificial Sequence
  derived and/or modified sequence opt4 from IFNalpha__Homo_sapiens__AAA36042
auggcccugagcuucagccugcugauggccgugcuggugcugagcuacaagagcaucugcagccugggcugcgaccugccccagacccacagccugggcaacagaagagcccugauccugcuggcccagaugggcagaaucagccacuucagcugccugaaggacagauacgacuucggcuucccccaggagguguucgacggcaaccaguuccagaaggcccaggccaucagcgccuuccacgagaugauccagcagaccuucaaccuguucagcaccaaggacagcagcgccgccugggacgagacccugcuggacaaguucuacaucgagcuguuccagcagcugaacgaccuggaggccugcgugacccaggaggugggcguggaggagaucgcccugaugaacgaggacagcauccuggccgugagaaaguacuuccagagaaucacccuguaccugaugggcaagaaguacagccccugcgccugggagguggugagagccgagaucaugagaagcuucagcuucagcaccaaccugcagaagggccugagaagaaaggacuga

SEQ ID NO: 4047 - RNA, 570 nt, Artificial Sequence
  derived and/or modified sequence opt5 from IFNalpha__Homo_sapiens__AAA36042
auggcccugagcuucucccuccugauggcugugcuuguccugucuuacaagagcaucugcucccucggcugugaccugccccagacccacucucuugggaacagacgggcccugauucuccuggcgcaaaugggacgcaucagccauuuuuccugccugaaagauagauaugacuucggcuuuccucaggagguuuucgaugggaaucaguuucagaaggcucaagccauuucugccuuccacgaaaugauccagcagacauuuaaccucuucagcacgaaagacuccagcgcugccugggaugagacccugcuugacaaguuuuacauugaacuguuccagcaacucaaugaucuggaggcuugugugacacaggaagugggagucgaggagaucgcccuuaugaacgaagacucuauccuggcggugcggaaauauuuucagcgcauuacccucuaccugaugggcaagaaguauuccccgugcgccugggagguugugagagcugaaaucaugcggagcuucucuuuuuccacaaaucugcagaaagggcuccgcagaaaggauuga

SEQ ID NO: 4048 - RNA, 570 nt, Artificial Sequence
  derived and/or modified sequence opt6 from IFNalpha__Homo_sapiens__AAA36042
auggcacuaagcuuuagcuuacuaauggcaguacuaguacuaucauacaaaaguauaugcucauuaggaugcgaucuaccacaaacacacucacuaggaaacagaagagcacuaauacuauuagcacaaaugggacgaauaagccauuucucaugcuuaaaagauagauaugacuuuggauuuccacaagaaguauucgauggaaaucaauuucaaaaagcacaagcaauaagugcauuccaugaaaugauacaacaaacauucaaucuauuuagcacaaaagauagcucagcagcaugggaugaaacacuauuagacaaauucuauauagaacucuuccaacaacuaaaugacuuagaagcaugcguaacacaagaaguaggaguagaagaaauagcacuaaugaacgaagacucaauauuagcaguaagaaaauacuuucaaagaauaacauuauaucuaaugggaaaaaaauauagcccaugcgcaugggaagucguaagagcagaaauaaugagaagcuuuagcuuuagcacaaacuuacaaaaaggcuuaagaagaaaagauuaa

SEQ ID NO: 4049 - protein, 189 aa, Artificial Sequence
  IFNalpha__Homo_sapiens__P32881
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 4050 - RNA, 570 nt, Artificial Sequence
  IFNalpha__Homo_sapiens__AAA52716
auggccuugacuuuuuauuuacuggucgcccuaguggugcucagcuacaagucauucagcucucugggcugugaucugccucagacucacagccuggguaacaggagggccuugauacuccuggcacaaaugcgaagaaucucuccuuucuccugccugaaggacagacaugacuuugaauucccccaggaggaguuugaugauaaacaguuccagaaggcucaagccaucucuguccuccaugagaugauccagcagaccuucaaccucuucagcacaaaggacucaucugcugcuuuggaugagacccuucuagaugaauucuacaucgaacuugaccagcagcugaaugaccuggaguccugugugaugcaggaagugggggugauagagucuccccugauguacgaggacuccauccuggcugugaggaaauacuuccaaagaaucacucuauaucugacagagaagaaauacagcucuugugccugggagguugucagagcagaaaucaugagauccuucucuuuaucaaucaacuugcaaaaaagauugaagaguaaggaauga

SEQ ID NO: 4051 - RNA, 570 nt, Artificial Sequence
  derived and/or modified sequence opt1 from IFNalpha__Homo_sapiens__AAA52716
auggcccugaccuucuaccuccugguggcccuggucgugcucagcuacaaguccuucagcucccugggcugcgaccugccccagacccacagccucgggaaccgccgggcgcugauccugcucgcccagaugcgccggaucuccccguucagcugccugaaggaccgccacgacuucgaguucccccaggaggaguucgacgacaagcaguuccagaaggcccaggccaucuccgugcugcacgagaugauccagcagacguucaaccucuucagcaccaaggacuccagcgccgcgcuggacgagacccugcucgacgaguucuacaucgagcuggaccagcagcugaacgaccucgaguccugcgucaugcaggaggugggcgugaucgagagcccccugauguacgaggacuccauccuggccguccggaaguacuuccagcgcaucacccucuaccugacggagaagaaguacagcuccugcgccugggagguggugcgggccgagaucaugcgcagcuucucccugagcaucaaccuccagaagcggcugaaguccaaggaguga

SEQ ID NO: 4052 - RNA, 570 nt, Artificial Sequence
  derived and/or modified sequence opt2 from IFNalpha__Homo_sapiens__AAA52716
auggcccucaccuucuaccuccucgucgcccucgucguccucuccuacaaguccuucuccucccucggcugcgaccucccccagacccacucccucggcaaccgccgcgcccucauccuccucgcccagaugcgccgcaucucccccuucuccugccucaaggaccgccacgacuucgaguucccccaggaggaguucgacgacaagcaguuccagaaggcccaggccaucuccguccuccacgagaugauccagcagaccuucaaccucuucuccaccaaggacuccuccgccgcccucgacgagacccuccucgacgaguucuacaucgagcucgaccagcagcucaacgaccucgaguccugcgucaugcaggaggucggcgucaucgaguccccccucauguacgaggacuccauccucgccguccgcaaguacuuccagcgcaucacccucuaccucaccgagaagaaguacuccuccugcgccugggaggucguccgcgccgagaucaugcgcuccuucucccucuccaucaaccuccagaagcgccucaaguccaaggaguga

SEQ ID NO: 4053 - RNA, 570 nt, Artificial Sequence
  derived and/or modified sequence opt3 from IFNalpha__Homo_sapiens__AAA52716
auggcccugaccuucuaccuccuuguggcucuggucguuuugagcuauaaguccuuuucuucauuaggcugcgaccugccccagacacacagucuagggaacagaagggcacucauccugcuugcccaaaugcggcgcauuagcccuuucuccugucugaaagaucgacaugacuuugaguucccacaggaagaguuugaugacaagcaguuccagaaagcgcaagcuauaucuguguugcacgaaaugauccagcagacuuuuaaucucuucucgacgaaggauucaagcgccgcacuggacgagacccugcucgaugaauuuuacauugaguuagaccagcaacugaacgaucuugagaguugcguaaugcaggaagugggagucaucgaguccccguugauguaugaagacucuauucuggccgugcguaaauacuuccagagaaucacacuauaucucacugagaagaaguacagcuccugugcuugggagguugugagggcagaaauaaugcggucauuuagucugagcaucaaucuucagaaacgccugaagucuaaagaguga

SEQ ID NO: 4054 - RNA, 570 nt, Artificial Sequence
  derived and/or modified sequence opt4 from IFNalpha__Homo_sapiens__AAA52716
auggcccugaccuucuaccugcugguggcccugguggugcugagcuacaagagcuucagcagccugggcugcgaccugccccagacccacagccugggcaacagaagagcccugauccugcuggcccagaugagaagaaucagccccuucagcugccugaaggacagacacgacuucgaguucccccaggaggaguucgacgacaagcaguuccagaaggcccaggccaucagcgugcugcacgagaugauccagcagaccuucaaccuguucagcaccaaggacagcagcgccgcccuggacgagacccugcuggacgaguucuacaucgagcuggaccagcagcugaacgaccuggagagcugcgugaugcaggaggugggcgugaucgagagcccccugauguacgaggacagcauccuggccgugagaaaguacuuccagagaaucacccuguaccugaccgagaagaaguacagcagcugcgccugggagguggugagagccgagaucaugagaagcuucagccugagcaucaaccugcagaagagacugaagagcaaggaguga

SEQ ID NO: 4055 - RNA, 570 nt, Artificial Sequence
  derived and/or modified sequence opt5 from IFNalpha__Homo_sapiens__AAA52716
auggcccugaccuucuaccuccugguggcucuugucguucugagcuauaaguccuuuucuagccucggcugcgaccugccccagacacacucccuugggaacagacgggcccugauccuccuggcgcaaaugcgcagaauuucuccuuucagcugucugaaagaucggcaugacuuugaguucccgcaggaagaguuugaugacaagcaguuccagaaagcucaagccaucuccgugcuccacgaaaugauucagcagacguuuaaucuguucucuaccaaggauagcuccgccgcucuugacgagacacugcucgaugaauuuuacaucgagcuggaccagcaacuuaacgaucuggagagcugcgugaugcaggaagucggagugauugagucuccccucauguaugaagacuccauccuggccguucgcaaauacuuccagagaaucacccuguaucucacagagaagaaguacagcucuugugcuugggaggugguccgggccgaaauuaugcgcuccuuuagccugucuaucaaucuucagaaaagacugaaguccaaagaguga

SEQ ID NO: 4056 - RNA, 570 nt, Artificial Sequence
  derived and/or modified sequence opt6 from IFNalpha__Homo_sapiens__AAA52716
auggcacuaaccuucuacuuacuaguagcccuaguaguacuaucauacaaaucauuuucaucacuaggaugcgaccucccacaaacacacucacuaggaaacagaagagcacucauacuacuagcacaaaugcgaagaauaucaccauucucaugccuaaaagacagacacgacuucgaauucccacaagaagaauucgacgacaaacaauuccaaaaagcacaagcaauauccguacuacacgaaaugauacaacaaacauucaaccuauucucaacaaaagacucaucagcagcacuagacgaaacacuacuagacgaauucuacauagaacuagaccaacaacucaacgacuuagaaucaugcguaaugcaagaaguaggcguaaucgaaucaccacuaauguacgaagacuccauacuagcaguaagaaaauacuuucaacgaauaacacuauaccuaacagaaaaaaaauacucaucaugcgcaugggaaguaguacgagcagaaauaaugagaucauucucauuaagcauaaacuuacaaaaaagacuaaaaucaaaagaauaa

SEQ ID NO: 4057 - protein, 189 aa, Artificial Sequence [sequence omitted]

SEQ ID NO: 4058 - RNA, 570 nt, Artificial Sequence
  IFNalpha__Homo_sapiens__CAA24970
augccccuguccuuuucuuuacugauggccgugcuggugcucagcuacaaauccaucuguucucugggcugugaucugccucagacucacagccuggguaauaggagggccuggauacuccuggcacaaaugggaagaaucucucauuucuccugccugaaggacagauaugauuucggauucccccaggagguguuugauggcaaccaguuccagaaggcucaagccaucucugccuuccaugagaugauccagcagaccuucaaucucuucagcacaaaggauucuucugcugcuugggaugagacccuccuagacaaauucuacauugaacuuuuccagcaacugaaugaccuagaagccugugugacacaggagguugggguggaagagauugcccugaugaaugaggacuccauccuggcugugaggaaauacuuucaaagaaucacucuuuaucugauggggaagaaauacagcccuugugccugggagguugucagagcagaaaucaugagauccuucucuuuuucaacaaacuugcaaaaaggauuaagaaggaaggauuga

SEQ ID NO: 4059 - RNA, 570 nt, Artificial Sequence
  derived and/or modified sequence opt1 from IFNalpha__Homo_sapiens__CAA24970
augccccugagcuucucccuccugauggccgugcugguccucagcuacaaguccaucugcagccugggcugcgaccugccgcagacccacucccucgggaaccgccgggccuggauccugcuggcgcagaugggccgcaucagccacuucuccugccucaaggaccgguacgacuucggguucccccaggagguguucgacggcaaccaguuccagaaggcccaggccaucagcgccuuccacgagaugauccagcagaccuucaaccuguucuccacgaaggacagcuccgccgcgugggacgagacccugcucgacaaguucuacaucgagcuguuccagcagcugaacgaccucgaggccugcgugacccaggaggucgggguggaggagaucgcccugaugaacgaggacagcauccuggccgugcgcaaguacuuccagcggaucacccucuaccugaugggcaagaaguacucccccugcgcgugggaggucgugcgcgccgagaucaugcggagcuucuccuucagcacgaaccugcagaagggccuccgccggaaggacuga

SEQ ID NO: 4060 - RNA, 570 nt, Artificial Sequence
  derived and/or modified sequence opt2 from IFNalpha__Homo_sapiens__CAA24970
augccccucuccuucucccuccucauggccguccucguccucuccuacaaguccaucugcucccucggcugcgaccucccccagacccacucccucggcaaccgccgcgccuggauccuccucgcccagaugggccgcaucucccacuucuccugccucaaggaccgcuacgacuucggcuucccccaggaggucuucgacggcaaccaguuccagaaggcccaggccaucuccgccuuccacgagaugauccagcagaccuucaaccucuucuccaccaaggacuccuccgccgccugggacgagacccuccucgacaaguucuacaucgagcucuuccagcagcucaacgaccucgaggccugcgucacccaggaggucggcgucgaggagaucgcccucaugaacgaggacuccauccucgccguccgcaaguacuuccagcgcaucacccucuaccucaugggcaagaaguacucccccugcgccugggaggucguccgcgccgagaucaugcgcuccuucuccuucuccaccaaccuccagaagggccuccgccgcaaggacuga

SEQ ID NO: 4061 - RNA, 570 nt, Artificial Sequence
  derived and/or modified sequence opt3 from IFNalpha__Homo_sapiens__CAA24970
augccccugagcuucucccuccuuauggccgugcuggucuugucuuacaagucaaucugcaguuuaggcugugaccugccucagacccacagccuagggaacagaagggcuuggauucuccuggcacaaaugggacggauaucccauuuuucuugccuuaaagaucgcuaugacuucgguuuuccacaggagguuuucgauggcaaucaguuucagaaggcccaagcgaucucggcuuuccacgaaaugauucagcagacauuuaaccuguucucaacuaaagacagcagugccgcaugggaugagacguugcucgacaaguuuuacaucgaacuguuccagcaacugaaugaucucgaggccugugugacccaggaaguagggguggaggagauugcuuuaaugaacgaagacuccauccuggcaguccgaaaauauuuucagcguauaacacuuuacuugaugggaaagaaguauucuccgugcgccugggaggugguuagagcugaaaucaugaggagcuucuccuuuucaacuaaucugcagaaaggccuacggcgcaaggauuga

SEQ ID NO: 4062 - RNA, 570 nt, Artificial Sequence
  derived and/or modified sequence opt4 from IFNalpha__Homo_sapiens__CAA24970
augccccugagcuucagccugcugauggccgugcuggugcugagcuacaagagcaucugcagccugggcugcgaccugccccagacccacagccugggcaacagaagagccuggauccugcuggcccagaugggcagaaucagccacuucagcugccugaaggacagauacgacuucggcuucccccaggagguguucgacggcaaccaguuccagaaggcccaggccaucagcgccuuccacgagaugauccagcagaccuucaaccuguucagcaccaaggacagcagcgccgccugggacgagacccugcuggacaaguucuacaucgagcuguuccagcagcugaacgaccuggaggccugcgugacccaggaggugggcguggaggagaucgcccugaugaacgaggacagcauccuggccgugagaaaguacuuccagagaaucacccuguaccugaugggcaagaaguacagccccugcgccugggagguggugagagccgagaucaugagaagcuucagcuucagcaccaaccugcagaagggccugagaagaaaggacuga

SEQ ID NO: 4063 - RNA, 570 nt, Artificial Sequence
  derived and/or modified sequence opt5 from IFNalpha__Homo_sapiens__CAA24970
augccccugagcuucucccuccugauggccgugcuuguccugucuuacaagagcaucugcucccucggcugugaccugccucagacccacucucuugggaacagacgggcuuggauucugcucgcccaaaugggacgcaucagccauuuuuccugccugaaagauagauaugacuucggcuuuccgcaggagguuuucgaugggaaucaguuucagaaggcgcaagcuauuucugccuuccacgaaaugauccagcagacauuuaaccuguucagcacgaaagacuccagcgccgcuugggaugagacccuccuggacaaguuuuacauugaacuuuuccagcaacugaaugaucucgaggccugugugacacaggaagugggagucgaggagaucgcucugaugaacgaagacucuauccuugccgugcggaaauauuuucagcgcauuacccuguaccucaugggcaagaaguauucccccugcgcgugggagguugugagagccgaaaucaugcggagcuucucuuuuuccacaaaucugcagaaagggcugcgcagaaaggauuga

SEQ ID NO: 4064 - RNA, 570 nt, Artificial Sequence
  derived and/or modified sequence opt6 from IFNalpha__Homo_sapiens__CAA24970
augccauuaagcuuuaguuuacuaauggcaguacuaguacuaucauacaaaagcauaugcucacuaggaugcgaucuaccacaaacacacucacuaggaaacagacgagcauggauauuacuagcacaaaugggaagaauaagccauuucucaugccuaaaagauagauaugacuuuggauuuccacaagaaguauucgauggaaaucaauuucaaaaagcacaagcaauaagcgcauuccaugaaaugauacaacaaacauucaaucuauuuaguacaaaagacagcucagcagcaugggaugaaacacuauuagacaaauucuauauagaacuauuucaacaacuaaaugacuuagaagcaugcguaacacaagaaguaggaguagaagaaauagcacuaaugaacgaagacucaauauuagcaguaagaaaauacuuucaaagaauaacacuauauuuaaugggaaaaaaauacagcccaugcgcaugggaaguaguaagagcagaaauaaugagaagcuuuagcuuuagcacaaacuuacaaaaaggauuaagaagaaaagauuaa

SEQ ID NO: 4065 - protein, 166 aa, Artificial Sequence [sequence omitted]

SEQ ID NO: 4066 - RNA, 501 nt, Artificial Sequence
  IFNalpha__Homo_sapiens__AAP20099
augugugaccuaccacaaacccacagccuggguagcaggaggaccuugaugcuccuggcgcagaugaggagaaucucucuuuucuccugcuugaaggacagacaugacuuuggauuuccccaggaggaguuuggcaaccaguuccaaaaggcugaaaccaucccuguccuccaugagaugauccagcagaucuucaaccucuucagcacaaaagacucaucugcugcuugggaugagacccuccuagacaaauucuacacugaacucuaccagcagcugaaugaccuggaagccugugugauacagggggugggggugacagagacuccccugaugaaggaggacuccauucuggcugugaggaaauacuuccaaagaaucacucucuaucugaaagagaagaaauacagcccuugugccugggagguugucagagcagaaaucaugagaucuuuuucuuugucaacaaacuugcaagaaaguuuaagaucuaaagaguaa

SEQ ID NO: 4067 - RNA, 501 nt, Artificial Sequence
  derived and/or modified sequence opt1 from IFNalpha__Homo_sapiens__AAP20099
augugcgaccugccccagacccacagccucggcucccgccggacccugaugcugcucgcccagaugcgccggaucagccuguucuccugccugaaggaccgccacgacuucggguucccgcaggaggaguucggcaaccaguuccagaaggccgagaccauccccgugcuccacgagaugauccagcagaucuucaaccuguucagcaccaaggacuccagcgcggccugggacgagacccugcucgacaaguucuacaccgagcuguaccagcagcugaacgaccucgaggccugcgucauccagggggugggcgugacggagacgccccugaugaaggaggacuccauccuggccguccggaaguacuuccagcgcaucacccucuaccugaaggagaagaaguacagccccugcgccugggagguggugcgggcggagaucaugcgcuccuucagccuguccaccaaccuccaggagagccugcgguccaaggaguga

SEQ ID NO: 4068 - RNA, 501 nt, Artificial Sequence
  derived and/or modified sequence opt2 from IFNalpha__Homo_sapiens__AAP20099
augugcgaccucccccagacccacucccucggcucccgccgcacccucaugcuccucgcccagaugcgccgcaucucccucuucuccugccucaaggaccgccacgacuucggcuucccccaggaggaguucggcaaccaguuccagaaggccgagaccauccccguccuccacgagaugauccagcagaucuucaaccucuucuccaccaaggacuccuccgccgccugggacgagacccuccucgacaaguucuacaccgagcucuaccagcagcucaacgaccucgaggccugcgucauccagggcgucggcgucaccgagaccccccucaugaaggaggacuccauccucgccguccgcaaguacuuccagcgcaucacccucuaccucaaggagaagaaguacucccccugcgccugggaggucguccgcgccgagaucaugcgcuccuucucccucuccaccaaccuccaggagucccuccgcuccaaggaguga

SEQ ID NO: 4069 - RNA, 501 nt, Artificial Sequence
  derived and/or modified sequence opt3 from IFNalpha__Homo_sapiens__AAP20099
augugcgaccugccccagacccacagccucggcuccagaaggacacuuaugcuguuggcccaaaugcggcgcaucucuuuauucucaugucugaaggaucgacaugacuuuggguucccucaggaggaauuuggaaaccaguuccagaaagcugagacuauuccagugcuacacgaaaugauacaacagaucuuuaaucucuucaguacgaaggauagcuccgcagccugggacgagacccugcuugauaaauuuuacacagaacuguaucagcaguugaacgaccucgaggcgugcgucauucaagguguuggcgugacugagaccccgcugaugaaggaagauucuauccuggcuguacguaaauacuuccagagaauuacacucuauuuaaaggagaagaaauacucgcccugugccugggaaguggucagggcagagaucaugcggucauuuagccugaguaccaaucuucaggaguccuugcgcucuaaggaauga

SEQ ID NO: 4070 - RNA, 501 nt, Artificial Sequence
  derived and/or modified sequence opt4 from IFNalpha__Homo_sapiens__AAP20099
augugcgaccugccccagacccacagccugggcagcagaagaacccugaugcugcuggcccagaugagaagaaucagccuguucagcugccugaaggacagacacgacuucggcuucccccaggaggaguucggcaaccaguuccagaaggccgagaccauccccgugcugcacgagaugauccagcagaucuucaaccuguucagcaccaaggacagcagcgccgccugggacgagacccugcuggacaaguucuacaccgagcuguaccagcagcugaacgaccuggaggccugcgugauccagggcgugggcgugaccgagaccccccugaugaaggaggacagcauccuggccgugagaaaguacuuccagagaaucacccuguaccugaaggagaagaaguacagccccugcgccugggagguggugagagccgagaucaugagaagcuucagccugagcaccaaccugcaggagagccugagaagcaaggaguga

SEQ ID NO: 4071 - RNA, 501 nt, Artificial Sequence
  derived and/or modified sequence opt5 from IFNalpha__Homo_sapiens__AAP20099
augugcgaccugccccagacccacagccucggcuccagacggacacugaugcuucuggcccaaaugcgcagaaucucucucuucagcugucugaaggaucggcaugacuuuggguucccucaggaggaauuuggaaaccaguuccagaaagcugagacgauuccggugcuucacgaaaugauccaacagauuuuuaaucuguucuccaccaaggauucuagcgccgcgugggacgagacacuccuggauaaauuuuacaccgaacuguaucagcagcucaacgaccuggaggcuugcgucauccaaggcguuggggugacagagacaccccuuaugaaggaagauuccauucuggccgugcgcaaauacuuccagagaaucacccucuaucugaaggagaagaaauacucuccuugugccugggaagucgugcgggcugagaucaugcgcagcuuuucccuuagcaccaaucugcaggagucucucagauccaaggaauga

SEQ ID NO: 4072 - RNA, 501 nt, Artificial Sequence
  derived and/or modified sequence opt6 from IFNalpha__Homo_sapiens__AAP20099
augugcgaccuaccacaaacacacucacuaggaucaagaagaacacuaaugcuacuagcacaaaugcgaagaauaucauuauucucaugccuaaaagacagacacgacuucggauucccacaagaagaauucggaaaccaauuccaaaaagcagaaacaauaccaguacuacacgaaaugauacaacaaauauucaaccuauucucaacaaaagacucaucagccgcaugggacgaaacacuacuagacaaauucuacacagaauuauaccaacaacuaaacgacuuagaagcaugcguaauacaaggaguaggagucacagaaacaccacuaaugaaagaagacucaauacuagcaguaagaaaauacuuccaaagaauaacacuauaccuaaaagaaaaaaaauacucaccaugcgcaugggaaguaguaagagcagaaauaaugagauccuucucacuaucaacaaaccuacaagaaucacuaagaucaaaagaauaa

SEQ ID NO: 4073 - protein, 187 aa, Artificial Sequence
  IFNB__Homo_sapiens__P01574
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 4074 - RNA, 564 nt, Artificial Sequence
  IFNB__Homo_sapiens__AAA36040
augaccaacaagugucuccuccaaauugcucuccuguugugcuucuccacuacagcucuuuccaugagcuacaacuugcuuggauuccuacaaagaagcagcaauuuucagugucagaagcuccuguggcaauugaaugggaggcuugaauacugccucaaggacaggaugaacuuugacaucccugaggagauuaagcagcugcagcaguuccagaaggaggacgccgcauugaccaucuaugagaugcuccagaacaucuuugcuauuuucagacaagauucaucuagcacuggcuggaaugagacuauuguugagaaccuccuggcuaaugucuaucaucagauaaaccaucugaagacaguccuggaagaaaaacuggagaaagaagauuucaccaggggaaaacucaugagcagucugcaccugaaaagauauuaugggaggauucugcauuaccugaaggccaaggaguacagucacugugccuggaccauagucagaguggaaauccuaaggaacuuuuacuucauuaacagacuuacagguuaccuccgaaacuga

SEQ ID NO: 4075 - RNA, 564 nt, Artificial Sequence
  derived and/or modified sequence opt1 from IFNB__Homo_sapiens__AAA36040
augaccaacaagugccugcuccagaucgcccugcugcucugcuucagcaccacggcccuguccaugagcuacaaccugcucggcuuccugcagcgcuccagcaacuuccagugccagaagcugcucuggcagcugaacgggcggcuggaguacugccucaaggaccgcaugaacuucgacauccccgaggagaucaagcagcugcagcaguuccagaaggaggacgcggcccugaccaucuacgagaugcuccagaacaucuucgccaucuuccggcaggacuccagcuccaccggcuggaacgagaccaucguggagaaccugcuggccaacgucuaccaccagaucaaccaccucaagacggugcuggaggagaagcuggagaaggaggacuucacccgcgggaagcucaugagcucccugcaccugaagcgguacuacggccgcauccuccacuaccugaaggccaaggaguacagccacugcgcguggaccaucgugcgggucgagauccugcgcaacuucuacuucaucaaccggcucaccggguaccugcgcaacuga

SEQ ID NO: 4076 - RNA, 564 nt, Artificial Sequence
  derived and/or modified sequence opt2 from IFNB__Homo_sapiens__AAA36040
augaccaacaagugccuccuccagaucgcccuccuccucugcuucuccaccaccgcccucuccauguccuacaaccuccucggcuuccuccagcgcuccuccaacuuccagugccagaagcuccucuggcagcucaacggccgccucgaguacugccucaaggaccgcaugaacuucgacauccccgaggagaucaagcagcuccagcaguuccagaaggaggacgccgcccucaccaucuacgagaugcuccagaacaucuucgccaucuuccgccaggacuccuccuccaccggcuggaacgagaccaucgucgagaaccuccucgccaacgucuaccaccagaucaaccaccucaagaccguccucgaggagaagcucgagaaggaggacuucacccgcggcaagcucauguccucccuccaccucaagcgcuacuacggccgcauccuccacuaccucaaggccaaggaguacucccacugcgccuggaccaucguccgcgucgagauccuccgcaacuucuacuucaucaaccgccucaccggcuaccuccgcaacuga

SEQ ID NO: 4077 - RNA, 564 nt, Artificial Sequence
  derived and/or modified sequence opt3 from IFNB__Homo_sapiens__AAA36040
augaccaacaagugccugcuccagaucgcccuucuguuguguuucagcacaacugcuuuauccaugucuuacaaucugcuaggcuuucuccaaagaucaaguaacuuccagugccagaaacugcuuuggcagcugaaugggagguuggaguauugucucaaggaccggaugaacuuugauauucccgaagagauaaaacaacugcagcaguuccagaaggaagacgcagcccugacgaucuacgagaugcuccaaaauauuuuugcgaucuuccgccaggauagcuccucuaccggauggaacgaaacaauuguggagaauuuacuggcuaacgucuaucaccagaucaaucaucuuaaaacuguuuuggaggaaaagcuggagaaggaagacuuuacccgagguaaacuaaugucgucacuccaccugaagcguuacuauggcagaauacuucauuaccugaaagccaaggaguauagccacugcgcauggacaaucgugaggguagagauuuugcggaacuucuacuuuaucaaucgccucaccggguaccugagaaacuga

SEQ ID NO: 4078 - RNA, 564 nt, Artificial Sequence
  derived and/or modified sequence opt4 from IFNB__Homo_sapiens__AAA36040
augaccaacaagugccugcugcagaucgcccugcugcugugcuucagcaccaccgcccugagcaugagcuacaaccugcugggcuuccugcagagaagcagcaacuuccagugccagaagcugcuguggcagcugaacggcagacuggaguacugccugaaggacagaaugaacuucgacauccccgaggagaucaagcagcugcagcaguuccagaaggaggacgccgcccugaccaucuacgagaugcugcagaacaucuucgccaucuucagacaggacagcagcagcaccggcuggaacgagaccaucguggagaaccugcuggccaacguguaccaccagaucaaccaccugaagaccgugcuggaggagaagcuggagaaggaggacuucaccagaggcaagcugaugagcagccugcaccugaagagauacuacggcagaauccugcacuaccugaaggccaaggaguacagccacugcgccuggaccaucgugagaguggagauccugagaaacuucuacuucaucaacagacugaccggcuaccugagaaacuga

SEQ ID NO: 4079 - RNA, 564 nt, Artificial Sequence
  derived and/or modified sequence opt5 from IFNB__Homo_sapiens__AAA36040
augaccaacaagugccugcuccagaucgcccugcuucuguguuucagcacaacggcucucuccaugucuuacaaucugcuuggcuuucugcaaagaagcuccaacuuccagugccagaaacuccuguggcagcugaaugggcggcucgaguauugucugaaggaccgcaugaacuuugauauucccgaagagaucaaacaacuucagcaguuccagaaggaagacgccgcgcugaccauuuacgagaugcuccaaaauaucuuugcuauuuucagacaggauucuagcuccacaggauggaacgaaaccaucguggagaaucugcuugccaacgucuaucaccagaucaaucaucugaaaacaguucucgaggaaaagcuggagaaggaagacuuuacccggggcaaacugaugucuagccuccaccugaagcgcuacuaugggcggauucuucauuaccugaaagccaaggaguauucccacugcgcuuggacaaucgugagaguggagauucuccgcaacuucuacuuuaucaauagacugaccggauaccuucggaacuga

SEQ ID NO: 4080 - RNA, 564 nt, Artificial Sequence
  derived and/or modified sequence opt6 from IFNB__Homo_sapiens__AAA36040
augacaaacaaaugccuacuacaaauagcacuacuccuaugcuucuccacaacagcacuaucaaugucauacaaccuacuaggauuccuacaacgauccucaaacuuccaaugccaaaaacuacuauggcaacuaaacggaagacuagaauacugcuuaaaagaccgcaugaacuucgacauaccagaagaaauaaaacaacuacaacaauuccaaaaagaagacgcagcacuaaccauauacgaaaugcuacaaaacauauucgcaauauuccgacaagacucaucaucaacaggauggaacgaaacaauaguagaaaaccuccuagcaaacguauaccaccaaauaaaccacuuaaaaacaguacuagaagaaaaauuagaaaaagaagacuucacaagaggaaaauuaaugucaucacuacaccuaaaacgauacuauggaagaauacuacacuaccuaaaagcaaaagaauacucacauugcgcauggacaauaguacgaguagaaauacuaagaaacuucuacuucauaaacagacuaacaggauaccuacgaaacuaa

SEQ ID NO: 4081 - protein, 187 aa, Artificial Sequence [sequence omitted]

SEQ ID NO: 4082 - RNA, 564 nt, Artificial Sequence
  IFNB__Homo_sapiens__AAC41702
augaccaacaagugucuccuccaaauugcucuccuguugugcuucuccacgacagcucuuuccaugagcuacaacuugcuuggauuccuacaaagaagcagcaauugucagugucagaagcuccuguggcaauugaaugggaggcuugaauacugccucaaggacaggaggaacuuugacaucccugaggagauuaagcagcugcagcaguuccagaaggaggacgccgcagugaccaucuaugagaugcuccagaacaucuuugcuauuuucagacaagauucaucgagcacuggcuggaaugagacuauuguugagaaccuccuggcuaaugucuaucaucagagaaaccaucugaagacaguccuggaagaaaaacuggagaaagaagauuucaccaggggaaaacgcaugagcagucugcaccugaaaagauauuaugggaggauucugcauuaccugaaggccaaggaggacagucacugugccuggaccauagucagaguggaaauccuaaggaacuuuuacgucauuaacagacuuacagguuaccuccgaaacuga

SEQ ID NO: 4083 - RNA, 564 nt, Artificial Sequence
  derived and/or modified sequence opt1 from IFNB__Homo_sapiens__AAC41702
augaccaacaagugccugcuccagaucgcccugcugcucugcuucagcaccacggcccuguccaugagcuacaaccugcucggcuuccugcagcgcuccagcaacugccagugccagaagcugcucuggcagcugaacgggcggcuggaguacugccucaaggaccgccggaacuucgacauccccgaggagaucaagcagcugcagcaguuccagaaggaggacgcggccgugaccaucuacgagaugcugcagaacaucuucgccaucuuccgccaggacuccagcuccaccggcuggaacgagaccaucgucgagaaccuccuggccaacguguaccaccagcggaaccaccugaagacggugcucgaggagaagcuggagaaggaggacuucacccgcgggaagcggaugagcucccugcaccucaagcgcuacuacggccggauccugcacuaccugaaggccaaggaggacagccacugcgcguggaccaucguccgcguggagauccuccggaacuucuacgugaucaaccgccugaccggguaccugcggaacuga

SEQ ID NO: 4084 - RNA, 564 nt, Artificial Sequence
  derived and/or modified sequence opt2 from IFNB__Homo_sapiens__AAC41702
augaccaacaagugccuccuccagaucgcccuccuccucugcuucuccaccaccgcccucuccauguccuacaaccuccucggcuuccuccagcgcuccuccaacugccagugccagaagcuccucuggcagcucaacggccgccucgaguacugccucaaggaccgccgcaacuucgacauccccgaggagaucaagcagcuccagcaguuccagaaggaggacgccgccgucaccaucuacgagaugcuccagaacaucuucgccaucuuccgccaggacuccuccuccaccggcuggaacgagaccaucgucgagaaccuccucgccaacgucuaccaccagcgcaaccaccucaagaccguccucgaggagaagcucgagaaggaggacuucacccgcggcaagcgcauguccucccuccaccucaagcgcuacuacggccgcauccuccacuaccucaaggccaaggaggacucccacugcgccuggaccaucguccgcgucgagauccuccgcaacuucuacgucaucaaccgccucaccggcuaccuccgcaacuga

SEQ ID NO: 4085 - RNA, 564 nt, Artificial Sequence
  derived and/or modified sequence opt3 from IFNB__Homo_sapiens__AAC41702
augaccaacaagugccugcuccagaucgcccuucuguuguguuucagcacaacugcuuuauccaugucuuacaaucugcuaggcuuucuccaaagaucaaguaacugccagugucagaaacugcuuuggcagcugaaugggagguuggaguauugccucaaggaccggcgcaacuucgauauucccgaagagauaaaacaacugcagcaguuucagaaggaagacgcagccgugacgaucuacgagaugcugcaaaauauuuucgcgaucuuucgacaggauagcuccucuaccggauggaacgaaacaauugucgagaaucucuuagcuaacguuuaucaccagcguaaucaucugaaaacugugcuugaggaaaaguuggagaaggaagacuucaccagagguaaaaggaugucgucacugcaccuaaagcgguacuauggccgcauccuccauuaccugaaagccaaggaggauagccacugugcauggacaauaguaagaguggagauccuuaggaacuuuuaugucauuaaucggcugaccggguacuugcgcaacuga

SEQ ID NO: 4086 - RNA, 564 nt, Artificial Sequence
  derived and/or modified sequence opt4 from IFNB__Homo_sapiens__AAC41702
augaccaacaagugccugcugcagaucgcccugcugcugugcuucagcaccaccgcccugagcaugagcuacaaccugcugggcuuccugcagagaagcagcaacugccagugccagaagcugcuguggcagcugaacggcagacuggaguacugccugaaggacagaagaaacuucgacauccccgaggagaucaagcagcugcagcaguuccagaaggaggacgccgccgugaccaucuacgagaugcugcagaacaucuucgccaucuucagacaggacagcagcagcaccggcuggaacgagaccaucguggagaaccugcuggccaacguguaccaccagagaaaccaccugaagaccgugcuggaggagaagcuggagaaggaggacuucaccagaggcaagagaaugagcagccugcaccugaagagauacuacggcagaauccugcacuaccugaaggccaaggaggacagccacugcgccuggaccaucgugagaguggagauccugagaaacuucuacgugaucaacagacugaccggcuaccugagaaacuga

SEQ ID NO: 4087 - RNA, 564 nt, Artificial Sequence
  derived and/or modified sequence opt5 from IFNB__Homo_sapiens__AAC41702
augaccaacaagugccugcuccagaucgcccugcuucuguguuucagcacaacggcucucuccaugucuuacaaucugcuuggcuuucugcaaagaagcuccaacugccagugucagaaacuccuguggcagcugaaugggcggcucgaguauugccugaaggaccgcagaaacuucgauauucccgaagagaucaaacaacuucagcaguuucagaaggaagacgccgcggugaccauuuacgagaugcugcaaaauaucuucgcuauuuuucggcaggauucuagcuccacaggauggaacgaaaccaucgucgagaaucuccuggccaacguuuaucaccagcgcaaucaucuuaaaacagugcuggaggaaaagcucgagaaggaagacuucaccagaggcaaacggaugucuagccugcaccugaagcgcuacuaugggagaauccuccauuaccugaaagccaaggaggauucccacugugcuuggacaauugugcgggucgagauccuucgcaacuuuuaugugauuaauagacugaccggauaccuccggaacuga

SEQ ID NO: 4088 - RNA, 564 nt, Artificial Sequence
  derived and/or modified sequence opt6 from IFNB__Homo_sapiens__AAC41702
augacaaauaaaugccuacuacaaauagcacuacuacuaugcuucuccacaaccgcacuaucaaugucauacaaccuacuaggauuccuccaaagaucaucaaacugccaaugccaaaaacuacuauggcaacuaaacggaagacuagaauacugccuaaaagacagacgaaacuucgacauaccagaagaaauaaaacaacuacaacaauuccaaaaagaagacgcagcaguaacaaucuacgaaaugcuacaaaacauauucgcaauauucagacaagacucaucaucaacaggauggaacgaaacaauaguagaaaacuuacuagcaaauguauaccaccaaagaaaccacuuaaaaacaguacuagaagaaaaacuagaaaaagaagacuucacaagaggaaaaagaaugucaucacuacaccuaaaaagauacuacggcagaauacuacacuaccuaaaagcaaaagaagacucacacugcgcauggacaauaguacgaguagaaauacuaagaaacuucuauguaauaaacagacuaacaggauacuuaagaaacuaa

SEQ ID NO: 4089 - protein, 166 aa, Artificial Sequence
  IFNG__Homo_sapiens__P01579
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 4090 - RNA, 501 nt, Artificial Sequence
  IFNG__Homo_sapiens__AAB59534
augaaauauacaaguuauaucuuggcuuuucagcucugcaucguuuuggguucucuuggcuguuacugccaggacccauauguaaaagaagcagaaaaccuuaagaaauauuuuaaugcaggucauucagauguagcggauaauggaacucuuuucuuaggcauuuugaagaauuggaaagaggagagugacagaaaaauaaugcagagccaaauugucuccuuuuacuucaaacuuuuuaaaaacuuuaaagaugaccagagcauccaaaagaguguggagaccaucaaggaagacaugaaugucaaguuuuucaauagcaacaaaaagaaacgagaugacuucgaaaagcugacuaauuauucgguaacugacuugaauguccaacgcaaagcaauacaugaacucauccaagugauggcugaacugucgccagcagcuaaaacagggaagcgaaaaaggagucagaugcuguuucgaggucgaagagcaucccaguaa

SEQ ID NO: 4091 - RNA, 501 nt, Artificial Sequence
  derived and/or modified sequence opt1 from IFNG__Homo_sapiens__AAB59534
augaaguacaccagcuacauccucgccuuccagcucugcaucgugcugggcucccuggggugcuacugccaggaccccuacgucaaggaggccgagaaccucaagaaguacuucaacgcgggccacagcgacguggccgacaacgggacccuguuccugggcauccucaagaacuggaaggaggaguccgaccgcaagaucaugcagagccagaucguguccuucuacuucaagcuguucaagaacuucaaggacgaccagagcauccagaaguccgucgagacgaucaaggaggacaugaacgugaaguucuucaacagcaacaagaagaagcgggacgacuucgagaagcugaccaacuacuccgugaccgaccucaacguccagcgcaaggccauccacgagcugauccaggugauggccgagcugagcccggccgcgaagaccgggaagcggaagcgcucccagaugcuguuccggggccgccgggccagccaguga

SEQ ID NO: 4092 - RNA, 501 nt, Artificial Sequence
  derived and/or modified sequence opt2 from IFNG__Homo_sapiens__AAB59534
augaaguacaccuccuacauccucgccuuccagcucugcaucguccucggcucccucggcugcuacugccaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgccgccaagaccggcaagcgcaagcgcucccagaugcucuuccgcggccgccgcgccucccaguga

SEQ ID NO: 4093 - RNA, 501 nt, Artificial Sequence
  derived and/or modified sequence opt3 from IFNG__Homo_sapiens__AAB59534
augaaguacaccagcuauauccucgccuuccagcucugcauugugcuuggcucccugggguguuacugccaagaccccuaugucaaagaggcugaaaacuugaagaaauacuuuaaugcaggacacucugauguugccgacaacgguacauuauuccugggcauacuaaagaauuggaaagaggaaucagauagaaagaucaugcagagucagauugugagcuuuuauuucaagcucuuuaaaaacuucaaggacgaucaguccauccaaaaaucuguagagacuauuaaggaagacaugaaugugaaauuuuucaacucgaauaagaagaaaagggaugacuuugagaagcugacgaacuacucagucaccgaucuuaaugugcagcggaaagcgauccaugagcugauacagguuauggcugaauugagcccugccgcaaagacagggaaacgcaagcgaagucagaugcuguuccguggaagaagggccucccaauga

SEQ ID NO: 4094 - RNA, 501 nt, Artificial Sequence
  derived and/or modified sequence opt4 from IFNG__Homo_sapiens__AAB59534
augaaguacaccagcuacauccuggccuuccagcugugcaucgugcugggcagccugggcugcuacugccaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgccgccaagaccggcaagagaaagagaagccagaugcuguucagaggcagaagagccagccaguga

SEQ ID NO: 4095 - RNA, 501 nt, Artificial Sequence
  derived and/or modified sequence opt5 from IFNG__Homo_sapiens__AAB59534
augaaguacaccagcuauauccuggccuuccagcucugcauugugcugggcucccuuggguguuacugccaagaccccuaugucaaagaggcugaaaaccugaagaaauacuuuaaugccggacacucugauguugcggacaacggcacacucuuccuggggauccuuaagaauuggaaagaggaaagcgauagaaagauuaugcagucccagaucgugucuuuuuauuucaagcuguuuaaaaacuucaaggacgaucagagcauucaaaaauccguggagacgaucaaggaagacaugaaugucaaauuuuucaacucuaauaagaagaaacgggaugacuuugagaagcucaccaacuacagcgugacagaucugaauguucagcgcaaagcuauccaugagcugauucaggugauggccgaacucuccccugccgcuaagaccggaaaaagaaagcggagccagaugcuguuccgcggcagacgggccucucaauga

SEQ ID NO: 4096 - RNA, 501 nt, Artificial Sequence
  derived and/or modified sequence opt6 from IFNG__Homo_sapiens__AAB59534
augaaauacacaucauacauauuagcauuccaacuaugcauaguacuaggaucacuaggaugcuacugccaagacccauacguaaaagaagcagaaaaccuaaaaaaauacuucaacgcaggucacucagacguagcagacaacggaacacuauuccuaggaauauuaaaaaacuggaaagaagaaucagacagaaaaauaaugcaaucacaaauaguaucauucuacuucaaacuauucaaaaacuucaaagacgaccaaucaauacaaaaaucaguagaaacaauaaaagaagacaugaacguaaaauucuucaacagcaauaaaaaaaaaagagacgacuucgaaaaacuaacaaacuacucaguaacagaccuaaacguacaaagaaaagcaauacacgaauuaauacaaguaauggcagaacuaucaccagcagcaaaaacaggaaaaagaaaaagaucacaaauguuauucagaggaagaagagcaagccaauaa

SEQ ID NO: 4097 - protein, 144 aa, Artificial Sequence [sequence omitted]

SEQ ID NO: 4098 - RNA, 435 nt, Artificial Sequence
  IFNG__Homo_sapiens__AAP20100
augcaggacccauauguaaaagaagcagaaaaccuuaagaaauauuuuaaugcaggucauucagauguagcggauaauggaacucuuuucuuaggcauuuugaagaauuggaaagaggagagugacagaaaaauaaugcagagccaaauugucuccuuuuacuucaaacuuuuuaaaaacuuuaaagaugaccagagcauccaaaagaguguggagaccaucaaggaagacaugaaugucaaguuuuucaauagcaacaaaaagaaacgagaugacuucgaaaagcugacuaauuauucgguaacugacuugaauguccaacgcaaagcaauacaugaacucauccaagugauggcugaacugucgccagcagcuaaaacagggaagcgaaaaaggagucagaugcuguuucgaggucgaagagcaucccaguaa

SEQ ID NO: 4099 - RNA, 435 nt, Artificial Sequence
  derived and/or modified sequence opt1 from IFNG__Homo_sapiens__AAP20100
augcaggaccccuacgugaaggaggccgagaaccugaagaaguacuucaacgccggccacagcgacgucgcggacaacgggacccucuuccugggcauccugaagaacuggaaggaggaguccgaccgcaagaucaugcagagccagaucguguccuucuacuucaagcuguucaagaacuucaaggacgaccagagcauccagaaguccguggagaccaucaaggaggacaugaacgucaaguucuucaacagcaacaagaagaagcgggacgacuucgagaagcucacgaacuacuccgugaccgaccugaacgugcagcgcaaggccauccacgagcucauccaggucauggccgagcugagcccggccgccaagaccgggaagcggaagcgcucccagaugcuguuccggggccgccgggcgagccaguga

SEQ ID NO: 4100 - RNA, 435 nt, Artificial Sequence
  derived and/or modified sequence opt2 from IFNG__Homo_sapiens__AAP20100
augcaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgccgccaagaccggcaagcgcaagcgcucccagaugcucuuccgcggccgccgcgccucccaguga

SEQ ID NO: 4101 - RNA, 435 nt, Artificial Sequence
  derived and/or modified sequence opt3 from IFNG__Homo_sapiens__AAP20100
augcaggaccccuacgugaaggaggccgaaaaccugaaaaaguauuucaaugcuggccacagcgaugucgcagacaacgggacccucuuucuuggaauccugaaaaauuggaaggaggaauccgauagaaaaauuaugcaaucucagauaguuucauucuacuuuaaguuguucaagaacuuuaaagacgaucagaguauccaaaagagcguggagacaauuaaagaagacaugaauguaaaguucuuuaacuccaauaaaaagaagagggaugacuucgagaaauuaacuaacuauucugugacggaucugaauguccagcggaaggccauccaugagcuaauucaggugauggcggaacucucgccugcugccaaaaccgguaagcgcaaacgaucacagaugcuguuucguggcagaagggcaagccaguga

SEQ ID NO: 4102 - RNA, 435 nt, Artificial Sequence
  derived and/or modified sequence opt4 from IFNG__Homo_sapiens__AAP20100
augcaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgccgccaagaccggcaagagaaagagaagccagaugcuguucagaggcagaagagccagccaguga

SEQ ID NO: 4103 - RNA, 435 nt, Artificial Sequence
  derived and/or modified sequence opt5 from IFNG__Homo_sapiens__AAP20100
augcaggaccccuacgugaaggaggccgaaaaccugaaaaaguauuucaaugcuggccacagcgaugucgccgacaacgggacccucuuucugggaauccuuaaaaauuggaaggaggaauccgauagaaaaauuaugcaaucucagaucguuagcuucuacuuuaagcuguucaagaacuuuaaagacgaucaguccauucagaagucuguggagacaaucaaagaagacaugaaugugaaguucuuuaacagcaauaaaaagaagcgggaugacuucgagaaacucacgaacuauuccgucaccgaucugaaugugcaacgcaaggcgauucaugagcuuauccagguuauggcugaacugucuccugccgccaaaacaggcaagagaaaacggagccagaugcucuuucgcgggagacgggcuucccaguga

SEQ ID NO: 4104 - RNA, 435 nt, Artificial Sequence
  derived and/or modified sequence opt6 from IFNG__Homo_sapiens__AAP20100
augcaagacccauacguaaaagaagccgaaaaccuaaaaaaauacuucaacgcaggacacucagacguagcagacaacggaacacuauuccuaggaauacuaaaaaacuggaaagaagaaagcgacagaaaaauaaugcaaucacaaauaguaucauucuacuucaaacuauucaaaaacuucaaagacgaccaaucaauacaaaaaucaguagaaacaauaaaagaagacaugaacguaaaauucuucaacagcaacaaaaaaaaaagagacgacuucgaaaaacuaacaaacuacagcguaacagaccuaaacguacaaagaaaagcaauacacgaacuaauacaaguaauggcagaacuaucaccagcagcaaaaacaggaaaaagaaaaagaucacaaaugcuauucagaggaagaagagcaucacaauaa

SEQ ID NO: 4105 - protein, 134 aa, Artificial Sequence [sequence omitted]

SEQ ID NO: 4106 - RNA, 405 nt, Artificial Sequence
  IFNG__Homo_sapiens__CAA44326
augcaagacccauauguaaaagaagcagaaaaccuuaagaaauauuuuaaugcaggucauucagauguagcggauaauggaacucuuuucuuaggcauuuugaagaauuggaaagaggagagugacagaaaaauaaugcagagccaaauugucuccuuuuacuucaaacuuuuuaaaaacuuuaaagaugaccagagcauccaaaagaguguggagaccaucaaggaagacaugaaugucaaguuuuucaauagcaacaaaaagaaacgagaugacuucgaaaagcugacuaauuauucgguaacugacuugaauguccaacgcaaagcaauacaugaacucauccaagugauggcugaacugucgccagcagcuaaaacagggaagcgaaaaaggagucucuag

SEQ ID NO: 4107 - RNA, 405 nt, Artificial Sequence
  derived and/or modified sequence opt1 from IFNG__Homo_sapiens__CAA44326
augcaggaccccuacgugaaggaggccgagaaccugaagaaguacuucaacgccggccacagcgacgucgcggacaacgggacccucuuccugggcauccugaagaacuggaaggaggaguccgaccgcaagaucaugcagagccagaucguguccuucuacuucaagcuguucaagaacuucaaggacgaccagagcauccagaaguccguggagaccaucaaggaggacaugaacgucaaguucuucaacagcaacaagaagaagcgggacgacuucgagaagcucacgaacuacuccgugaccgaccugaacgugcagcgcaaggccauccacgagcucauccaggucauggccgagcugagcccggccgccaagaccgggaagcggaagcgcucccuguga

SEQ ID NO: 4108 - RNA, 405 nt, Artificial Sequence
  derived and/or modified sequence opt2 from IFNG__Homo_sapiens__CAA44326
augcaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgccgccaagaccggcaagcgcaagcgcucccucuga

SEQ ID NO: 4109 - RNA, 405 nt, Artificial Sequence
  derived and/or modified sequence opt3 from IFNG__Homo_sapiens__CAA44326
augcaggaccccuacgugaaggaggccgaaaaccugaaaaaguauuucaaugcuggccacagcgaugucgcagacaacgggacccucuuucuuggaauccugaaaaauuggaaggaggaauccgauagaaaaauuaugcaaucucagauaguuucauucuacuuuaaguuguucaagaacuuuaaagacgaucagaguauccaaaagagcguggagacaauuaaagaagacaugaauguaaaguucuuuaacuccaauaaaaagaagagggaugacuucgagaaauuaacuaacuauucugugacggaucugaauguccagcggaaggccauccaugagcuaauucaggugauggcggaacucucgccugcugccaaaaccgguaagcgcaaacgaucacuguga

SEQ ID NO: 4110 - RNA, 405 nt, Artificial Sequence
  derived and/or modified sequence opt4 from IFNG__Homo_sapiens__CAA44326
augcaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgccgccaagaccggcaagagaaagagaagccuguga

SEQ ID NO: 4111 - RNA, 405 nt, Artificial Sequence
  derived and/or modified sequence opt5 from IFNG__Homo_sapiens__CAA44326
augcaggaccccuacgugaaggaggccgaaaaccugaaaaaguauuucaaugcuggccacagcgaugucgccgacaacgggacccucuuucugggaauccuuaaaaauuggaaggaggaauccgauagaaaaauuaugcaaucucagaucguuagcuucuacuuuaagcuguucaagaacuuuaaagacgaucaguccauucagaagucuguggagacaaucaaagaagacaugaaugugaaguucuuuaacagcaauaaaaagaagcgggaugacuucgagaaacucacgaacuauuccgucaccgaucugaaugugcaacgcaaggcgauucaugagcuuauccagguuauggcugaacugucuccugccgccaaaacaggcaagagaaaacggagccucuga

SEQ ID NO: 4112 - RNA, 405 nt, Artificial Sequence
  derived and/or modified sequence opt6 from IFNG__Homo_sapiens__CAA44326
augcaagacccauacguaaaagaagcagaaaaccuaaaaaaauacuucaacgcaggacacucagacguagcagacaacggaacacuauuccuaggaauacuaaaaaacuggaaagaagaaucagacagaaaaauaaugcaaucacaaauaguaucauucuacuucaaacuauucaaaaacuucaaagacgaccaaucaauacaaaaaucaguagaaacaauaaaagaagacaugaacguaaaauucuucaacucaaacaaaaaaaaaagagacgacuucgaaaaacuaacaaacuacucaguaacagaccuaaacguacaaagaaaagcaauacacgaacuaauacaaguaauggcagaacuaucaccagcagcaaaaacaggaaaaagaaaaagaucacuauaa

SEQ ID NO: 4113 - protein, 133 aa, Artificial Sequence [sequence omitted]

SEQ ID NO: 4114 - RNA, 402 nt, Artificial Sequence
  IFNG__Homo_sapiens__CAA44330
augcaagacccauauguaaaagaagcagaaaaccuuaagaaauauuuuaaugcaggucauucagauguagcggauaauggaacucuuuucuuaggcauuuugaagaauuggaaagaggagagugacagaaaaauaaugcagagccaaauugucuccuuuuacuucaaacuuuuuaaaaacuuuaaagaugaccagagcauccaaaagaguguggagaccaucaaggaagacaugaaugucaaguuuuucaauagcaacaaaaagaaacgagaugacuucgaaaagcugacuaauuauucgguaacugacuugaauguccaacgcaaagcaauacaugaacucauccaagugauggcugaacugucgccagcagcuaaaacagggaagcgaaaaaggaguuaa

SEQ ID NO: 4115 - RNA, 402 nt, Artificial Sequence
  derived and/or modified sequence opt1 from IFNG__Homo_sapiens__CAA44330
augcaggaccccuacgugaaggaggccgagaaccugaagaaguacuucaacgccggccacagcgacgucgcggacaacgggacccucuuccugggcauccugaagaacuggaaggaggaguccgaccgcaagaucaugcagagccagaucguguccuucuacuucaagcuguucaagaacuucaaggacgaccagagcauccagaaguccguggagaccaucaaggaggacaugaacgucaaguucuucaacagcaacaagaagaagcgggacgacuucgagaagcucacgaacuacuccgugaccgaccugaacgugcagcgcaaggccauccacgagcucauccaggucauggccgagcugagcccggccgccaagaccgggaagcggaagcgcuccuga

SEQ ID NO: 4116 - RNA, 402 nt, Artificial Sequence
  derived and/or modified sequence opt2 from IFNG__Homo_sapiens__CAA44330
augcaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgccgccaagaccggcaagcgcaagcgcuccuga

SEQ ID NO: 4117 - RNA, 402 nt, Artificial Sequence
  derived and/or modified sequence opt3 from IFNG__Homo_sapiens__CAA44330
augcaggaccccuacgugaaggaggccgaaaaccugaaaaaguauuucaaugcuggccacagcgaugucgcagacaacgggacccucuuucuuggaauccugaaaaauuggaaggaggaauccgauagaaaaauuaugcaaucucagauaguuucauucuacuuuaaguuguucaagaacuuuaaagacgaucagaguauccaaaagagcguggagacaauuaaagaagacaugaauguaaaguucuuuaacuccaauaaaaagaagagggaugacuucgagaaauuaacuaacuauucugugacggaucugaauguccagcggaaggccauccaugagcuaauucaggugauggcggaacucucgccugcugccaaaaccgguaagcgcaaacgaucauga

SEQ ID NO: 4118 - RNA, 402 nt, Artificial Sequence
  derived and/or modified sequence opt4 from IFNG__Homo_sapiens__CAA44330
augcaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgccgccaagaccggcaagagaaagagaagcuga

SEQ ID NO: 4119 - RNA, 402 nt, Artificial Sequence
  derived and/or modified sequence opt5 from IFNG__Homo_sapiens__CAA44330
augcaggaccccuacgugaaggaggccgaaaaccugaaaaaguauuucaaugcuggccacagcgaugucgccgacaacgggacccucuuucugggaauccuuaaaaauuggaaggaggaauccgauagaaaaauuaugcaaucucagaucguuagcuucuacuuuaagcuguucaagaacuuuaaagacgaucaguccauucagaagucuguggagacaaucaaagaagacaugaaugugaaguucuuuaacagcaauaaaaagaagcgggaugacuucgagaaacucacgaacuauuccgucaccgaucugaaugugcaacgcaaggcgauucaugagcuuauccagguuauggcugaacugucuccugccgccaaaacaggcaagagaaaacggagcuga

SEQ ID NO: 4120 - RNA, 402 nt, Artificial Sequence
  derived and/or modified sequence opt6 from IFNG__Homo_sapiens__CAA44330
augcaagacccauacguaaaagaagcagaaaaccuaaaaaaauacuucaacgcaggacacucagacguagcagacaacggaacacuauuccuaggaauacuaaaaaacuggaaagaagaaucagacagaaaaauaaugcaaucacaaauaguaagcuucuacuucaaacuauucaaaaacuucaaagacgaccaaucaauacaaaaaucaguagaaacaauaaaagaagacaugaacguaaaauucuucaacucaaacaaaaaaaaaagagacgacuucgaaaaacuaacaaacuacucaguaacagaccuaaacguacaaagaaaagcaauacacgaacuaauacaaguaauggcagaacuaucaccagcagcaaaaacaggaaaaagaaaaagaucauaa

SEQ ID NO: 4121 - protein, 133 aa, Artificial Sequence [sequence omitted]

SEQ ID NO: 4122 - RNA, 402 nt, Artificial Sequence
  IFNG__Homo_sapiens__CAA44331
augcaagacccauauguaaaagaagcagaaaaccuuaagaaauauuuuaaugcaggucauucagauguagcggauaauggaacucuuuucuuaggcauuuugaagaauuggaaagaggagagugacagaaaaauaaugcagagccaaauugucuccuuuuacuucaaacuuuuuaaaaacuuuaaagaugaccagagcauccaaaagaguguggagaccaucaaggaagacaugaaugucaaguuuuucaauagcaacaaaaagaaacgagaugacuucgaaaagcugacuaauuauucgguaacugacuugaauguccaacgcaaagcaauacaugaacucauccaagugauggcugaacugucgccagcagcuaaaacagggaagcgaaaaaggcucuag

SEQ ID NO: 4123 - RNA, 402 nt, Artificial Sequence
  derived and/or modified sequence opt1 from IFNG__Homo_sapiens__CAA44331
augcaggaccccuacgugaaggaggccgagaaccugaagaaguacuucaacgccggccacagcgacgucgcggacaacgggacccucuuccugggcauccugaagaacuggaaggaggaguccgaccgcaagaucaugcagagccagaucguguccuucuacuucaagcuguucaagaacuucaaggacgaccagagcauccagaaguccguggagaccaucaaggaggacaugaacgucaaguucuucaacagcaacaagaagaagcgggacgacuucgagaagcucacgaacuacuccgugaccgaccugaacgugcagcgcaaggccauccacgagcucauccaggucauggccgagcugagcccggccgccaagaccgggaagcggaagcgccuguga

SEQ ID NO: 4124 - RNA, 402 nt, Artificial Sequence
  derived and/or modified sequence opt2 from IFNG__Homo_sapiens__CAA44331
augcaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgccgccaagaccggcaagcgcaagcgccucuga

SEQ ID NO: 4125 - RNA, 402 nt, Artificial Sequence
  derived and/or modified sequence opt3 from IFNG__Homo_sapiens__CAA44331
augcaggaccccuacgugaaggaggccgaaaaccugaaaaaguauuucaaugcuggccacagcgaugucgcagacaacgggacccucuuucuuggaauccugaaaaauuggaaggaggaauccgauagaaaaauuaugcaaucucagauaguuucauucuacuuuaaguuguucaagaacuuuaaagacgaucagaguauccaaaagagcguggagacaauuaaagaagacaugaauguaaaguucuuuaacuccaauaaaaagaagagggaugacuucgagaaauuaacuaacuauucugugacggaucugaauguccagcggaaggccauccaugagcuaauucaggugauggcggaacucucgccugcugccaaaaccgguaagcgcaaacgacuguga

SEQ ID NO: 4126 - RNA, 402 nt, Artificial Sequence
  derived and/or modified sequence opt4 from IFNG__Homo_sapiens__CAA44331
augcaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgccgccaagaccggcaagagaaagagacuguga

SEQ ID NO: 4127 - RNA, 402 nt, Artificial Sequence
  derived and/or modified sequence opt5 from IFNG__Homo_sapiens__CAA44331
augcaggaccccuacgugaaggaggccgaaaaccugaaaaaguauuucaaugcuggccacagcgaugucgccgacaacgggacccucuuucugggaauccuuaaaaauuggaaggaggaauccgauagaaaaauuaugcaaucucagaucguuagcuucuacuuuaagcuguucaagaacuuuaaagacgaucaguccauucagaagucuguggagacaaucaaagaagacaugaaugugaaguucuuuaacagcaauaaaaagaagcgggaugacuucgagaaacucacgaacuauuccgucaccgaucugaaugugcaacgcaaggcgauucaugagcuuauccagguuauggcugaacugucuccugccgccaaaacaggcaagagaaaacggcucuga

SEQ ID NO: 4128 - RNA, 402 nt, Artificial Sequence
  derived and/or modified sequence opt6 from IFNG__Homo_sapiens__CAA44331
augcaagacccauacguaaaagaagcagaaaaccuaaaaaaauacuucaacgcaggacacucagacguagcagacaacggaacacuauuccuaggaauacuaaaaaacuggaaagaagaaucagacagaaaaauaaugcaaucacaaauaguaucauucuacuucaaacuauucaaaaacuucaaagacgaucaaucaauacaaaaaucaguagaaacaauaaaagaagacaugaacguaaaauucuucaacucaaacaaaaaaaaaagagacgacuucgaaaaacuaacaaacuacucaguaacagaccuaaacguacaaagaaaagcaauacacgaacuaauacaaguaauggcagaacuaucaccagcagcaaaaacaggaaaaagaaaaagacuauaa

SEQ ID NO: 4129 - protein, 130 aa, Artificial Sequence [sequence omitted]

SEQ ID NO: 4130 - RNA, 393 nt, Artificial Sequence
  IFNG__Homo_sapiens__CAA44329
augcaagacccauauguaaaagaagcagaaaaccuuaagaaauauuuuaaugcaggucauucagauguagcggauaauggaacucuuuucuuaggcauuuugaagaauuggaaagaggagagugacagaaaaauaaugcagagccaaauugucuccuuuuacuucaaacuuuuuaaaaacuuuaaagaugaccagagcauccaaaagaguguggagaccaucaaggaagacaugaaugucaaguuuuucaauagcaacaaaaagaaacgagaugacuucgaaaagcugacuaauuauucgguaacugacuugaauguccaacgcaaagcaauacaugaacucauccaagugauggcugaacugucgccagcagcuaaaacagggaagcucuag

SEQ ID NO: 4131 - RNA, 393 nt, Artificial Sequence
  derived and/or modified sequence opt1 from IFNG__Homo_sapiens__CAA44329
augcaggaccccuacgugaaggaggccgagaaccugaagaaguacuucaacgccggccacagcgacgucgcggacaacgggacccucuuccugggcauccugaagaacuggaaggaggaguccgaccgcaagaucaugcagagccagaucguguccuucuacuucaagcuguucaagaacuucaaggacgaccagagcauccagaaguccguggagaccaucaaggaggacaugaacgucaaguucuucaacagcaacaagaagaagcgggacgacuucgagaagcucacgaacuacuccgugaccgaccugaacgugcagcgcaaggccauccacgagcucauccaggucauggccgagcugagcccggccgccaagaccgggaagcuguga

SEQ ID NO: 4132 - RNA, 393 nt, Artificial Sequence
  derived and/or modified sequence opt2 from IFNG__Homo_sapiens__CAA44329
augcaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgccgccaagaccggcaagcucuga

SEQ ID NO: 4133 - RNA, 393 nt, Artificial Sequence
  derived and/or modified sequence opt3 from IFNG__Homo_sapiens__CAA44329
augcaggaccccuacgugaaggaggccgaaaaccugaaaaaguauuucaaugcuggccacagcgaugucgcagacaacgggacccucuuucuuggaauccugaaaaauuggaaggaggaauccgauagaaaaauuaugcaaucucagauaguuucauucuacuuuaaguuguucaagaacuuuaaagacgaucagaguauccaaaagagcguggagacaauuaaagaagacaugaauguaaaguucuuuaacuccaauaaaaagaagagggaugacuucgagaaauuaacuaacuauucugugacggaucugaauguccagcggaaggccauccaugagcuaauucaggugauggcggaacucucgccugcugccaaaaccgguaagcuguga

SEQ ID NO: 4134 - RNA, 393 nt, Artificial Sequence
  derived and/or modified sequence opt4 from IFNG__Homo_sapiens__CAA44329
augcaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgccgccaagaccggcaagcuguga

SEQ ID NO: 4135 - RNA, 393 nt, Artificial Sequence
  derived and/or modified sequence opt5 from IFNG__Homo_sapiens__CAA44329
augcaggaccccuacgugaaggaggccgaaaaccugaaaaaguauuucaaugcuggccacagcgaugucgccgacaacgggacccucuuucugggaauccuuaaaaauuggaaggaggaauccgauagaaaaauuaugcaaucucagaucguuagcuucuacuuuaagcuguucaagaacuuuaaagacgaucaguccauucagaagucuguggagacaaucaaagaagacaugaaugugaaguucuuuaacagcaauaaaaagaagcgggaugacuucgagaaacucacgaacuauuccgucaccgaucugaaugugcaacgcaaggcgauucaugagcuuauccagguuauggcugaacugucuccugccgccaaaacaggcaagcucuga

SEQ ID NO: 4136 - RNA, 393 nt, Artificial Sequence
  derived and/or modified sequence opt6 from IFNG__Homo_sapiens__CAA44329
augcaagacccauacguaaaagaagccgaaaaccuaaaaaaauacuucaacgcaggacacucagacguagcagacaacggaacacuauuccucggaauacuaaaaaacuggaaagaagaaucagacagaaaaauaaugcaaucacaaauaguaucauucuauuucaaacuauucaaaaacuucaaagacgaccaaucaauacaaaaaucaguagaaacaauaaaagaagacaugaacguaaaauucuucaacucaaacaaaaaaaaaagagacgacuucgaaaaacuaacaaacuacucaguaacagaccuaaacguacaaagaaaagcaauacacgaacuaauacaaguaauggcagaacuaucaccagcagcaaaaacaggaaaacuauaa

SEQ ID NO: 4137 - protein, 125 aa, Artificial Sequence [sequence omitted]

SEQ ID NO: 4138 - RNA, 378 nt, Artificial Sequence
  IFNG__Homo_sapiens__CAA44328
augcaagacccauauguaaaagaagcagaaaaccuuaagaaauauuuuaaugcaggucauucagauguagcggauaauggaacucuuuucuuaggcauuuugaagaauuggaaagaggagagugacagaaaaauaaugcagagccaaauugucuccuuuuacuucaaacuuuuuaaaaacuuuaaagaugaccagagcauccaaaagaguguggagaccaucaaggaagacaugaaugucaaguuuuucaauagcaacaaaaagaaacgagaugacuucgaaaagcugacuaauuauucgguaacugacuugaauguccaacgcaaagcaauacaugaacucauccaagugauggcugaacugucgccagcacucuag

SEQ ID NO: 4139 - RNA, 378 nt, Artificial Sequence
  derived and/or modified sequence opt1 from IFNG__Homo_sapiens__CAA44328
augcaggaccccuacgugaaggaggccgagaaccugaagaaguacuucaacgccggccacagcgacgucgcggacaacgggacccucuuccugggcauccugaagaacuggaaggaggaguccgaccgcaagaucaugcagagccagaucguguccuucuacuucaagcuguucaagaacuucaaggacgaccagagcauccagaaguccguggagaccaucaaggaggacaugaacgucaaguucuucaacagcaacaagaagaagcgggacgacuucgagaagcucacgaacuacuccgugaccgaccugaacgugcagcgcaaggccauccacgagcucauccaggucauggccgagcugagcccggcccuguga

SEQ ID NO: 4140 - RNA, 378 nt, Artificial Sequence
  derived and/or modified sequence opt2 from IFNG__Homo_sapiens__CAA44328
augcaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgcccucuga

SEQ ID NO: 4141 - RNA, 378 nt, Artificial Sequence
  derived and/or modified sequence opt3 from IFNG__Homo_sapiens__CAA44328
augcaggaccccuacgugaaggaggccgaaaaccugaaaaaguauuucaaugcuggccacagcgaugucgcagacaacgggacccucuuucuuggaauccugaaaaauuggaaggaggaauccgauagaaaaauuaugcaaucucagauaguuucauucuacuuuaaguuguucaagaacuuuaaagacgaucagaguauccaaaagagcguggagacaauuaaagaagacaugaauguaaaguucuuuaacuccaauaaaaagaagagggaugacuucgagaaauuaacuaacuauucugugacggaucugaauguccagcggaaggccauccaugagcuaauucaggugauggcggaacucucgccugcucuguga

SEQ ID NO: 4142 - RNA, 378 nt, Artificial Sequence
  derived and/or modified sequence opt4 from IFNG__Homo_sapiens__CAA44328
augcaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgcccuguga

SEQ ID NO: 4143 - RNA, 378 nt, Artificial Sequence
  derived and/or modified sequence opt5 from IFNG__Homo_sapiens__CAA44328
augcaggaccccuacgugaaggaggccgaaaaccugaaaaaguauuucaaugcuggccacagcgaugucgccgacaacgggacccucuuucugggaauccuuaaaaauuggaaggaggaauccgauagaaaaauuaugcaaucucagaucguuagcuucuacuuuaagcuguucaagaacuuuaaagacgaucaguccauucagaagucuguggagacaaucaaagaagacaugaaugugaaguucuuuaacagcaauaaaaagaagcgggaugacuucgagaaacucacgaacuauuccgucaccgaucugaaugugcaacgcaaggcgauucaugagcuuauccagguuauggcugaacugucuccugcccucuga

SEQ ID NO: 4144 - RNA, 378 nt, Artificial Sequence
  derived and/or modified sequence opt6 from IFNG__Homo_sapiens__CAA44328
augcaagacccauacguaaaagaagcagaaaacuuaaaaaaauacuucaacgcaggacacucagacguagcagacaacggaacacucuuccuaggaauacuaaaaaacuggaaagaagaaucagacagaaaaauaaugcaaucacaaauaguaucauucuacuucaaacuauucaaaaacuucaaagacgaccaaucaauacaaaaaucaguagaaacaauaaaagaagacaugaacguaaaauucuucaacucaaacaaaaaaaaaagagacgacuucgaaaaacuaacaaacuacucaguaacagaccuaaacguacaaagaaaagcaauacacgaacuaauacaaguaauggcagaacucucaccagcacuauaa

SEQ ID NO: 4145 - protein, 124 aa, Artificial Sequence [sequence omitted]

SEQ ID NO: 4146 - RNA, 375 nt, Artificial Sequence
  IFNG__Homo_sapiens__CAA44327
augcaagacccauauguaaaagaagcagaaaaccuuaagaaauauuuuaaugcaggucauucagauguagcggauaauggaacucuuuucuuaggcauuuugaagaauuggaaagaggagagugacagaaaaauaaugcagagccaaauugucuccuuuuacuucaaacuuuuuaaaaacuuuaaagaugaccagagcauccaaaagaguguggagaccaucaaggaagacaugaaugucaaguuuuucaauagcaacaaaaagaaacgagaugacuucgaaaagcugacuaauuauucgguaacugacuugaauguccaacgcaaagcaauacaugaacucauccaagugauggcugaacugucgccagcauaa

SEQ ID NO: 4147 - RNA, 375 nt, Artificial Sequence
  derived and/or modified sequence opt1 from IFNG__Homo_sapiens__CAA44327
augcaggaccccuacgugaaggaggccgagaaccugaagaaguacuucaacgccggccacagcgacgucgcggacaacgggacccucuuccugggcauccugaagaacuggaaggaggaguccgaccgcaagaucaugcagagccagaucguguccuucuacuucaagcuguucaagaacuucaaggacgaccagagcauccagaaguccguggagaccaucaaggaggacaugaacgucaaguucuucaacagcaacaagaagaagcgggacgacuucgagaagcucacgaacuacuccgugaccgaccugaacgugcagcgcaaggccauccacgagcucauccaggucauggccgagcugagcccggccuga

SEQ ID NO: 4148 - RNA, 375 nt, Artificial Sequence
  derived and/or modified sequence opt2 from IFNG__Homo_sapiens__CAA44327
augcaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgccuga

SEQ ID NO: 4149 - RNA, 375 nt, Artificial Sequence
  derived and/or modified sequence opt3 from IFNG__Homo_sapiens__CAA44327
augcaggaccccuacgugaaggaggccgaaaaccugaaaaaguauuucaaugcuggccacagcgaugucgcagacaacgggacccucuuucuuggaauccugaaaaauuggaaggaggaauccgauagaaaaauuaugcaaucucagauaguuucauucuacuuuaaguuguucaagaacuuuaaagacgaucagaguauccaaaagagcguggagacaauuaaagaagacaugaauguaaaguucuuuaacuccaauaaaaagaagagggaugacuucgagaaauuaacuaacuauucugugacggaucugaauguccagcggaaggccauccaugagcuaauucaggugauggcggaacucucgccugcuuga

SEQ ID NO: 4150 - RNA, 375 nt, Artificial Sequence
  derived and/or modified sequence opt4 from IFNG__Homo_sapiens__CAA44327
augcaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgccuga

SEQ ID NO: 4151 - RNA, 375 nt, Artificial Sequence
  derived and/or modified sequence opt5 from IFNG__Homo_sapiens__CAA44327
augcaggaccccuacgugaaggaggccgaaaaccugaaaaaguauuucaaugcuggccacagcgaugucgccgacaacgggacccucuuucugggaauccuuaaaaauuggaaggaggaauccgauagaaaaauuaugcaaucucagaucguuagcuucuacuuuaagcuguucaagaacuuuaaagacgaucaguccauucagaagucuguggagacaaucaaagaagacaugaaugugaaguucuuuaacagcaauaaaaagaagcgggaugacuucgagaaacucacgaacuauuccgucaccgaucugaaugugcaacgcaaggcgauucaugagcuuauccagguuauggcugaacugucuccugccuga

SEQ ID NO: 4152 - RNA, 375 nt, Artificial Sequence
  derived and/or modified sequence opt6 from IFNG__Homo_sapiens__CAA44327
augcaagaccccuacguaaaagaagcagaaaaccuaaaaaaauacuucaacgcaggacacagcgacguagcagacaacggaacacuauuccuaggaauacuaaaaaacuggaaagaagaaagcgacagaaaaauaaugcaaucacaaauaguaucauucuacuucaaacuauucaaaaacuucaaagacgaccaaucaauacaaaaaucaguagaaacaauaaaagaagacaugaacguaaaauucuucaacagcaacaaaaaaaaaagagacgacuucgaaaaauuaacaaacuacucaguaacagaccuaaacguacaaagaaaagcaauacacgaacuaauacaaguaauggcagaacuaucaccagcauaa

SEQ ID NO: 4153 - protein, 144 aa, Artificial Sequence [sequence omitted]

SEQ ID NO: 4154 - RNA, 435 nt, Artificial Sequence
  IFNG__Homo_sapiens__AAM28885
augcaggacccauauguaaaagaagcagaaaaccuuaagaaauauuuuaaugcaggucauucagauguagcggauaauggaacucuuuucuuaggcauuuugaagaauuggaaagaggagagugacagaaaaauaaugcagagccaaauugucuccuuuuacuucaaacuuuuuaaaaacuuuaaagaugaccagagcauccaaaagaguguggagaccaucaaggaagacaugaaugucaaguuuuucaauagcaacaaaaagaaacgagaugacuucgaaaagcugacuaauuauucgguaacugacuugaauguccaacgcaaagcaauacaugaacucauccaagugauggcugaacugucgccagcagcuaaaacagggaagcgaacaaggagucagaugcuguuucgaggucgaagagcaucccaguaa

SEQ ID NO: 4155 - RNA, 435 nt, Artificial Sequence
  derived and/or modified sequence opt1 from IFNG__Homo_sapiens__AAM28885
augcaggaccccuacgugaaggaggccgagaaccugaagaaguacuucaacgccggccacagcgacgucgcggacaacgggacccucuuccugggcauccugaagaacuggaaggaggaguccgaccgcaagaucaugcagagccagaucguguccuucuacuucaagcuguucaagaacuucaaggacgaccagagcauccagaaguccguggagaccaucaaggaggacaugaacgucaaguucuucaacagcaacaagaagaagcgggacgacuucgagaagcucacgaacuacuccgugaccgaccugaacgugcagcgcaaggccauccacgagcucauccaggucauggccgagcugagcccggccgccaagaccgggaagcggacccgcucccagaugcuguuccggggccgccgggcgagccaguga

SEQ ID NO: 4156 - RNA, 435 nt, Artificial Sequence
  derived and/or modified sequence opt2 from IFNG__Homo_sapiens__AAM28885
augcaggaccccuacgucaaggaggccgagaaccucaagaaguacuucaacgccggccacuccgacgucgccgacaacggcacccucuuccucggcauccucaagaacuggaaggaggaguccgaccgcaagaucaugcagucccagaucgucuccuucuacuucaagcucuucaagaacuucaaggacgaccaguccauccagaaguccgucgagaccaucaaggaggacaugaacgucaaguucuucaacuccaacaagaagaagcgcgacgacuucgagaagcucaccaacuacuccgucaccgaccucaacguccagcgcaaggccauccacgagcucauccaggucauggccgagcucucccccgccgccaagaccggcaagcgcacccgcucccagaugcucuuccgcggccgccgcgccucccaguga

SEQ ID NO: 4157 - RNA, 435 nt, Artificial Sequence
  derived and/or modified sequence opt3 from IFNG__Homo_sapiens__AAM28885
augcaggaccccuacgugaaggaggccgaaaaccugaaaaaguauuucaaugcuggccacagcgaugucgcagacaacgggacccucuuucuuggaauccugaaaaauuggaaggaggaauccgauagaaaaauuaugcaaucucagauaguuucauucuacuuuaaguuguucaagaacuuuaaagacgaucagaguauccaaaagagcguggagacaauuaaagaagacaugaauguaaaguucuuuaacuccaauaaaaagaagagggaugacuucgagaaauuaacuaacuauucugugacggaucugaauguccagcggaaggccauccaugagcuaauucaggugauggcggaacucucgccugcugccaaaaccgguaagcgcacacgaucacagaugcuguuucguggcagaagggcaagccaguga

SEQ ID NO: 4158 - RNA, 435 nt, Artificial Sequence
  derived and/or modified sequence opt4 from IFNG__Homo_sapiens__AAM28885
augcaggaccccuacgugaaggaggccgagaaccugaagaaguacuucaacgccggccacagcgacguggccgacaacggcacccuguuccugggcauccugaagaacuggaaggaggagagcgacagaaagaucaugcagagccagaucgugagcuucuacuucaagcuguucaagaacuucaaggacgaccagagcauccagaagagcguggagaccaucaaggaggacaugaacgugaaguucuucaacagcaacaagaagaagagagacgacuucgagaagcugaccaacuacagcgugaccgaccugaacgugcagagaaaggccauccacgagcugauccaggugauggccgagcugagccccgccgccaagaccggcaagagaaccagaagccagaugcuguucagaggcagaagagccagccaguga

SEQ ID NO: 4159 - RNA, 435 nt, Artificial Sequence
  derived and/or modified sequence opt5 from IFNG__Homo_sapiens__AAM28885
augcaggaccccuacgugaaggaggccgaaaaccugaaaaaguauuucaaugcuggccacagcgaugucgccgacaacgggacccucuuucugggaauccuuaaaaauuggaaggaggaauccgauagaaaaauuaugcaaucucagaucguuagcuucuacuuuaagcuguucaagaacuuuaaagacgaucaguccauucagaagucuguggagacaaucaaagaagacaugaaugugaaguucuuuaacagcaauaaaaagaagcgggaugacuucgagaaacucacgaacuauuccgucaccgaucugaaugugcaacgcaaggcgauucaugagcuuauccagguuauggcugaacugucuccugccgccaaaacaggcaagagaacccggagccagaugcucuuucgcgggagacgggcuucccaguga

SEQ ID NO: 4160 - RNA, 435 nt, Artificial Sequence
  derived and/or modified sequence opt6 from IFNG__Homo_sapiens__AAM28885
augcaagacccauacguaaaagaagcagaaaaccuaaaaaaauacuucaacgcaggacacucagacguagcagacaacggaacacuauuccuaggaauacuaaaaaacuggaaagaagaaucagacagaaaaauaaugcaaucacaaauaguaucauucuacuucaaacuauucaaaaacuucaaagacgaccaaucaauacaaaaaucagucgaaacaauaaaagaagacaugaacguaaaauucuucaacucaaacaaaaaaaaaagagacgacuucgaaaaacuaacaaacuacucaguaacagaccuaaacguacaaagaaaagcaauacacgaacuaauacaaguaauggcagaacuaucaccagccgcaaaaacaggaaaaagaacaagaucacaaaugcuauucagaggaagaagagcaagccaauaa

SEQ ID NO: 4161 - protein, 195 aa, Artificial Sequence
  IFNomega__Homo_sapiens__P05000
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 4162 - RNA, 588 nt, Artificial Sequence
  IFNomega__Homo_sapiens__AAH69095
auggcccuccuguucccucuacuggcagcccuagugaugaccagcuauagcccuguuggaucucugggcugugaucugccucagaaccauggccuacuuagcaggaacaccuuggugcuucugcaccaaaugaggagaaucuccccuuucuugugucucaaggacagaagagacuucagguucccccaggagaugguaaaagggagccaguugcagaaggcccaugucaugucuguccuccaugagaugcugcagcagaucuucagccucuuccacacagagcgcuccucugcugccuggaacaugacccuccuagaccaacuccacacuggacuucaucagcaacugcaacaccuggagaccugcuugcugcagguagugggagaaggagaaucugcuggggcaauuagcagcccugcacugaccuugaggagguacuuccagggaauccgugucuaccugaaagagaagaaauacagcgacugugccugggaaguugucagaauggaaaucaugaaauccuuguucuuaucaacaaacaugcaagaaagacugagaaguaaagauagagaccugggcucaucuuga

SEQ ID NO: 4163 - RNA, 588 nt, Artificial Sequence
  derived and/or modified sequence opt1 from IFNomega__Homo_sapiens__AAH69095
auggcccuccuguucccccugcuggccgcgcucgugaugaccagcuacuccccggucggcagccuggggugcgaccugccccagaaccacggccuccugucccgcaacacccuggugcuccugcaccagaugcggcgcaucagccccuuccugugccucaaggaccggcgcgacuuccgguucccccaggagauggugaaggggucccagcugcagaaggcccacgucaugagcgugcugcacgagaugcuccagcagaucuucucccuguuccacacggagcgcagcuccgccgccuggaacaugacccugcucgaccagcugcacaccggccugcaccagcagcuccagcaccuggagaccugccugcuccagguggucggggagggcgagagcgccggcgcgaucuccagcccggcccugacgcugcggcgcuacuuccaggggauccggguguaccucaaggagaagaaguacuccgacugcgccugggaggugguccgcauggagaucaugaagucccuguuccugagcaccaacaugcaggagcggcuccgcagcaaggaccgggaccugggcuccagcuga

SEQ ID NO: 4164 - RNA, 588 nt, Artificial Sequence
  derived and/or modified sequence opt2 from IFNomega__Homo_sapiens__AAH69095
auggcccuccucuucccccuccucgccgcccucgucaugaccuccuacucccccgucggcucccucggcugcgaccucccccagaaccacggccuccucucccgcaacacccucguccuccuccaccagaugcgccgcaucucccccuuccucugccucaaggaccgccgcgacuuccgcuucccccaggagauggucaagggcucccagcuccagaaggcccacgucauguccguccuccacgagaugcuccagcagaucuucucccucuuccacaccgagcgcuccuccgccgccuggaacaugacccuccucgaccagcuccacaccggccuccaccagcagcuccagcaccucgagaccugccuccuccaggucgucggcgagggcgaguccgccggcgccaucuccucccccgcccucacccuccgccgcuacuuccagggcauccgcgucuaccucaaggagaagaaguacuccgacugcgccugggaggucguccgcauggagaucaugaagucccucuuccucuccaccaacaugcaggagcgccuccgcuccaaggaccgcgaccucggcuccuccuga

SEQ ID NO: 4165 - RNA, 588 nt, Artificial Sequence
  derived and/or modified sequence opt3 from IFNomega__Homo_sapiens__AAH69095
auggcccuccuguucccccuucuggcugcauuggugaugaccagcuacuccccugucggcucuuuagggugcgaccugccacagaaccacggacuacucucaagaaauacacugguucuucugcaucaaaugaggcggaucaguccguuuuugugucucaaggaucgccgagacuuccguuuuccccaggagauggugaaggguagccagcugcagaaggcccacguaauguccgugcugcaugaaaugcuccaacagauuuucucuuuauuucacacugagagaucgucagcggcuuggaacaugacgcugcuugaucaguugcauaccggccugcaccagcaacuacagcaccucgaaacaugccugcuucaggucgugggggagggagaaagcgccggcgcaauaaguuccccugcccugacuuugaggcgguauuuccaggguauccgcguuuaccucaaagagaagaaauauucugacugugcuugggagguggucagaauggaaauuaugaaaagccuguuuuuauccaccaauaugcaagagaggcugcggucaaaggaucgcgaccucgggaguagcuga

SEQ ID NO: 4166 - RNA, 588 nt, Artificial Sequence
  derived and/or modified sequence opt4 from IFNomega__Homo_sapiens__AAH69095
auggcccugcuguucccccugcuggccgcccuggugaugaccagcuacagccccgugggcagccugggcugcgaccugccccagaaccacggccugcugagcagaaacacccuggugcugcugcaccagaugagaagaaucagccccuuccugugccugaaggacagaagagacuucagauucccccaggagauggugaagggcagccagcugcagaaggcccacgugaugagcgugcugcacgagaugcugcagcagaucuucagccuguuccacaccgagagaagcagcgccgccuggaacaugacccugcuggaccagcugcacaccggccugcaccagcagcugcagcaccuggagaccugccugcugcagguggugggcgagggcgagagcgccggcgccaucagcagccccgcccugacccugagaagauacuuccagggcaucagaguguaccugaaggagaagaaguacagcgacugcgccugggagguggugagaauggagaucaugaagagccuguuccugagcaccaacaugcaggagagacugagaagcaaggacagagaccugggcagcagcuga

SEQ ID NO: 4167 - RNA, 588 nt, Artificial Sequence
  derived and/or modified sequence opt5 from IFNomega__Homo_sapiens__AAH69095
auggcccuccuguucccccugcuugcugcccuggugaugaccagcuacuccccugucggcucucucgggugcgaccugccgcagaaccacggacuucugagcagaaauacacucguucugcugcaucaaaugcggcgcaucucccccuuucucugucugaaggauagacgggacuuccgcuuuccucaggagauggugaagggcucucagcuucagaaggcgcacgugaugagcguccugcaugaaaugcuccaacagauuuucucccuguuucacacggagagaucuagcgcugccuggaacaugacccuucuggaucagcuccauacagggcugcaccagcaacugcagcaccucgaaaccugccugcuucaggugguuggagagggcgaauccgccggggcuaucagcucucccgcccugacacuccggcgcuauuuccagggaauuagaguguaccugaaagagaagaaauauuccgacugugcuugggaggucgugcggauggaaaucaugaaaagccuuuuucugucuaccaauaugcaagagcgccucagauccaaggaucgggaccugggcagcucuuga

SEQ ID NO: 4168 - RNA, 588 nt, Artificial Sequence
  derived and/or modified sequence opt6 from IFNomega__Homo_sapiens__AAH69095
auggcacuacucuucccacuacuagcagcauuagucaugacaucauacucaccaguaggaucacuaggaugcgaccuaccacaaaaccacggauuacuaagcagaaacacacuaguacuacuacaccaaaugagaagaauaucaccauuccuaugcuuaaaagacagaagagacuucagauucccacaagaaaugguaaaaggaucacaauuacaaaaagcacacguaaugucaguacuacacgaaaugcuacaacaaauauucucacuauuccacacagaaagaucaucagccgcauggaacaugacacuauuagaccaacuacacacaggacuccaccaacaacuacaacaccuagaaacaugccuacuacaaguaguaggcgaaggagaaucagcaggagcaauaucaucaccagcacuaacacuaagaagauacuuccaaggaauaagaguauaccuaaaagaaaaaaaauacucagacugcgcaugggaaguaguaagaauggaaauaaugaaaagccuauuccucucaacaaacaugcaagaaagacuacgcucaaaagauagagacuuaggaucaucauaa

SEQ ID NO: 4169 - protein, 178 aa, Artificial Sequence
  IL-10__Homo_sapiens__P22301
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 4170 - RNA, 537 nt, Artificial Sequence
  IL-10__Homo_sapiens__AAA63207
augcacagcucagcacugcucuguugccugguccuccugacuggggugagggccagcccaggccagggcacccagucugagaacagcugcacccacuucccaggcaaccugccuaacaugcuucgagaucuccgagaugccuucagcagagugaagacuuucuuucaaaugaaggaucagcuggacaacuuguuguuaaaggaguccuugcuggaggacuuuaaggguuaccuggguugccaagccuugucugagaugauccaguuuuaccuggaggaggugaugccccaagcugagaaccaagacccagacaucaaggcgcaugugaacucccugggggagaaccugaagacccucaggcugaggcuacggcgcugucaucgauuucuucccugugaaaacaagagcaaggccguggagcaggugaagaaugccuuuaauaagcuccaagagaaaggcaucuacaaagccaugagugaguuugacaucuucaucaacuacauagaagccuacaugacaaugaagauacgaaacuga

SEQ ID NO: 4171 - RNA, 537 nt, Artificial Sequence
  derived and/or modified sequence opt1 from IL-10__Homo_sapiens__AAA63207
augcacagcuccgcccugcucugcugccuggugcugcucaccggcgugcgcgccagccccgggcagggcacccaguccgagaacagcugcacgcacuucccggggaaccugcccaacaugcugcgggaccuccgcgacgcguucucccgggugaagaccuucuuccagaugaaggaccagcuggacaaccugcuccugaaggagagccugcucgaggacuucaagggcuaccuggggugccaggcccuguccgagaugauccaguucuaccucgaggaggugaugccccaggccgagaaccaggaccccgacaucaaggcccacgucaacagccugggcgagaaccugaagacccuccgccugcggcugcgccggugccaccgcuuccucccgugcgagaacaaguccaaggccguggagcaggucaagaacgcguucaacaagcugcaggagaagggcaucuacaaggccaugagcgaguucgacaucuucaucaacuacaucgaggccuacaugaccaugaagauccggaacuga

SEQ ID NO: 4172 - RNA, 537 nt, Artificial Sequence
  derived and/or modified sequence opt2 from IL-10__Homo_sapiens__AAA63207
augcacuccuccgcccuccucugcugccucguccuccucaccggcguccgcgccucccccggccagggcacccaguccgagaacuccugcacccacuuccccggcaaccuccccaacaugcuccgcgaccuccgcgacgccuucucccgcgucaagaccuucuuccagaugaaggaccagcucgacaaccuccuccucaaggagucccuccucgaggacuucaagggcuaccucggcugccaggcccucuccgagaugauccaguucuaccucgaggaggucaugccccaggccgagaaccaggaccccgacaucaaggcccacgucaacucccucggcgagaaccucaagacccuccgccuccgccuccgccgcugccaccgcuuccuccccugcgagaacaaguccaaggccgucgagcaggucaagaacgccuucaacaagcuccaggagaagggcaucuacaaggccauguccgaguucgacaucuucaucaacuacaucgaggccuacaugaccaugaagauccgcaacuga

SEQ ID NO: 4173 - RNA, 537 nt, Artificial Sequence
  derived and/or modified sequence opt3 from IL-10__Homo_sapiens__AAA63207
augcacagcuccgcccugcucugcugucuugugcuguugaccggcgucagagcuucucccgggcagggaacacaaucagagaacaguugcacucauuucccugguaauuuaccaaacaugcugagggaccuacgggaugcauuuagccgcguuaagacguucuuucagaugaaagaccagcucgauaaucugcuucugaaggaauccuugcucgaggacuucaaaggcuaccuggggugucaggcccugucugaaaugauccaauuuuaucucgaggaagugaugccgcaggcggagaaccaggaucccgacauuaaggcucacguaaauucguuaggagagaaccugaaaacccuucgauugcgucugagaaggugccaucgguuccuaccuugugaaaauaagucaaaggccguggagcaggucaaaaacgcauuuaauaagcuccaagaaaaaggcauauacaaggccaugagcgaguucgauaucuuuauuaacuauaucgaggcuuacaugacaaugaaaauucgcaauuga

SEQ ID NO: 4174 - RNA, 537 nt, Artificial Sequence
  derived and/or modified sequence opt4 from IL-10__Homo_sapiens__AAA63207
augcacagcagcgcccugcugugcugccuggugcugcugaccggcgugagagccagccccggccagggcacccagagcgagaacagcugcacccacuuccccggcaaccugcccaacaugcugagagaccugagagacgccuucagcagagugaagaccuucuuccagaugaaggaccagcuggacaaccugcugcugaaggagagccugcuggaggacuucaagggcuaccugggcugccaggcccugagcgagaugauccaguucuaccuggaggaggugaugccccaggccgagaaccaggaccccgacaucaaggcccacgugaacagccugggcgagaaccugaagacccugagacugagacugagaagaugccacagauuccugcccugcgagaacaagagcaaggccguggagcaggugaagaacgccuucaacaagcugcaggagaagggcaucuacaaggccaugagcgaguucgacaucuucaucaacuacaucgaggccuacaugaccaugaagaucagaaacuga

SEQ ID NO: 4175 - RNA, 537 nt, Artificial Sequence
  derived and/or modified sequence opt5 from IL-10__Homo_sapiens__AAA63207
augcacagcuccgcccugcucugcugucuggugcuucugaccggcgucagagcuucucccgggcagggaacacaaagcgagaacuccugcacgcauuucccuggcaaucucccgaacaugcugcgggaccuucgcgaugccuuuucuagaguuaagaccuucuuucagaugaaagaccagcuggauaaucuccugcugaaggaaagccuccuggaggacuucaaaggguaccuuggaugucaggcgcuguccgaaaugauccaauuuuaucucgaggaagugaugccccaggcugagaaccaggauccugacauuaaggcccacgucaauucucugggcgagaaccuuaaaacacugcggcuccgccugagacggugccaucgcuuccugcccugugaaaauaagagcaaggccguggaacaggugaaaaacgcuuuuaauaagcuccaagagaaagggaucuacaaggccauguccgaguucgauauuuuuaucaacuauauugaggcuuacaugaccaugaaaaucagaaauuga

SEQ ID NO: 4176 - RNA, 537 nt, Artificial Sequence
  derived and/or modified sequence opt6 from IL-10__Homo_sapiens__AAA63207
augcacuccucagcacuacuaugcugccuaguauuacuaacaggaguaagagcaucaccaggacaaggaacacaaucagaaaacucaugcacacacuucccaggaaaccuaccaaacaugcuaagagaccuaagagacgcauucucaagaguaaaaacauucuuccaaaugaaagaccaacuagacaacuuacuacuaaaagaaucacuacuagaagacuucaaaggauaccuaggaugccaagcacuaucagaaaugauacaauucuaccuagaagaagucaugccacaagcagaaaaccaagacccagacauaaaagcacacguaaacucacuaggagaaaacuuaaaaacauuaagacuaagacuaagaagaugccacagauuccuaccaugcgaaaacaaaucaaaagcaguagaacaaguaaaaaacgcauucaacaaacuacaagaaaaaggaauauacaaagcaaugucagaauucgacauauucauaaacuacauagaagcauacaugacaaugaaaauaagaaacuaa

SEQ ID NO: 4177 - protein, 199 aa, Artificial Sequence
  IL-11__Homo_sapiens__P20809
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 4178 - RNA, 600 nt, Artificial Sequence
  IL-11__Homo_sapiens__AAA59132
augaacuguguuugccgccugguccuggucgugcugagccuguggccagauacagcugucgccccugggccaccaccuggccccccucgaguuuccccagacccucgggccgagcuggacagcaccgugcuccugacccgcucucuccuggcggacacgcggcagcuggcugcacagcugagggacaaauucccagcugacggggaccacaaccuggauucccugcccacccuggccaugagugcgggggcacugggagcucuacagcucccaggugugcugacaaggcugcgagcggaccuacuguccuaccugcggcacgugcaguggcugcgccgggcagguggcucuucccugaagacccuggagcccgagcugggcacccugcaggcccgacuggaccggcugcugcgccggcugcagcuccugaugucccgccuggcccugccccagccacccccggacccgccggcgcccccgcuggcgccccccuccucagccugggggggcaucagggccgcccacgccauccugggggggcugcaccugacacuugacugggccgugaggggacugcugcugcugaagacucggcuguga

SEQ ID NO: 4179 - RNA, 600 nt, Artificial Sequence
  derived and/or modified sequence opt1 from IL-11__Homo_sapiens__AAA59132
augaacugcgugugccgccugguccucguggugcugagccuguggcccgacaccgccgucgcccccgggcccccgcccggcccgccccgggugucccccgacccccgcgcggagcucgacagcaccgugcugcugacgcggucccuccuggccgacacccgccagcuggccgcccagcuccgggacaaguuccccgccgacggcgaccacaaccuggacagccugcccacccucgcgauguccgccggggcccugggcgcccugcagcuccccgggguccugacccgccugcgggcggaccuccugagcuaccugcgccacgugcaguggcuccggcgcgccggcggcuccagccugaagacgcuggagcccgagcucgggacccugcaggcccggcuggaccgccuccugcggcgccugcagcuccugaugucccggcuggcccucccccagcccccgcccgacccgcccgccccgccccuggcgccgcccagcuccgccuggggcgggauccgcgccgcccacgccauccugggcgggcuccaccugacccuggacugggcggugcggggccuccugcugcucaagacccgccuguga

SEQ ID NO: 4180 - RNA, 600 nt, Artificial Sequence
  derived and/or modified sequence opt2 from IL-11__Homo_sapiens__AAA59132
augaacugcgucugccgccucguccucgucguccucucccucuggcccgacaccgccgucgcccccggccccccccccggccccccccgcgucucccccgacccccgcgccgagcucgacuccaccguccuccucacccgcucccuccucgccgacacccgccagcucgccgcccagcuccgcgacaaguuccccgccgacggcgaccacaaccucgacucccuccccacccucgccauguccgccggcgcccucggcgcccuccagcuccccggcguccucacccgccuccgcgccgaccuccucuccuaccuccgccacguccaguggcuccgccgcgccggcggcuccucccucaagacccucgagcccgagcucggcacccuccaggcccgccucgaccgccuccuccgccgccuccagcuccucaugucccgccucgcccucccccagcccccccccgacccccccgcccccccccucgccccccccuccuccgccuggggcggcauccgcgccgcccacgccauccucggcggccuccaccucacccucgacugggccguccgcggccuccuccuccucaagacccgccucuga

SEQ ID NO: 4181 - RNA, 600 nt, Artificial Sequence
  derived and/or modified sequence opt3 from IL-11__Homo_sapiens__AAA59132
augaacugcguguguagacugguccucguugugcuuagccuguggcccgacaccgccguagcuccuggcccaccgcccgggccuccaagggugucccccgauccucgggcagaguuggacucuacagucuuacugacucgcucacuacucgccgauacgcgacagcuggcggcucaacuucgugacaaguucccagccgauggagaccacaaucuggauaguuugcccacccucgcaaugagcgccggugcucugggcgcacugcagcucccugggguguuaacaagacugagggccgaccuuuuguccuaccugcggcauguucaguggcuacgcagagcuggagggucuucgcucaaaacucuggaaccagagcuugguacccugcaggccagguuggaucggcuccugcgccgauuacaacugcucaugucaagacuugcgcugccgcagcccccuccagaucccccugcaccacccuuggccccgccuagcagugcuuggggcggaaucagggccgcacacgcuauucuaggcggccugcaucucacacuggacugggccgugcgggggcuucuguugcucaagacccgucuguga

SEQ ID NO: 4182 - RNA, 600 nt, Artificial Sequence
  derived and/or modified sequence opt4 from IL-11__Homo_sapiens__AAA59132
augaacugcgugugcagacuggugcugguggugcugagccuguggcccgacaccgccguggcccccggccccccccccggcccccccagagugagccccgaccccagagccgagcuggacagcaccgugcugcugaccagaagccugcuggccgacaccagacagcuggccgcccagcugagagacaaguuccccgccgacggcgaccacaaccuggacagccugcccacccuggccaugagcgccggcgcccugggcgcccugcagcugcccggcgugcugaccagacugagagccgaccugcugagcuaccugagacacgugcaguggcugagaagagccggcggcagcagccugaagacccuggagcccgagcugggcacccugcaggccagacuggacagacugcugagaagacugcagcugcugaugagcagacuggcccugccccagcccccccccgacccccccgcccccccccuggccccccccagcagcgccuggggcggcaucagagccgcccacgccauccugggcggccugcaccugacccuggacugggccgugagaggccugcugcugcugaagaccagacuguga

SEQ ID NO: 4183 - RNA, 600 nt, Artificial Sequence
  derived and/or modified sequence opt5 from IL-11__Homo_sapiens__AAA59132
augaacugcguguguagacugguccucguugugcugagccuuuggcccgacaccgccguggcuccuggcccgcccccugggcccccucgggucucccccgauccucgcgccgagcuggacucuacagugcuccugacgagaagccuucuggcggauacccggcagcucgcugcccaacugcgcgacaaguucccggccgauggagaccacaaucuggauucccuccccacacuggcuaugucugccggcgcucuuggggcccugcagcucccuggaguucugaccagacuucgggcggaccugcucagcuaccugcgccaugugcaguggcugagacgggccggcggguccucucucaaaacacuggaacccgagcuuggaacccugcaggcucgccucgauagacugcuucggcgccugcaacuccugaugagcagacuggcccucccucagcccccgccugaucccccugcuccuccccuggcgcccccguccagcgccuggggcggcauccgggccgcucacgccauucuugggggacugcaucucacacuggacugggcuguccgcggccuucugcuccugaagaccagacuguga

SEQ ID NO: 4184 - RNA, 600 nt, Artificial Sequence
  derived and/or modified sequence opt6 from IL-11__Homo_sapiens__AAA59132
augaacuguguauguagacuaguauuaguaguauuaucauuauggccagacacagcaguagcaccaggaccaccaccaggaccaccaagaguaucaccagacccaagagcagaauuagacucaacaguucucuuaacaagaucuuuacuagcagacacaagacaauuagcagcacaacuaagagacaaauucccagcagauggagaucauaauuuagauaguuuaccaacauuagcuaugucagcaggagcauuaggagcacuacaacuaccaggaguacuaacaagauuaagagcagacuuauuaucauacuuaagacauguacaaugguuaagaagagcaggaggaucaucucuaaaaacacuagaaccagaacuaggaaccuuacaagcaagauuagaccgauuauuaagaagauuacaauuauuaaugucaagauuagcauuaccacaaccaccaccagauccaccagcaccaccauuagcaccaccaucuucagcauggggaggaauaagagcagcacaugccauauuaggaggacuacaccuaacauuagacugggcaguaagaggacuacuacuacuaaaaacaagacuauaa

SEQ ID NO: 4185 - protein, 219 aa, Artificial Sequence
  IL-12A__Homo_sapiens__P29459
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 4186 - RNA, 660 nt, Artificial Sequence
  IL-12A__Homo_sapiens__AAK84425
auguguccagcgcgcagccuccuccuuguggcuacccugguccuccuggaccaccucaguuuggccagaaaccuccccguggccacuccagacccaggaauguucccaugccuucaccacucccaaaaccugcugagggccgucagcaacaugcuccagaaggccagacaaacucuagaauuuuacccuugcacuucugaagagauugaucaugaagauaucacaaaagauaaaaccagcacaguggaggccuguuuaccauuggaauuaaccaagaaugagaguugccuaaauuccagagagaccucuuucauaacuaaugggaguugccuggccuccagaaagaccucuuuuaugauggcccugugccuuaguaguauuuaugaagacuugaagauguaccagguggaguucaagaccaugaaugcaaagcuucugauggauccuaagaggcagaucuuucuagaucaaaacaugcuggcaguuauugaugagcugaugcaggcccugaauuucaacagugagacugugccacaaaaauccucccuugaagaaccggauuuuuauaaaacuaaaaucaagcucugcauacuucuucaugcuuucagaauucgggcagugacuauugauagagugaugagcuaucugaaugcuuccuaa

SEQ ID NO: 4187 - RNA, 660 nt, Artificial Sequence
  derived and/or modified sequence opt1 from IL-12A__Homo_sapiens__AAK84425
augugccccgcccgcagccugcuccugguggccacccugguccuccuggaccaccugucccucgcgcggaaccugccgguggccacccccgaccccggcauguuccccugccugcaccacagccagaaccuccugcgcgccguguccaacaugcugcagaaggcccggcagacgcucgaguucuacccgugcaccagcgaggagaucgaccacgaggacaucaccaaggacaagaccuccacggucgaggccugccugccccuggagcucaccaagaacgagagcugccugaacucccgcgagaccagcuucaucaccaacggguccugccuggcgagccggaagacguccuucaugauggcccucugccugagcuccaucuacgaggaccugaagauguaccagguggaguucaagaccaugaacgccaagcuccugauggaccccaagcgccagaucuuccuggaccagaacaugcucgccgugaucgacgagcugaugcaggcgcugaacuucaacagcgagaccgucccccagaaguccagccucgaggagccggacuucuacaagaccaagaucaagcugugcauccugcuccacgccuuccggauccgcgccgugacgaucgaccgggugauguccuaccugaacgccagcuga

SEQ ID NO: 4188 - RNA, 660 nt, Artificial Sequence
  derived and/or modified sequence opt2 from IL-12A__Homo_sapiens__AAK84425
augugccccgcccgcucccuccuccucgucgccacccucguccuccucgaccaccucucccucgcccgcaaccuccccgucgccacccccgaccccggcauguuccccugccuccaccacucccagaaccuccuccgcgccgucuccaacaugcuccagaaggcccgccagacccucgaguucuaccccugcaccuccgaggagaucgaccacgaggacaucaccaaggacaagaccuccaccgucgaggccugccucccccucgagcucaccaagaacgaguccugccucaacucccgcgagaccuccuucaucaccaacggcuccugccucgccucccgcaagaccuccuucaugauggcccucugccucuccuccaucuacgaggaccucaagauguaccaggucgaguucaagaccaugaacgccaagcuccucauggaccccaagcgccagaucuuccucgaccagaacaugcucgccgucaucgacgagcucaugcaggcccucaacuucaacuccgagaccgucccccagaaguccucccucgaggagcccgacuucuacaagaccaagaucaagcucugcauccuccuccacgccuuccgcauccgcgccgucaccaucgaccgcgucauguccuaccucaacgccuccuga

SEQ ID NO: 4189 - RNA, 660 nt, Artificial Sequence
  derived and/or modified sequence opt3 from IL-12A__Homo_sapiens__AAK84425
augugccccgccagaagccugcuccuuguggcuacccuggucuuguuagaccaccugucccuagcaaggaaccucccuguugccacaccagauccgggcauguuccccugucugcaucacucucagaaucuucugcgggcggugucaaacauguugcaaaaggcucgccagacucucgaguuuuacccuugcacgagugaagagaucgaccaugaagauauuaccaaagacaagacaagcacuguagaggccugucugccacuggaacucaccaaaaaugaguccugcuuaaacucucgagagacaucguucauaaccaaugggucaugucuggcaagccguaagacaaguuuuaugauggcccuuugcuuguccucuaucuaugaagaucugaaaauguaccagguggaguucaagacuaugaacgcuaagcuacucauggaccccaaaagacagauuuuucuggaucaaaauaugcuugcagucaucgacgaacugaugcaggccuugaacuucaauagcgagaccgugccucagaaguccucacucgaggaaccagauuuuuauaaaacgaagauuaaacuguguaucuuacugcacgcuuucaggauacgggccguuacuaucgaccgcgugaugaguuaccucaacgcgagcuga

SEQ ID NO: 4190 - RNA, 660 nt, Artificial Sequence
  derived and/or modified sequence opt4 from IL-12A__Homo_sapiens__AAK84425
augugccccgccagaagccugcugcugguggccacccuggugcugcuggaccaccugagccuggccagaaaccugcccguggccacccccgaccccggcauguuccccugccugcaccacagccagaaccugcugagagccgugagcaacaugcugcagaaggccagacagacccuggaguucuaccccugcaccagcgaggagaucgaccacgaggacaucaccaaggacaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagagacagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcuga

SEQ ID NO: 4191 - RNA, 660 nt, Artificial Sequence
  derived and/or modified sequence opt5 from IL-12A__Homo_sapiens__AAK84425
augugccccgccagaagccugcuccugguggcuacccuuguccugcucgaccaccugucccuugcccggaaccugccuguugcgacaccggaucccggcauguucccuugucuccaucacucucagaaucugcugcgcgcugugagcaacaugcuccaaaaggccagacagacgcuggaguuuuaccccugcaccuccgaagagaucgaccaugaagauauuacaaaagacaagaccucuacaguggaggccugucuuccucuggaacucaccaaaaaugagagcugccugaacucccgggagacaucuuucaucaccaaugggagcugucuugcuucccgcaagacgagcuuuaugauggcccugugccucucuuccauuuaugaagaucugaaaauguaccaggucgaguucaagaccaugaacgcuaagcugcucauggaccccaaaagacagaucuuucuggaucaaaauaugcuugccgugauugacgaacugaugcaggcgcucaacuucaauagcgagacaguuccucagaagucuucccuggaggaaccggauuuuuauaaaaccaagaucaaacuuuguauccugcuccacgccuuccggauucgcgcugugacaaucgacagagucaugagcuaccugaacgccucuuga

SEQ ID NO: 4192 - RNA, 660 nt, Artificial Sequence
  derived and/or modified sequence opt6 from IL-12A__Homo_sapiens__AAK84425
augugcccagcaagaucacuacuacuaguagcaacacuaguacuacuagaccaccuaucacucgccagaaaccucccaguagccacaccagacccaggaauguuccccugccuccaccauucccaaaaccuacuaagagcaguaucaaacaugcuacaaaaagcaagacaaacacuagaauucuauccaugcacaucagaagaaauagaccacgaagacauaacaaaagacaaaacaucaaccguagaagcaugccucccacucgaacucacaaaaaacgaaucaugccuaaacucaagagaaacaucauucauaacaaacggcucaugcuuagccucaagaaaaacaucauucaugauggcacuaugccucucauccauauaugaagacuuaaaaauguaccaaguagaauuuaaaaccaugaacgcaaaauuacuaauggacccaaaaagacaaauauuccuagaccaaaacaugcuagcaguaauagacgaacuaaugcaagcacuaaacuucaacucagaaaccguaccccaaaaaucaucucuagaagaaccagacuucuacaaaacaaaaauaaaacuaugcauacuacuacacgccuucagaauaagagccgucacaauagacagagucaugucauaccuaaacgccucauaa

SEQ ID NO: 4193 - protein, 328 aa, Artificial Sequence
  IL-12__Homo_sapiens__P29460
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 4194 - RNA, 987 nt, Artificial Sequence
  IL-12__Homo_sapiens__AAA35695
augugucaccagcaguuggucaucucuugguuuucccugguuuuucuggcaucuccccucguggccauaugggaacugaagaaagauguuuaugucguagaauuggauugguauccggaugccccuggagaaauggugguccucaccugugacaccccugaagaagaugguaucaccuggaccuuggaccagagcagugaggucuuaggcucuggcaaaacccugaccauccaagucaaagaguuuggagaugcuggccaguacaccugucacaaaggaggcgagguucuaagccauucgcuccugcugcuucacaaaaaggaagauggaauuugguccacugauauuuuaaaggaccagaaagaacccaaaaauaagaccuuucuaagaugcgaggccaagaauuauucuggacguuucaccugcugguggcugacgacaaucaguacugauuugacauucagugucaaaagcagcagaggcucuucugacccccaaggggugacgugcggagcugcuacacucucugcagagagagucagaggggacaacaaggaguaugaguacucaguggagugccaggaggacagugccugcccagcugcugaggagagucugcccauugaggucaugguggaugccguucacaagcucaaguaugaaaacuacaccagcagcuucuucaucagggacaucaucaaaccugacccacccaagaacuugcagcugaagccauuaaagaauucucggcagguggaggucagcugggaguacccugacaccuggaguacuccacauuccuacuucucccugacauucugcguucagguccagggcaagagcaagagagaaaagaaagauagagucuucacggacaagaccucagccacggucaucugccgcaaaaaugccagcauuagcgugcgggcccaggaccgcuacuauagcucaucuuggagcgaaugggcaucugugcccugcaguuag

SEQ ID NO: 4195 - RNA, 987 nt, Artificial Sequence
  derived and/or modified sequence opt1 from IL-12__Homo_sapiens__AAA35695
augugccaccagcagcuggugaucagcugguucucccucgucuuccuggccagcccccugguggccaucugggagcucaagaaggacguguacgucguggagcuggacugguacccggacgcgcccggcgagauggugguccugaccugcgacacccccgaggaggacgggaucacguggacccucgaccaguccagcgaggugcugggcuccgggaagacccugaccauccaggugaaggaguucggcgacgccgggcaguacacgugccacaagggcggcgagguccucagccacucccugcugcuccugcacaagaaggaggacgggaucuggagcaccgacauccugaaggaccagaaggagcccaagaacaagaccuuccuccgcugcgaggccaagaacuacuccggccgguucacgugcugguggcugaccaccaucagcaccgaccugaccuucuccgucaagagcucccgcgggagcuccgacccgcagggcgugacgugcggggccgccacccucagcgcggagcgggugcgcggcgacaacaaggaguacgaguacuccguggagugccaggaggacagcgccugccccgccgccgaggagucccugcccaucgaggugauggucgacgcggugcacaagcugaaguacgagaacuacaccagcagcuucuucauccgggacaucaucaagcccgacccgcccaagaaccuccagcugaagccccugaagaacucccgccagguggaggucagcugggaguaccccgacaccugguccacgccgcacagcuacuucucccucaccuucugcguccaggugcagggcaagagcaagcgggagaagaaggaccgcguguucaccgacaagaccuccgccacggugaucugccggaagaacgccagcaucuccgugcgcgcccaggaccgguacuacagcuccagcugguccgagugggccagcguccccugcuccuga

SEQ ID NO: 4196 - RNA, 987 nt, Artificial Sequence
  derived and/or modified sequence opt2 from IL-12__Homo_sapiens__AAA35695
augugccaccagcagcucgucaucuccugguucucccucgucuuccucgccuccccccucgucgccaucugggagcucaagaaggacgucuacgucgucgagcucgacugguaccccgacgcccccggcgagauggucguccucaccugcgacacccccgaggaggacggcaucaccuggacccucgaccaguccuccgagguccucggcuccggcaagacccucaccauccaggucaaggaguucggcgacgccggccaguacaccugccacaagggcggcgagguccucucccacucccuccuccuccuccacaagaaggaggacggcaucugguccaccgacauccucaaggaccagaaggagcccaagaacaagaccuuccuccgcugcgaggccaagaacuacuccggccgcuucaccugcugguggcucaccaccaucuccaccgaccucaccuucuccgucaaguccucccgcggcuccuccgacccccagggcgucaccugcggcgccgccacccucuccgccgagcgcguccgcggcgacaacaaggaguacgaguacuccgucgagugccaggaggacuccgccugccccgccgccgaggagucccuccccaucgaggucauggucgacgccguccacaagcucaaguacgagaacuacaccuccuccuucuucauccgcgacaucaucaagcccgacccccccaagaaccuccagcucaagccccucaagaacucccgccaggucgaggucuccugggaguaccccgacaccugguccaccccccacuccuacuucucccucaccuucugcguccagguccagggcaaguccaagcgcgagaagaaggaccgcgucuucaccgacaagaccuccgccaccgucaucugccgcaagaacgccuccaucuccguccgcgcccaggaccgcuacuacuccuccuccugguccgagugggccuccguccccugcuccuga

SEQ ID NO: 4197 - RNA, 987 nt, Artificial Sequence
  derived and/or modified sequence opt3 from IL-12__Homo_sapiens__AAA35695
augugccaccagcaacuggugaucagcugguucucccucgucuuucuugccucuccccugguugcuauuugggaguugaagaaagacguguacguaguggaauuagauugguauccugacgcaccaggcgagauggucgugcugaccugugauacaccggaagaggacgggauaacuuggacgcuagaucagucaagugaaguucucggaagcgguaagacccugacaauccaggugaaagaguucggcgacgccgggcaguacacuugccauaagggaggcgagguccuuucccacucucuguugcuccugcauaaaaaggaagaugguauuuggucgaccgacauccugaaggaucaaaaagagcccaagaacaaaacauuucucagaugugaagcgaagaauuauucagggagguuuaccugcuggugguuaacuacaauuagcaccgaccugacguucagugugaaauccucucggggaagcuccgauccucagggcguaacuuguggcgcugccacccuuucagcagagcgcguucgaggggacaacaaggaguacgaauauaguguggagugccaggaagauagcgccuguccagcugcagaggaaucuuugcccaucgaggucaugguggacgccgugcacaagcugaaauacgagaauuauacauccucauucuuuauacgugacaucauuaagccugauccacccaaaaaccuacagcucaagccucugaaaaauagcagacaagucgaaguuaguugggaguacccagacacuuggucuaccccgcauuccuacuucagccuuacauuuugcgugcagguacagggaaagucgaaaagggaaaagaaggaucggguguucaccgacaaaacgucugcuacugucaucugucgcaagaacgccuccauuucagugagagcgcaggauagguauuacaguagcuccuggucugagugggcaagcguucccugcucauga

SEQ ID NO: 4198 - RNA, 987 nt, Artificial Sequence
  derived and/or modified sequence opt4 from IL-12__Homo_sapiens__AAA35695
augugccaccagcagcuggugaucagcugguucagccugguguuccuggccagcccccugguggccaucugggagcugaagaaggacguguacgugguggagcuggacugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaggacagcgccugccccgccgccgaggagagccugcccaucgaggugaugguggacgccgugcacaagcugaaguacgagaacuacaccagcagcuucuucaucagagacaucaucaagcccgacccccccaagaaccugcagcugaagccccugaagaacagcagacagguggaggugagcugggaguaccccgacaccuggagcaccccccacagcuacuucagccugaccuucugcgugcaggugcagggcaagagcaagagagagaagaaggacagaguguucaccgacaagaccagcgccaccgugaucugcagaaagaacgccagcaucagcgugagagcccaggacagauacuacagcagcagcuggagcgagugggccagcgugcccugcagcuga

SEQ ID NO: 4199 - RNA, 987 nt, Artificial Sequence
  derived and/or modified sequence opt5 from IL-12__Homo_sapiens__AAA35695
augugccaccagcaacuggugaucagcugguucucccucgucuuucuggccucuccccuuguugcuauuugggagcugaagaaagacguguacguggucgaacucgauugguauccugacgccccgggcgagauggugguucugaccugugauacacccgaagaggacgggaucacguggacccuugaucagagcuccgaagugcugggaucuggcaagacacucaccauucaggucaaagaguucggggacgcgggacaguacacaugccauaagggcggggaggugcugagccacucccugcuccugcuucauaaaaaggaagauggaaucuggucuaccgacauucugaaggaucaaaaagagccuaagaacaaaacauuucucagaugugaagcuaagaauuauagcggccgguuuaccugcugguggcugacgaccaucuccacagaccuuaccuucagcguuaaaucuucccgcggcagcucugauccccagggggugacauguggagccgccacccuguccgcugagagaguccggggcgacaacaaggaguacgaauauagcguggagugccaggaagauucugccuguccugcugccgaggaaucccuccccaucgaggugauggucgacgcgguucacaagcugaaauacgagaauuauacgagcuccuucuuuauucgcgacaucauuaagccugauccgcccaaaaaccugcagcucaagccucugaaaaauucuagacaaguggaagugagcugggaguaccccgacacaugguccaccccucauagcuacuucucucuuacauuuugcguccaggugcaggggaaguccaaacgggaaaagaaggaucgcguuuucaccgacaaaaccagcgccacagugaucuguagaaagaacgcuucuauuagcguccgggcccaggaucgcuauuacuccucuagcugguccgagugggcuagcgugcccugcucuuga

SEQ ID NO: 4200 - RNA, 987 nt, Artificial Sequence
  derived and/or modified sequence opt6 from IL-12__Homo_sapiens__AAA35695
augugccaccaacaacuaguaauaucaugguucucacuaguauucuuggcaucaccccuaguagcaauaugggaacuaaaaaaagacguauacguaguagaacuagacugguacccagacgcaccaggagaaaugguaguauuaacaugcgacacaccagaagaagauggaauaacuuggacauuagaccaaucaagugaaguauuaggaucaggcaaaacacuaacuauacaaguaaaagaauuuggagacgcaggacaauacaccugccacaaaggaggcgaaguccuaucacauucacuacuauuauuacacaaaaaagaagacggaaucuggagcacagacauauuaaaagaccaaaaagaaccaaaaaacaaaacauuucuaagaugcgaagcuaaaaacuauucaggaagauucacaugcugguggcuaacaaccaucaguaccgacuuaacauucucaguaaaaucaucaagaggaucaucagacccacaaggaguaacauguggagcagcaacacuaagcgcagaaagaguacgaggagacaacaaagaauacgaauauucaguagaaugucaagaagacucagcaugcccugcagcagaagaaucauuaccaauagaaguaauggucgacgcuguacacaaacuaaaauaugaaaauuacacaagcaguuucuucauaagagacauaauaaaacccgacccaccaaaaaaccuacaacuaaaaccauuaaaaaauucaagacaaguagaaguaucaugggaauacccagauacauggagcacaccacacaguuacuucucauuaacauucugcguacaaguacaaggaaaaaguaaaagagaaaaaaaagacagaguauucacagauaagacuucagcaacaguaauaugcagaaaaaacgcaagcauaagcguacgagcacaagacagauauuacucaagcucauggucagaaugggcaucaguaccauguucauaa

SEQ ID NO: 4201 - protein, 146 aa, Artificial Sequence [sequence omitted]

SEQ ID NO: 4202 - RNA, 441 nt, Artificial Sequence
  IL-13__Homo_sapiens__CAA48823
augcauccgcuccucaauccucuccuguuggcacugggccucauggcgcuuuuguugaccacggucauugcucucacuugccuuggcggcuuugccuccccaggcccugugccucccucuacagcccucagggagcucauugaggagcuggucaacaucacccagaaccagaaggcuccgcucugcaauggcagcaugguauggagcaucaaccugacagcuggcauguacugugcagcccuggaaucccugaucaacgugucaggcugcagugccaucgagaagacccagaggaugcugagcggauucugcccgcacaaggucucagcugggcaguuuuccagcuugcauguccgagacaccaaaaucgagguggcccaguuuguaaaggaccugcucuuacauuuaaagaaacuuuuucgcgagggacgguucaacuga

SEQ ID NO: 4203 - RNA, 441 nt, Artificial Sequence
  derived and/or modified sequence opt1 from IL-13__Homo_sapiens__CAA48823
augcacccccugcucaacccgcugcugcucgcccugggccugauggcccuccugcugaccaccgugaucgcgcucacgugccucgggggcuucgccagccccgggcccgugcccccguccaccgcccugcgcgagcucaucgaggagcuggucaacaucacccagaaccagaaggcgccccugugcaacggcagcauggugugguccaucaaccucaccgccgggauguacugcgccgcccuggagagccugaucaacgucuccggcugcagcgccaucgagaagacgcagcggaugcucuccggcuucugcccccacaaggugagcgccgggcaguucuccagccugcacgugcgcgacaccaagaucgaggucgcgcaguucgugaaggaccugcuccugcaccugaagaagcuguuccgggagggccgcuucaacuga

SEQ ID NO: 4204 - RNA, 441 nt, Artificial Sequence
  derived and/or modified sequence opt2 from IL-13__Homo_sapiens__CAA48823
augcacccccuccucaacccccuccuccucgcccucggccucauggcccuccuccucaccaccgucaucgcccucaccugccucggcggcuucgccucccccggccccgucccccccuccaccgcccuccgcgagcucaucgaggagcucgucaacaucacccagaaccagaaggccccccucugcaacggcuccauggucugguccaucaaccucaccgccggcauguacugcgccgcccucgagucccucaucaacgucuccggcugcuccgccaucgagaagacccagcgcaugcucuccggcuucugcccccacaaggucuccgccggccaguucuccucccuccacguccgcgacaccaagaucgaggucgcccaguucgucaaggaccuccuccuccaccucaagaagcucuuccgcgagggccgcuucaacuga

SEQ ID NO: 4205 - RNA, 441 nt, Artificial Sequence
  derived and/or modified sequence opt3 from IL-13__Homo_sapiens__CAA48823
augcacccccugcucaacccucuucuguuggccuuaggccugauggcucuacuccugaccacagugaucgcacuuacuugccuugggggauucgccagcccagguccgguucccccuuccacggcguugagagagcucauugaagaguuggucaauauaacccagaaccaaaaggcuccacuguguaauggcucuaugguguggucaaucaaccucacagccgggauguacugcgcagccuuagaaagucugauuaauguaagcggauguuccgcuaucgagaaaacucagaggaugcuuucuggcuuuugcccccauaaggugucggcaggucaguucucaagccugcacguccgggacaccaaaauugaaguggcccaguuuguuaaggaucugcuacuccaucugaaaaagcuguuccgcgaggggcgauuuaacuga

SEQ ID NO: 4206 - RNA, 441 nt, Artificial Sequence
  derived and/or modified sequence opt4 from IL-13__Homo_sapiens__CAA48823
augcacccccugcugaacccccugcugcuggcccugggccugauggcccugcugcugaccaccgugaucgcccugaccugccugggcggcuucgccagccccggccccgugccccccagcaccgcccugagagagcugaucgaggagcuggugaacaucacccagaaccagaaggccccccugugcaacggcagcaugguguggagcaucaaccugaccgccggcauguacugcgccgcccuggagagccugaucaacgugagcggcugcagcgccaucgagaagacccagagaaugcugagcggcuucugcccccacaaggugagcgccggccaguucagcagccugcacgugagagacaccaagaucgagguggcccaguucgugaaggaccugcugcugcaccugaagaagcuguucagagagggcagauucaacuga

SEQ ID NO: 4207 - RNA, 441 nt, Artificial Sequence
  derived and/or modified sequence opt5 from IL-13__Homo_sapiens__CAA48823
augcacccccugcucaacccucugcuucuggcccucggccugauggcccuucugcucaccacagugaucgcucugacgugccuugggggauucgcgagcccgggccccgucccucccuccaccgcucucagagagcugauugaggaacuuguuaauaucacacagaaccaaaaggccccucuguguaaugggucuaugguguggagcauuaaccucaccgccggaauguacugcgcugcccuggaaucccuuaucaaugugucuggcuguagcgcuauugagaaaacacagcggaugcuguccggguuuugcccccauaaggucucugccggacaguucagcucccuccacgugcgcgacaccaaaaucgaaguugcgcaguuugugaaggaucugcugcuccaucugaaaaagcuguucagagagggccgguuuaacuga

SEQ ID NO: 4208 - RNA, 441 nt, Artificial Sequence
  derived and/or modified sequence opt6 from IL-13__Homo_sapiens__CAA48823
augcacccacuacuaaacccacuacuacuagcacuaggacuaauggcacuacuacuaacaacaguaauagcacuaacaugccuaggaggauucgcaucaccaggaccaguaccaccaucaacagcacuaagagaacuaauagaagaacuaguaaacauaacacaaaaccaaaaagcaccacuaugcaacggaucaaugguauggucaauaaaccuaacagcaggaauguacugcgcagcacuagaaucacuaauaaacguaucaggaugcucagcaauagaaaaaacacaaagaaugcuaucaggauucugcccacacaaaguaucagcaggacaauucucaucacuacacguaagagacacaaaaauagaaguagcacaauucguaaaagaccuacuacuacaccuaaaaaaacuauuccgagaaggaagauucaacuaa

SEQ ID NO: 4209 - protein, 546 aa, Artificial Sequence
  IL-14__Homo_sapiens__P40222
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 4210 - RNA, 1641 nt, Artificial Sequence
  IL-14__Homo_sapiens__AAI03824
augaagaaccaagacaaaaagaacggggcugccaaacaauccaauccaaaaagcagcccaggacaaccggaagcaggacccgagggagcccaggagcggcccagccaggcggcuccugcaguagaagcagaaggucccggcagcagccaggcuccucggaagccggagggggcucaagccagaacggcucagucuggggcccuucgugaugucucugaggagcugagccgccaacuggaagacauacugagcacauacuguguggacaauaaccaggggggccccggcgaggauggggcacagggugagccggcugaacccgaagaugcagagaagucccggaccuauguggcaaggaauggggagccugaaccaacuccaguagucaauggagagaaggaacccuccaagggggauccaaacacagaagagauccggcagagugacgaggucggagaccgagaccaucgaaggccacaggagaagaaaaaagccaaggguuuggggaaggagaucacguugcugaugcagacauugaauacucugaguaccccagaggagaagcuggcugcucugugcaagaaguaugcugaacugcuggaggagcaccggaauucacagaagcagaugaagcuccuacagaaaaagcagagccagcuggugcaagagaaggaccaccugcgcggugagcacagcaaggccguccuggcccgcagcaagcuugagagccuaugccgugagcugcagcggcacaaccgcucccucaaggaagaaggugugcagcgggcccgggaggaggaggagaagcgcaaggaggugaccucgcacuuccaggugacacugaaugacauucagcugcagauggaacagcacaaugagcgcaacuccaagcugcgccaagagaacauggagcuggcugagaggcucaagaagcugauugagcaguaugagcugcgcgaggagcauaucgacaaagucuucaaacacaaggaccuacaacagcagcugguggaugccaagcuccagcaggcccaggagaugcuaaaggaggcagaagagcggcaccagcgggagaaggauuuucuccugaaagaggcaguagagucccagaggaugugugagcugaugaagcagcaagagacccaccugaagcaacagcuugcccuauacacagagaaguuugaggaguuccagaacacacuuuccaaaagcagcgagguauucaccacauucaagcaggagauggaaaagaugacuaagaagaucaagaagcuggagaaagaaaccaccauguaccggucccggugggagagcagcaacaaggcccugcuugagauggcugaggagaaaacaguccgggauaaagaacuggagggccugcagguaaaaauccaacggcuggagaagcugugccgggcacugcagacagagcgcaaugaccugaacaagaggguacaggaccugagugcugguggccagggcucccucacugacaguggcccugagaggaggccagaggggccuggggcucaagcacccagcucccccagggucacagaagcgccuugcuacccaggagcaccgagcacagaagcaucaggccagacugggccucaagagcccaccuccgccagggccuag

SEQ ID NO: 4211 - RNA, 1641 nt, Artificial Sequence
  derived and/or modified sequence opt1 from IL-14__Homo_sapiens__AAI03824
augaagaaccaggacaagaagaacggcgccgccaagcagagcaaccccaaguccagcccggggcagcccgaggcgggccccgagggggcccaggagcgccccucccaggccgccccggccguggaggcggagggccccgggagcucccaggcgccccggaagcccgagggcgcccaggcccgcaccgcccagagcggcgcccugcgggacgucuccgaggagcucagccgccagcuggaggacauccuguccaccuacugcguggacaacaaccagggcgggccgggggaggacggcgcccagggggagcccgccgagcccgaggacgccgagaagucccggacguacguggcgcgcaacggcgagcccgagccgacccccgucgugaacggcgagaaggagcccagcaagggggaccccaacaccgaggagauccggcagagcgacgaggugggcgaccgcgaccaccggcgcccgcaggagaagaagaaggccaaggggcucggcaaggagaucacccugcugaugcagacgcucaacacccuguccacccccgaggagaagcuggccgcccucugcaagaaguacgccgagcugcuggaggagcaccggaacagccagaagcagaugaagcuccugcagaagaagcagucccagcugguccaggagaaggaccaccuccgcggcgagcacagcaaggcggugcuggcccgguccaagcuggagagccucugccgcgagcugcagcggcacaaccgcucccugaaggaggagggggugcagcgggcccgcgaggaggaggagaagcggaaggaggucaccagccacuuccaggugacgcucaacgacauccagcugcagauggagcagcacaacgagcgcaacagcaagcugcggcaggagaacauggagcucgccgagcgccugaagaagcugaucgagcaguacgagcuccgcgaggagcacaucgacaagguguucaagcacaaggaccugcagcagcagcuggucgacgccaagcuccagcaggcgcaggagaugcugaaggaggccgaggagcggcaccagcgcgagaaggacuuccugcucaaggaggccguggagucccagcggaugugcgagcugaugaagcagcaggagacccaccugaagcagcagcucgcccuguacaccgagaaguucgaggaguuccagaacacccugagcaaguccagcgagguguucacgaccuucaagcaggagauggagaagaugaccaagaagaucaagaagcucgagaaggagaccacgauguaccgcucccggugggagagcuccaacaaggcccugcuggagauggcggaggagaagaccguccgcgacaaggagcucgagggccuccaggugaagauccagcggcuggagaagcugugccgcgcccugcagaccgagcggaacgaccugaacaagcgcgugcaggaccucagcgccgggggccaggggucccugaccgacagcggccccgagcggcgccccgagggcccgggggcccaggcgcccuccagcccccgggucacggaggcccccugcuacccgggcgcccccuccaccgaggccagcgggcagaccggcccccaggagcccaccuccgcccgcgcguga

SEQ ID NO: 4212 - RNA, 1641 nt, Artificial Sequence
  derived and/or modified sequence opt2 from IL-14__Homo_sapiens__AAI03824
augaagaaccaggacaagaagaacggcgccgccaagcaguccaaccccaaguccucccccggccagcccgaggccggccccgagggcgcccaggagcgccccucccaggccgcccccgccgucgaggccgagggccccggcuccucccaggccccccgcaagcccgagggcgcccaggcccgcaccgcccaguccggcgcccuccgcgacgucuccgaggagcucucccgccagcucgaggacauccucuccaccuacugcgucgacaacaaccagggcggccccggcgaggacggcgcccagggcgagcccgccgagcccgaggacgccgagaagucccgcaccuacgucgcccgcaacggcgagcccgagcccacccccgucgucaacggcgagaaggagcccuccaagggcgaccccaacaccgaggagauccgccaguccgacgaggucggcgaccgcgaccaccgccgcccccaggagaagaagaaggccaagggccucggcaaggagaucacccuccucaugcagacccucaacacccucuccacccccgaggagaagcucgccgcccucugcaagaaguacgccgagcuccucgaggagcaccgcaacucccagaagcagaugaagcuccuccagaagaagcagucccagcucguccaggagaaggaccaccuccgcggcgagcacuccaaggccguccucgcccgcuccaagcucgagucccucugccgcgagcuccagcgccacaaccgcucccucaaggaggagggcguccagcgcgcccgcgaggaggaggagaagcgcaaggaggucaccucccacuuccaggucacccucaacgacauccagcuccagauggagcagcacaacgagcgcaacuccaagcuccgccaggagaacauggagcucgccgagcgccucaagaagcucaucgagcaguacgagcuccgcgaggagcacaucgacaaggucuucaagcacaaggaccuccagcagcagcucgucgacgccaagcuccagcaggcccaggagaugcucaaggaggccgaggagcgccaccagcgcgagaaggacuuccuccucaaggaggccgucgagucccagcgcaugugcgagcucaugaagcagcaggagacccaccucaagcagcagcucgcccucuacaccgagaaguucgaggaguuccagaacacccucuccaaguccuccgaggucuucaccaccuucaagcaggagauggagaagaugaccaagaagaucaagaagcucgagaaggagaccaccauguaccgcucccgcugggaguccuccaacaaggcccuccucgagauggccgaggagaagaccguccgcgacaaggagcucgagggccuccaggucaagauccagcgccucgagaagcucugccgcgcccuccagaccgagcgcaacgaccucaacaagcgcguccaggaccucuccgccggcggccagggcucccucaccgacuccggccccgagcgccgccccgagggccccggcgcccaggcccccuccuccccccgcgucaccgaggcccccugcuaccccggcgcccccuccaccgaggccuccggccagaccggcccccaggagcccaccuccgcccgcgccuga

SEQ ID NO: 4213 - RNA, 1641 nt, Artificial Sequence
  derived and/or modified sequence opt3 from IL-14__Homo_sapiens__AAI03824
augaagaaccaggacaaaaagaauggcgccgcuaaacaaagcaaccccaaguccucuccugggcagccagaggcaggaccggaaggugcccaggagagacccucacaggcggcuccugccguggaagcagagggcccagggaguagccaagcccccaggaaaccugaaggagcucaggcacggaccgcccaguccggcgcucugcgcgaugucucugaggagcucucgcgacagcuugaagacauccugucaacauacugcguugauaauaaccaaggugggccaggagaggacggcgcccagggcgaacccgcggagccugaggaugcagaaaagagccguacuuauguggccagaaauggggagccagaaccgacgcccguagugaacggagagaaggaaccuaguaaaggugacccaaauaccgaggagauuaggcaguccgaugaagucggcgaccgggaucaccgcagaccccaggagaagaaaaaggcuaaaggguugggaaaggaaauaacauuacugaugcaaacucuaaacacccucucuacaccugaggaaaagcuggccgcacuuuguaaaaaguacgcugagcuguuggaggaacauaggaauagccagaaacagaugaagcuccugcagaaaaagcaaucccagcuggugcaggagaaagaccaccuccggggcgaacauucaaaggccguuuuagcgcgcaguaagcuggagagccuuugccgagaauugcaaagacacaacaggucucugaaagaggagggugugcagcgggcccgugaagaggaagagaagcgcaaagaggucaccucccauuuccaggugacucuaaaugauauccagcuccaaauggaacagcacaacgagagaaauucaaagcugaggcaggaaaacauggagcuugcagaacggcugaaaaaguugauugagcaguaugagcuccgagaagaacacaucgacaagguauuuaaacauaaggaucugcaacagcaguuaguugacgcuaaacugcagcaagcccaggaaaugcucaaggaggcugaggagcgccaccagagagagaaagacuuccuucugaaggaagccguggagagccaaaggaugugugaauugaugaagcagcaggagacacaucuaaaacagcaacuggcacucuacaccgaaaaguuugaggaguuccagaauacgcugaguaaaucuuccgaagucuuuacuaccuucaagcaggagauggagaaaaugacaaagaagauuaaaaagcuggaaaaagagacuaccauguaucggagccgcugggaaucgucuaacaaggcccuguuggagauggcugaagagaaaacagugagagauaaggaacucgaggggcuucaggugaaaauccaaagguuagagaagcugugccgugcgcuacagaccgaacggaacgaccucaauaagcgaguccaggaucuguccgcaggaggccagggcucacuuacggacagugggccagagagaaggcccgaaggaccgggugcccaagcuccuagcucuccccgcguuacugaggccccauguuacccuggcgcacccuccacagaagccagcgggcagaccggaccacaggagcccacuucagcucgggccuga

SEQ ID NO: 4214 - RNA, 1641 nt, Artificial Sequence
  derived and/or modified sequence opt4 from IL-14__Homo_sapiens__AAI03824
augaagaaccaggacaagaagaacggcgccgccaagcagagcaaccccaagagcagccccggccagcccgaggccggccccgagggcgcccaggagagacccagccaggccgcccccgccguggaggccgagggccccggcagcagccaggcccccagaaagcccgagggcgcccaggccagaaccgcccagagcggcgcccugagagacgugagcgaggagcugagcagacagcuggaggacauccugagcaccuacugcguggacaacaaccagggcggccccggcgaggacggcgcccagggcgagcccgccgagcccgaggacgccgagaagagcagaaccuacguggccagaaacggcgagcccgagcccacccccguggugaacggcgagaaggagcccagcaagggcgaccccaacaccgaggagaucagacagagcgacgaggugggcgacagagaccacagaagaccccaggagaagaagaaggccaagggccugggcaaggagaucacccugcugaugcagacccugaacacccugagcacccccgaggagaagcuggccgcccugugcaagaaguacgccgagcugcuggaggagcacagaaacagccagaagcagaugaagcugcugcagaagaagcagagccagcuggugcaggagaaggaccaccugagaggcgagcacagcaaggccgugcuggccagaagcaagcuggagagccugugcagagagcugcagagacacaacagaagccugaaggaggagggcgugcagagagccagagaggaggaggagaagagaaaggaggugaccagccacuuccaggugacccugaacgacauccagcugcagauggagcagcacaacgagagaaacagcaagcugagacaggagaacauggagcuggccgagagacugaagaagcugaucgagcaguacgagcugagagaggagcacaucgacaagguguucaagcacaaggaccugcagcagcagcugguggacgccaagcugcagcaggcccaggagaugcugaaggaggccgaggagagacaccagagagagaaggacuuccugcugaaggaggccguggagagccagagaaugugcgagcugaugaagcagcaggagacccaccugaagcagcagcuggcccuguacaccgagaaguucgaggaguuccagaacacccugagcaagagcagcgagguguucaccaccuucaagcaggagauggagaagaugaccaagaagaucaagaagcuggagaaggagaccaccauguacagaagcagaugggagagcagcaacaaggcccugcuggagauggccgaggagaagaccgugagagacaaggagcuggagggccugcaggugaagauccagagacuggagaagcugugcagagcccugcagaccgagagaaacgaccugaacaagagagugcaggaccugagcgccggcggccagggcagccugaccgacagcggccccgagagaagacccgagggccccggcgcccaggcccccagcagccccagagugaccgaggcccccugcuaccccggcgcccccagcaccgaggccagcggccagaccggcccccaggagcccaccagcgccagagccuga

SEQ ID NO: 4215 - RNA, 1641 nt, Artificial Sequence
  derived and/or modified sequence opt5 from IL-14__Homo_sapiens__AAI03824
augaagaaccaggacaaaaagaauggcgccgcuaaacaaagcaaccccaaguccucuccugggcagccggaggccggacccgaaggcgcgcaggagagaccuagccaggcugcccccgccguggaagcugaggggccuggauccucucaagcuccccggaaaccugaaggcgcccaggcccgcaccgcgcagagcggggcccugagagaugucuccgaggagcucucucggcagcuggaagacauccuuagcacauacugcguugauaauaaccaaggaggcccgggcgaggacggggcucagggagaacccgccgagccugaggaugcugaaaagucccgcacguauguggccagaaauggcgagcccgaaccuacccccguggucaacggggagaaggaaccgagcaaaggagacccuaauacagaggagauucggcagucugaugaagugggcgaccgcgaucacagacggccccaggagaagaaaaaggcgaaagggcugggaaaggaaaucacccuccugaugcaaacacuuaacacccuguccacaccugaggaaaagcucgccgcucuguguaaaaaguacgccgagcugcucgaggaacaucgcaauagccagaaacagaugaagcugcuucagaaaaagcaaucucagcugguucaggagaaagaccaccucagaggcgaacauuccaaggcugugcuggcccggagcaaacuugagucucugugccgcgaacuccaaagacacaaccggucccugaaggaggagggcguccagcgcgccagagaagaggaagagaagcggaaagaggugaccagccauuuccagguuacgcugaaugauauucagcuccaaauggaacagcacaacgagagaaauuccaagcugcgccaggaaaacauggagcuugcugaacggcugaaaaagcucaucgagcaguaugagcugagagaggaacacauugacaagguguuuaaacauaaggaucuucaacagcagcuggucgacgcgaaacuccagcaagcccaggaaaugcugaaggaggcugaggaacgccaccagcgggagaaagacuuccugcucaaggaagccguggagucucaaagaaugugugaacugaugaagcagcaggagacccaucuuaaacagcaacuggcccucuacacagaaaaguuugaggaguuccagaauacccugagcaaauccagcgaaguguuuacaaccuucaagcaggagauggagaaaaugacgaagaagaucaagaaacuugaaaaagagacaaccauguaucgcucucggugggaauccagcaacaaggcucugcucgagauggccgaagagaaaacagucagagauaaggaacuggaggggcugcagguuaaaauccaacgccucgagaagcugugccgggcgcuucagaccgaaagaaacgaccugaauaagcgcgugcaggaucucucugcuggaggccaggggagccugaccgacuccggacccgagcggagacccgaaggcccuggggcccaagccccgucuagcccccgggugacagaggcuccuuguuaccccggagccccuuccacggaagcuagcggccagaccggcccccaggagccgacaucugcccgcgcguga

SEQ ID NO: 4216 - RNA, 1641 nt, Artificial Sequence
  derived and/or modified sequence opt6 from IL-14__Homo_sapiens__AAI03824
augaaaaaccaagacaaaaaaaauggcgcagcaaagcaaagcaacccuaaaaguagcccaggccaacccgaagcaggaccggaaggugcacaagaaagaccaagccaagccgcaccagcaguagaagccgaaggcccaggaagcucacaagcaccaaggaaacccgaaggagcgcaagcacggacagcccaaaguggugcacuaagagauguuucagaagaacuaucacgacaacuagaagacaucuuauccaccuauugcguagauaauaaccaaggaggcccaggagaagauggagcccaaggcgaaccagcagaaccggaagacgcggaaaaaucaagaacuuaugucgcacgaaauggagaacccgaacccacgccaguaguaaacggcgaaaaagaaccaagcaaaggggacccgaauacagaagaaauaagacaaagcgacgaaguaggagacagggaucacagaagaccucaagaaaaaaaaaaagccaaaggacugggaaaagaaauuacauugcuaaugcaaacacuaaauacguuaagcacaccagaagagaaacucgcagcauugugcaaaaaauaugccgaauuacuagaagaacacagaaacucacaaaaacaaaugaaauuauuacaaaaaaaacaaagccaauuaguccaagaaaaggaccauuuaagaggagaacacucaaaagcaguacuagcacgaaguaaacucgaaucacuuuguagggaauuacaaaggcacaauagaucacuaaaagaagaaggaguacaaagagcacgagaagaagaggagaaacgaaaagaaguaacgagucauuuccaaguuacauuaaaugauauccaauuacaaauggaacaacacaacgaaagaaauucaaaguuacgacaagaaaauauggaacuagcagaaagauuaaaaaaauuaauagaacaauaugaacuaagagaagaacauauugauaaaguauuuaaacauaaagacuuacaacaacaacuaguagacgccaaacuacaacaagcacaagaaauguugaaagaagccgaagaacgacaccaaagagaaaaagauuucuuauuaaaggaagcaguagaaagucagagaaugugugaauuaaugaaacaacaagaaacccacuuaaaacaacaacuugcauuauacacagaaaaauuugaagaauuccaaaacacauuaucaaagucaagugagguuuuuacaacauuuaaacaagaaauggaaaaaaugaccaaaaagauaaaaaaauuagaaaaagaaaccacaauguauagaagcagaugggaaucaucaaauaaagcacuacuagaaauggcagaagaaaagacaguaagagauaaagaauuagaagguuugcaagugaaaauacaaagacuagaaaaacuaugcagagcacuacaaacagaaaggaacgauuuaaauaaaagaguacaagacuuaucagcaggaggacaaggaagucuaacagacucaggaccagaaagacgaccugaaggaccuggcgcacaagcaccaucaagucccagaguaacagaggcaccaugcuaccccggagcacccaguacagaagcuagcggacagacgggaccacaagaaccaacgucagcaagagcguaa

SEQ ID NO: 4217 - protein, 162 aa, Artificial Sequence
  IL-15__Homo_sapiens__P40933
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 4218 - RNA, 489 nt, Artificial Sequence
  IL-15__Homo_sapiens__AAA21551
augagaauuucgaaaccacauuugagaaguauuuccauccagugcuacuuguguuuacuucuaaacagucauuuucuaacugaagcuggcauucaugucuucauuuugggcuguuucagugcagggcuuccuaaaacagaagccaacugggugaauguaauaagugauuugaaaaaaauugaagaucuuauucaaucuaugcauauugaugcuacuuuauauacggaaagugauguucaccccaguugcaaaguaacagcaaugaagugcuuucucuuggaguuacaaguuauuucacuugaguccggagaugcaaguauucaugauacaguagaaaaucugaucauccuagcaaacaacaguuugucuucuaaugggaauguaacagaaucuggaugcaaagaaugugaggaacuggaggaaaaaaauauuaaagaauuuuugcagaguuuuguacauauuguccaaauguucaucaacacuucuuga

SEQ ID NO: 4219 - RNA, 489 nt, Artificial Sequence
  derived and/or modified sequence opt1 from IL-15__Homo_sapiens__AAA21551
augcgcaucagcaagccccaccuccgguccaucagcauccagugcuaccugugccugcugcucaacucccacuuccugaccgaggccggcauccacguguucauccuggggugcuucagcgccggccucccgaagaccgaggcgaacugggucaacgugaucuccgaccugaagaagaucgaggaccugauccagagcaugcacaucgacgccacgcucuacaccgaguccgacgugcaccccagcugcaaggucaccgccaugaagugcuuccugcuggagcuccaggugaucucccuggagagcggggacgccuccauccacgacaccguggagaaccugaucauccucgccaacaacagccuguccagcaacggcaacgucacggaguccgggugcaaggagugcgaggagcuggaggagaagaacaucaaggaguuccuccagagcuucgugcacaucgugcagauguucaucaacaccuccuga

SEQ ID NO: 4220 - RNA, 489 nt, Artificial Sequence
  derived and/or modified sequence opt2 from IL-15__Homo_sapiens__AAA21551
augcgcaucuccaagccccaccuccgcuccaucuccauccagugcuaccucugccuccuccucaacucccacuuccucaccgaggccggcauccacgucuucauccucggcugcuucuccgccggccuccccaagaccgaggccaacugggucaacgucaucuccgaccucaagaagaucgaggaccucauccaguccaugcacaucgacgccacccucuacaccgaguccgacguccaccccuccugcaaggucaccgccaugaagugcuuccuccucgagcuccaggucaucucccucgaguccggcgacgccuccauccacgacaccgucgagaaccucaucauccucgccaacaacucccucuccuccaacggcaacgucaccgaguccggcugcaaggagugcgaggagcucgaggagaagaacaucaaggaguuccuccaguccuucguccacaucguccagauguucaucaacaccuccuga

SEQ ID NO: 4221 - RNA, 489 nt, Artificial Sequence
  derived and/or modified sequence opt3 from IL-15__Homo_sapiens__AAA21551
augagaaucagcaagccccaccugagguccauuucuauacagugcuaccucugucuucuguugaacucacauuucuuaaccgaagccggcauccacguguuuauucuggggugcuucagugcuggacuaccuaaaacagaagcaaauugggucaacguuaucagcgaccucaagaaaauugaggaucugauccaauccaugcauauagacgccacucuuuauacggaaucugaugugcacccaucguguaagguaaccgcgaugaaaugcuuucuguuggagcuccaggugaucucacuggaaagcggugacgcuaguauucaugauacagucgagaaucugaucauucucgccaacaauuccuuaucuagcaacggcaaugugacugaguccggguguaaggaaugcgaggaacuggaggagaagaacaucaaagaguuccuucagucauuuguucacauagugcagauguucauuaauaccaguuga

SEQ ID NO: 4222 - RNA, 489 nt, Artificial Sequence
  derived and/or modified sequence opt4 from IL-15__Homo_sapiens__AAA21551
augagaaucagcaagccccaccugagaagcaucagcauccagugcuaccugugccugcugcugaacagccacuuccugaccgaggccggcauccacguguucauccugggcugcuucagcgccggccugcccaagaccgaggccaacugggugaacgugaucagcgaccugaagaagaucgaggaccugauccagagcaugcacaucgacgccacccuguacaccgagagcgacgugcaccccagcugcaaggugaccgccaugaagugcuuccugcuggagcugcaggugaucagccuggagagcggcgacgccagcauccacgacaccguggagaaccugaucauccuggccaacaacagccugagcagcaacggcaacgugaccgagagcggcugcaaggagugcgaggagcuggaggagaagaacaucaaggaguuccugcagagcuucgugcacaucgugcagauguucaucaacaccagcuga

SEQ ID NO: 4223 - RNA, 489 nt, Artificial Sequence
  derived and/or modified sequence opt5 from IL-15__Homo_sapiens__AAA21551
augagaaucagcaagccccaucugcgguccauuucuauccagugcuaccucugucugcuucugaacagccacuuccucaccgaagccggcauucacguguuuauccuggggugcuucuccgcuggacuuccuaaaacagaagccaauugggucaacguuauuucugaccugaagaaaaucgaggaucucauccaaagcaugcauauugacgcgacgcuguauaccgaauccgaugugcacccgucuuguaaggugacagcuaugaaaugcuuucugcucgagcugcaggucaucagccuugaauccggcgacgccagcauucaugauaccguggagaaucugaucauucucgccaacaauucucuguccagcaacgggaauguuacagagucuggauguaaggaaugcgaggaacuugaggagaagaacaucaaagaguuccugcaguccuuugugcacauuguccagauguucaucaauaccagcuga

SEQ ID NO: 4224 - RNA, 489 nt, Artificial Sequence
  derived and/or modified sequence opt6 from IL-15__Homo_sapiens__AAA21551
augagaauaucaaaaccacaccucagaucaauaucaauacaaugcuacuuaugccuacuacuaaacucacacuuccuaacagaagcaggaauacacguauucauacucggaugcuucagcgcaggacuaccaaaaacagaagcaaacuggguaaacguaauaucagaccuaaaaaaaauagaagaccuaauacaaucaaugcacauagacgccacacuauacacagaaucagacguacacccaucaugcaaaguaacagcaaugaaaugcuuccuacuagaacuacaaguaauaucacucgaaucaggagacgcaucaauacacgacacaguagaaaaccuaauaauacuagcaaacaacucacuaucaucaaacggaaacguaacagaaucaggaugcaaagaaugcgaagaauuagaagaaaaaaacauaaaagaauuccuacaaucauucguacacauaguacaaauguucauaaacacaucauaa

SEQ ID NO: 4225 - protein, 1332 aa, Artificial Sequence
  IL-16__Homo_sapiens__Q14005
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 4226 - RNA, 3999 nt, Artificial Sequence
  IL-16__Homo_sapiens__CCDS42069.1
auggagucgcacagccgcgcuggaaagagcagaaaaucugcaaaauuucgguccaucuccaggucccugaugcucuguaaugcuaagaccagugaugauggcucuagcccugaugagaaauauccugaucccuuugagauuuccuuggcccagggcaaggagggaauuuuccacucaucugugcagcuggcagacacaucggaggcugggcccagcaguguuccugaucuagcacuggccucggaggcugcucaacuccaagcagcugggaaugaucgaggcaagaccuguaggaggauauucuucaugaaggaaucuuccacagcuuccucucgagaaaagccuggaaaacuagaagcacaaaguaguaacuuccuguuuccuaaagccugccaccaaagggcacgcagcaacucaaccaguguuaaucccuauugcacaagagaaauugauuuuccaaugaccaagaaaucugcagcgcccacggacaggcagccuuacucucucugcaguaacaggaagucccucucucaacaauuggacuguccagcaggaaaggcugcgggaacuucgagaccaacacggucccugagcacagcucagcucgugcagccaucugggggccuccaggcuucagucaucuccaacaucgugcugaugaagggccaggcuaagggucugggcuucagcaucguugggggaaaagacagcauuuauggccccauugggauuuacgucaaaaccauuuuugcagggggagcagcagcagccgauggaaggcuacaggaaggugaugaaauucuggagcucaauggugaaucaauggcuggacuaacacaucaggaugcuuugcagaaguucaagcaagccaaaaaggggcuccucacccucaccgugagaacccgccugacggcgccuccuucccugugcagccaccugucucccccacugugccgcucccugagcuccagcacuuguaucaccaaggacagcagcuccuucgccuuggaaagccccucggcucccaucagcaccgccaagcccaauuacagaaucaugguggagguuucucugcagaaagaggccggcgugggccugggcaucggccugugcagcguucccuacuuccaaugcaucucuggcauuuucguccacacgcugucaccaggauccguggcgcaccuggacggacgucuccgguguggggacgagauuguggaaaucagugauuccccugugcacugccugacgcucaaugaagucuacacgauccugagucacugugaucccgguccaguccccaucauuguuagccgacauccagacccacaggucucugaacagcaacucaaagaagcuguggcccaggcuguggaaaacaccaaguuuggaaaggagaggcaucaguggagucuggaaggugucaaaaggcuggaaagcaguuggcacgggcggcccaccuuggagaaggaacgagagaagaacucagcacccccgcaucgcagggcucagaaggucaugauccgcuccagcagugacagcagcuacaugucuggguccccagggggaaguccugggaguggcagugcugagaagccguccucugacguggacaucagcacacacagccccagcuugccucuggcacgggagccaguggugcuuucuauagcauccuccaggcugccccaggagagcccaccccucccagagagccgggacagccacccgccgcugagacugaagaaauccuuugagauuuuggugagaaagccuauguccuccaagcccaagccuccacccagaaaauacuuuaaaagugacagugacccucagaagagucuggaagagagagagaacuccucaugcucuucugggcacaccccacccaccuguggccaggaagcgagagagcugcugccacugcugcuaccacaggaagacacagcagggagaagcccuagugccucugccggcugcccaggaccugguaucggcccacagaccaaguccuccacagagggcgagccaggguggagaagagccagcccagugacccaaacauccccgauaaaacacccacugcuuaagaggcaggcucggauggacuauagcuuugauaccacagccgaagacccuuggguuaggauuucugacugcaucaaaaacuuauuuagccccaucaugagugagaaccauggccacaugccucuacagcccaaugccagccugaaugaagaagaagggacacagggccacccagaugggaccccaccaaagcuggacaccgccaauggcacucccaaaguuuacaagucagcagacagcagcacugugaagaaagguccuccuguggcucccaagccagccugguuucgccaaagcuugaaagguuugaggaaucgugcuucagacccaagagggcucccugauccugccuuguccacccagccagcaccugcuuccagggagcaccuaggaucacacauccgggccuccuccuccuccuccuccaucaggcagagaaucagcuccuuugaaaccuuuggcuccucucaacugccugacaaaggagcccagagacugagccuccagcccuccucuggggaggcagcaaaaccucuugggaagcaugaggaaggacgguuuucuggacucuuggggcgaggggcugcacccacucuugugccccagcagccugagcaaguacuguccucgggguccccugcagccuccgaggccagagacccaggugugucugaguccccucccccagggcggcagcccaaucagaaaacucuccccccuggcccggacccgcuccuaaggcugcugucaacacaggcugaggaaucucaaggcccagugcucaagaugccuagccagcgagcacggagcuucccccugaccaggucccaguccugugagacgaagcuacuugacgaaaagaccagcaaacucuauucuaucagcagccaagugucaucggcugucaugaaauccuugcugugccuuccaucuucuaucuccugugcccagacucccugcauccccaaggaaggggcaucuccaacaucaucauccaacgaagacucagcugcaaaugguucugcugaaacaucugccuuggacacaggguucucgcucaaccuuucagagcugagagaauauacagagggucucacggaagccaaggaagacgaugauggggaccacaguucccuucagucuggucaguccguuaucucccugcugagcucagaagaauuaaaaaaacucaucgaggaggugaagguucuggaugaagcaacauuaaagcaauuagacggcauccaugucaccaucuuacacaaggaggaaggugcuggucuuggguucagcuuggcaggaggagcagaucuagaaaacaaggugauuacgguucacagaguguuuccaaaugggcuggccucccaggaagggacuauucagaagggcaaugagguucuuuccaucaacggcaagucucucaaggggaccacgcaccaugaugccuuggccauccuccgccaagcucgagagcccaggcaagcugugauugucacaaggaagcugacuccagaggccaugcccgaccucaacuccuccacugacucugcagccucagccucugcagccagugauguuucuguagaaucuacagcagaggccacagucugcacggugacacuggagaagaugucggcagggcugggcuucagccuggaaggagggaagggcucccuacacggagacaagccucucaccauuaacaggauuuucaaaggagcagccucagaacaaagugagacaguccagccuggagaugaaaucuuacagcuggguggcacugccaugcagggccucacacgguuugaagccuggaacaucaucaaggcacugccugauggaccugucacgauugucaucaggagaaaaagccuccaguccaaggaaaccacagcugcuggagacuccuag

SEQ ID NO: 4227 - RNA, 3999 nt, Artificial Sequence
  derived and/or modified sequence opt1 from IL-16__Homo_sapiens__CCDS42069.1
auggagagccacucccgcgccggcaagagccggaaguccgccaaguuccgcagcaucucccggagccugaugcucugcaacgcgaagaccuccgacgacgggagcucccccgacgagaaguacccggaccccuucgagaucagccuggcccagggcaaggaggggaucuuccacuccagcgugcagcuggccgacaccuccgaggccggccccagcuccguccccgaccucgcccuggcgagcgaggccgcccagcugcaggccgcggggaacgaccgcggcaagacgugccggcgcaucuucuucaugaaggaguccagcaccgccuccagccgggagaagccgggcaagcucgaggcccagagcuccaacuuccuguuccccaaggccugccaccagcgcgcccggagcaacuccaccagcgugaaccccuacugcacccgcgagaucgacuuccccaugacgaagaaguccgcggccccgaccgaccggcagcccuacagccugugcuccaaccgcaagagccucucccagcagcuggacugccccgccgggaaggccgccggcaccagccggcccacccgcucccugagcacggcgcagcucgugcagccguccgggggccugcaggccagcgucaucuccaacaucgugcugaugaaggggcaggccaagggccucggcuucagcaucguggggggcaaggacuccaucuacgggcccaucggcaucuacgucaagaccaucuucgccggcggggccgcggccgccgacggccggcugcaggagggggacgagauccuggagcucaacggcgagagcauggccgggcugacccaccaggacgcccugcagaaguucaagcaggcgaagaagggccuccugacccugacggugcgcacccggcucaccgccccccccucccugugcagccaccugagcccgccccucugccgcucccugagcuccagcaccugcaucacgaaggacuccagcuccuucgcccuggagagccccuccgcccccaucagcaccgcgaagccgaacuaccggaucaugguggaggucucccuccagaaggaggccggcguggggcugggcaucgggcugugcagcgugcccuacuuccagugcaucuccggcaucuucguccacacccucagccccggguccguggcccaccuggacggccgccugcggugcggcgacgagaucguggagaucagcgacucccccguccacugccucacccugaacgagguguacacgauccugagccacugcgacccggggcccgugcccaucaucgucagccgccaccccgacccgcagguguccgagcagcagcucaaggaggccguggcccaggcggucgagaacaccaaguucggcaaggagcgccaccaguggagccuggagggggugaagcggcuggaguccagcuggcacggccgccccacccucgagaaggagcgggagaagaacuccgcccccccgcaccgccgggcccagaaggugaugauccgcagcuccagcgacuccagcuacauguccgggagccccggcggcucccccgggagcggcuccgccgagaagcccagcuccgacgucgacaucagcacccacuccccgagccugccccuggcccgggagcccgugguccucagcaucgcguccagccgccugccccaggaguccccgccccugcccgagagccgggacucccaccccccgcuccgccugaagaagagcuucgagauccuggugcggaagcccauguccagcaagcccaagcccccgccccgcaaguacuucaaguccgacagcgacccccagaagucccuggaggagcgggagaacagcuccugcagcuccgggcacacgcccccgaccugcggccaggaggcccgcgagcuccugccccugcuccugccccaggaggacaccgccggccggagccccuccgccagcgccgggugcccgggccccgggaucggcccccagaccaaguccagcacggagggggagccgggcuggcgccgggcgagccccgugacccagaccucccccaucaagcacccccugcucaagcgccaggcccggauggacuacagcuucgacaccacggccgaggacccguggguccgcaucuccgacugcaucaagaaccuguucagccccaucauguccgagaaccacggccacaugccccugcagcccaacgccagccucaacgaggaggaggggacccagggccacccggacgggaccccccccaagcuggacaccgcgaacggcacgcccaagguguacaaguccgccgacagcuccaccgugaagaaggggccgcccgucgcccccaagcccgccugguuccgccagagccugaagggccuccggaaccgcgccuccgacccgcggggccugcccgaccccgcgcugagcacccagcccgccccggccucccgcgagcaccucgggagccacauccgggccuccagcuccagcuccagcauccgccagcggaucagcuccuucgagaccuucggcagcucccagcugcccgacaagggggcccagcgccugagccuccagcccuccagcggcgaggcggccaagccccuggggaagcacgaggagggccgguucuccggccugcucgggcgcggcgccgccccgacccuggugccccagcagcccgagcaggugcugagcuccgggagccccgccgcguccgaggcccgggacccgggcgucagcgaguccccccccccggggcgccagcccaaccagaagacgcucccccccggcccggacccccugcugcggcuccugagcacccaggccgaggagucccagggccccgugcugaagaugcccagccagcgcgcccgguccuucccgcucacccgcagccaguccugcgagaccaagcugcuggacgagaagacgagcaagcucuacagcaucuccagccagguguccagcgcggucaugaagucccugcugugccuccccagcuccaucagcugcgcccagacccccugcauccccaaggagggggccuccccgaccagcuccagcaacgaggacuccgccgccaacggcagcgcggagaccuccgcccuggacacgggguucagccugaaccucuccgagcugcgggaguacaccgagggccugaccgaggccaaggaggacgacgacggcgaccacagcucccuccagagcgggcagagcgugaucucccugcugagcuccgaggagcucaagaagcugaucgaggaggugaagguccuggacgaggccacccucaagcagcuggacggcauccacgugacgauccugcacaaggaggagggggccggccucggguucagccuggcgggcggcgccgaccuggagaacaaggugaucaccguccaccgcguguuccccaacgggcucgccucccaggagggcaccauccagaaggggaacgaggugcugagcaucaacggcaagucccugaaggggaccacgcaccacgacgcccucgccauccugcggcaggcgcgcgagccccggcaggccgucaucgugacccgcaagcugacccccgaggccaugccggaccucaacagcuccaccgacagcgccgccuccgcgagcgccgccuccgacgugagcgucgaguccacggccgaggcgaccgugugcaccgugacccuggagaagaugagcgccggccugggcuucucccucgaggggggcaaggggagccugcacggcgacaagccccugacgaucaaccgcaucuucaagggggccgccagcgagcaguccgagaccguccagcccggcgacgagauccuccagcugggcgggaccgccaugcagggccugacccgguucgaggcguggaacaucaucaaggcccuccccgacgggccggugacgaucgugauccgccggaagagccugcaguccaaggagaccaccgccgccggcgacagcuga

SEQ ID NO: 4228 - RNA, 3999 nt, Artificial Sequence
  derived and/or modified sequence opt2 from IL-16__Homo_sapiens__CCDS42069.1
auggagucccacucccgcgccggcaagucccgcaaguccgccaaguuccgcuccaucucccgcucccucaugcucugcaacgccaagaccuccgacgacggcuccucccccgacgagaaguaccccgaccccuucgagaucucccucgcccagggcaaggagggcaucuuccacuccuccguccagcucgccgacaccuccgaggccggccccuccuccguccccgaccucgcccucgccuccgaggccgcccagcuccaggccgccggcaacgaccgcggcaagaccugccgccgcaucuucuucaugaaggaguccuccaccgccuccucccgcgagaagcccggcaagcucgaggcccaguccuccaacuuccucuuccccaaggccugccaccagcgcgcccgcuccaacuccaccuccgucaaccccuacugcacccgcgagaucgacuuccccaugaccaagaaguccgccgcccccaccgaccgccagcccuacucccucugcuccaaccgcaagucccucucccagcagcucgacugccccgccggcaaggccgccggcaccucccgccccacccgcucccucuccaccgcccagcucguccagcccuccggcggccuccaggccuccgucaucuccaacaucguccucaugaagggccaggccaagggccucggcuucuccaucgucggcggcaaggacuccaucuacggccccaucggcaucuacgucaagaccaucuucgccggcggcgccgccgccgccgacggccgccuccaggagggcgacgagauccucgagcucaacggcgaguccauggccggccucacccaccaggacgcccuccagaaguucaagcaggccaagaagggccuccucacccucaccguccgcacccgccucaccgccccccccucccucugcucccaccucucccccccccucugccgcucccucuccuccuccaccugcaucaccaaggacuccuccuccuucgcccucgagucccccuccgcccccaucuccaccgccaagcccaacuaccgcaucauggucgaggucucccuccagaaggaggccggcgucggccucggcaucggccucugcuccguccccuacuuccagugcaucuccggcaucuucguccacacccucucccccggcuccgucgcccaccucgacggccgccuccgcugcggcgacgagaucgucgagaucuccgacucccccguccacugccucacccucaacgaggucuacaccauccucucccacugcgaccccggccccguccccaucaucgucucccgccaccccgacccccaggucuccgagcagcagcucaaggaggccgucgcccaggccgucgagaacaccaaguucggcaaggagcgccaccaguggucccucgagggcgucaagcgccucgaguccuccuggcacggccgccccacccucgagaaggagcgcgagaagaacuccgcccccccccaccgccgcgcccagaaggucaugauccgcuccuccuccgacuccuccuacauguccggcucccccggcggcucccccggcuccggcuccgccgagaagcccuccuccgacgucgacaucuccacccacucccccucccucccccucgcccgcgagcccgucguccucuccaucgccuccucccgccucccccaggagucccccccccuccccgagucccgcgacucccaccccccccuccgccucaagaaguccuucgagauccucguccgcaagcccauguccuccaagcccaagccccccccccgcaaguacuucaaguccgacuccgacccccagaagucccucgaggagcgcgagaacuccuccugcuccuccggccacaccccccccaccugcggccaggaggcccgcgagcuccucccccuccuccucccccaggaggacaccgccggccgcucccccuccgccuccgccggcugccccggccccggcaucggcccccagaccaaguccuccaccgagggcgagcccggcuggcgccgcgccucccccgucacccagaccucccccaucaagcacccccuccucaagcgccaggcccgcauggacuacuccuucgacaccaccgccgaggaccccuggguccgcaucuccgacugcaucaagaaccucuucucccccaucauguccgagaaccacggccacaugccccuccagcccaacgccucccucaacgaggaggagggcacccagggccaccccgacggcaccccccccaagcucgacaccgccaacggcacccccaaggucuacaaguccgccgacuccuccaccgucaagaagggcccccccgucgcccccaagcccgccugguuccgccagucccucaagggccuccgcaaccgcgccuccgacccccgcggccuccccgaccccgcccucuccacccagcccgcccccgccucccgcgagcaccucggcucccacauccgcgccuccuccuccuccuccuccauccgccagcgcaucuccuccuucgagaccuucggcuccucccagcuccccgacaagggcgcccagcgccucucccuccagcccuccuccggcgaggccgccaagccccucggcaagcacgaggagggccgcuucuccggccuccucggccgcggcgccgcccccacccucgucccccagcagcccgagcagguccucuccuccggcucccccgccgccuccgaggcccgcgaccccggcgucuccgagucccccccccccggccgccagcccaaccagaagacccucccccccggccccgacccccuccuccgccuccucuccacccaggccgaggagucccagggccccguccucaagaugcccucccagcgcgcccgcuccuucccccucacccgcucccaguccugcgagaccaagcuccucgacgagaagaccuccaagcucuacuccaucuccucccaggucuccuccgccgucaugaagucccuccucugccuccccuccuccaucuccugcgcccagacccccugcauccccaaggagggcgccucccccaccuccuccuccaacgaggacuccgccgccaacggcuccgccgagaccuccgcccucgacaccggcuucucccucaaccucuccgagcuccgcgaguacaccgagggccucaccgaggccaaggaggacgacgacggcgaccacuccucccuccaguccggccaguccgucaucucccuccucuccuccgaggagcucaagaagcucaucgaggaggucaagguccucgacgaggccacccucaagcagcucgacggcauccacgucaccauccuccacaaggaggagggcgccggccucggcuucucccucgccggcggcgccgaccucgagaacaaggucaucaccguccaccgcgucuuccccaacggccucgccucccaggagggcaccauccagaagggcaacgagguccucuccaucaacggcaagucccucaagggcaccacccaccacgacgcccucgccauccuccgccaggcccgcgagccccgccaggccgucaucgucacccgcaagcucacccccgaggccaugcccgaccucaacuccuccaccgacuccgccgccuccgccuccgccgccuccgacgucuccgucgaguccaccgccgaggccaccgucugcaccgucacccucgagaagauguccgccggccucggcuucucccucgagggcggcaagggcucccuccacggcgacaagccccucaccaucaaccgcaucuucaagggcgccgccuccgagcaguccgagaccguccagcccggcgacgagauccuccagcucggcggcaccgccaugcagggccucacccgcuucgaggccuggaacaucaucaaggcccuccccgacggccccgucaccaucgucauccgccgcaagucccuccaguccaaggagaccaccgccgccggcgacuccuga

SEQ ID NO: 4229 - RNA, 3999 nt, Artificial Sequence
  derived and/or modified sequence opt3 from IL-16__Homo_sapiens__CCDS42069.1
auggagagccacuccagagccggcaagucuaggaaaucagcuaaguuccggaguaucagccgcucccugaugcucugcaacgcaaaaaccucugacgaugggucgucacccgacgaaaaguacccugauccauuugagauuagccuugcccagggaaaagaagguauauuccauaguuccgugcaacuggcggacacaucugaggcuggcccgagcuccguccccgauuuggccuuagcaucagaagccgcucagcugcaggcagccgggaaugaccgaggaaagacuugucguagaaucuuuuucaugaaggagaguagcacggcuucuuccagggagaaaccuggcaagcuagaagcccagucaagcaacuuucucuucccaaaagcgugccaccaacgggcacgcaguaauucuaccuccguuaaccccuauuguacaagagagauugauuuuccuaugacuaagaaaagcgccgcuccaaccgacaggcagcccuacucgcugugcucuaaucggaagucccuuucacagcagcuggauuguccugccgguaaggcagcugggacaagucgcccaacccgaagccuuuccacugcccaacucgugcagccgucuggaggccugcaggcgagcguaaucucaaacauugugcugaugaaaggccaggccaaggggcucggauucaguaucgucgguggcaaagacuccauauaugggcccaucggaauuuacgugaagacaaucuuugcaggcggugcugccgcugccgaugggagauuacaagaaggagacgagauucuggagcuuaauggcgaaagcauggcaggcuugacccaucaggaugcccugcagaaauucaagcaagcuaaaaaggggcuacucacgcugacuguuaggacccggcuuacagcgccuccaucucugugcucacacuugagucccccucucugucguagccuguccucuucgacuugcaucaccaaggacagcuccucauuugcauuagagaguccaucugcccccauaagcacagcuaaaccgaacuaucgcauuaugguggaagucucccugcagaaggaggccggagugggucucggcaucgggcuuuguucaguaccuuacuuccagugcauuagcggaaucuuuguucauacccugucucccggcuccguggcacacuuggacgguagacuaagguguggggaugaaaucgucgagauuagugacagcccagugcacugccugacgcucaaugagguguauacuauacugucucauugcgauccuggccccgucccaaucauuguuucccggcaccccgacccucaggugucagaacaacagcuuaaagaggccguagcucaggccguggaaaacacaaaguucggaaaagagcgacaucaguggagucuggaaggcgucaagcgcuuggagagcucguggcacgggagaccaacccucgagaaggaaagggagaaaaauuccgcaccgccccaccggcgcgcgcaaaaggugaugaucagaucuagcucagauaguuccuacaugucuggaagcccugguggcuccccagggucaggaagcgcugaaaaacccaguucugacguugauauauccacucauagcccuucgcugccauuagccagggagcccgugguccugucaauugcaucuagucgucuaccgcaggaauccccuccacuccccgagagccgggacucucacccuccccugcgacuuaagaaauccuucgagaucuuggugagaaagccaaugagcucaaagccuaaacccccaccgaggaaguacuuuaaaagugauagcgacccucagaagucucuggaggagcgcgaaaacuccucauguaguagcggccauacacccccaaccugcggucaggaggcccgggagcuccugccccuucuguugccucaagaagauacggcugggagauccccaucugccucggcaggcugucccggaccuggcaucgggccgcagaccaaaagcucaacagagggagaaccagguuggaggcgcgcuucccccguaacucagaccaguccuauuaagcacccacuccugaagcgacaggcccggauggacuauucuuucgacacaacugcggaggaucccuggguucguaucagcgacugcauuaaaaauuuauuuuccccuauaaugucagaaaaccauggccacaugccgcugcaacccaaugccucucuaaacgaggaggaagggacccagggacacccagauggcacaccucccaagcucgacaccgcuaacgguacuccaaaaguguacaagagcgcagauaguuccacggucaaaaaggggccucccguggccccaaaaccggcuugguucagacagagccugaagggccuuaggaaucgcgccucugacccucggggauugcccgauccagcacugucaacacaacccgcgccugccuccagagagcaucucggcagucacaucagggcuagcucgucuuccagcucaauucgacagcgcaucaguucuuuugaaaccuucggguccagccagcugccagacaagggagcccagcgguuaucacugcaacccaguagcggcgaggcagcuaaaccucuugguaagcaugaagaggggagauuuuccggauugcucggcaggggugccgcaccgacucuggucccacagcagcccgaacaggugcuaucuagcggcuccccugccgcuucagaagcgcgugaucccgggguuucugagaguccaccucccggacgccaaccaaaccagaaaacccugccuccgggccccgacccacuccugcggcuuuugucgacacaggccgaagagagccaggggccugugcugaagaugcccucccaaagagcaaggucuuucccauuaacccgaucacagagcugugaaacuaaacuccuggaugagaagacauccaaguuguauaguaucucuagccagguaucauccgcugucaugaaaagucuguugugccucccuagcucuauuuccugugcccaaacgcccugcauaccgaaggagggagccucaccaaccagcucgucuaaugaagacagugcugcaaacggcuccgccgagacuagcgcgcuggauacagguuuuucacuaaaucuguccgaacuccgggaguacaccgaggggcugacagaagcuaaagaggacgacgauggagaccacucuagccuucagaguggccaguccgugaucagcuugcugucuucagaagaguuaaagaaacucauugaagagguuaaggugcuggaugaggccacucuuaagcagcuggacgguauccacgucaccauucuacauaaagaagagggcgcagggcucggauucagucuggccggcggggcugauuuggaaaacaaggugaucacgguacaccgcguguuuccuaauggacuggcaucccaagagggcaccauacagaaagguaacgaaguuuuaagcaucaaugggaagucucucaaaggaacaacucaucacgacgcccuggcgauucuuagacaggcuagggagccccggcaggccgucaucgugacccgaaagcugacaccagaggcaaugcccgauuugaacucgucaacugacagcgccgcuuccgccagugcagcuucugaugugagcgucgaauccaccgccgaggcgacgguuuguacagugacccucgaaaagaugucagccggccuggguuucagucuagagggcgggaaaggaucucugcauggcgacaagccucuuacuauuaauagaaucuuuaaaggggcagcuagcgaacaauccgagacagugcagccgggagaugagauacuccagcugggcgguaccgccaugcagggguugacucgcuucgaggcuuggaacauuaucaaggcacugcccgacggaccaguaaccauugucaucaggcguaaaucauuacaaagcaaggaaacaacggccgccggcgauucuuga

SEQ ID NO: 4230 - RNA, 3999 nt, Artificial Sequence
  derived and/or modified sequence opt4 from IL-16__Homo_sapiens__CCDS42069.1
auggagagccacagcagagccggcaagagcagaaagagcgccaaguucagaagcaucagcagaagccugaugcugugcaacgccaagaccagcgacgacggcagcagccccgacgagaaguaccccgaccccuucgagaucagccuggcccagggcaaggagggcaucuuccacagcagcgugcagcuggccgacaccagcgaggccggccccagcagcgugcccgaccuggcccuggccagcgaggccgcccagcugcaggccgccggcaacgacagaggcaagaccugcagaagaaucuucuucaugaaggagagcagcaccgccagcagcagagagaagcccggcaagcuggaggcccagagcagcaacuuccuguuccccaaggccugccaccagagagccagaagcaacagcaccagcgugaaccccuacugcaccagagagaucgacuuccccaugaccaagaagagcgccgcccccaccgacagacagcccuacagccugugcagcaacagaaagagccugagccagcagcuggacugccccgccggcaaggccgccggcaccagcagacccaccagaagccugagcaccgcccagcuggugcagcccagcggcggccugcaggccagcgugaucagcaacaucgugcugaugaagggccaggccaagggccugggcuucagcaucgugggcggcaaggacagcaucuacggccccaucggcaucuacgugaagaccaucuucgccggcggcgccgccgccgccgacggcagacugcaggagggcgacgagauccuggagcugaacggcgagagcauggccggccugacccaccaggacgcccugcagaaguucaagcaggccaagaagggccugcugacccugaccgugagaaccagacugaccgccccccccagccugugcagccaccugagccccccccugugcagaagccugagcagcagcaccugcaucaccaaggacagcagcagcuucgcccuggagagccccagcgcccccaucagcaccgccaagcccaacuacagaaucaugguggaggugagccugcagaaggaggccggcgugggccugggcaucggccugugcagcgugcccuacuuccagugcaucagcggcaucuucgugcacacccugagccccggcagcguggcccaccuggacggcagacugagaugcggcgacgagaucguggagaucagcgacagccccgugcacugccugacccugaacgagguguacaccauccugagccacugcgaccccggccccgugcccaucaucgugagcagacaccccgacccccaggugagcgagcagcagcugaaggaggccguggcccaggccguggagaacaccaaguucggcaaggagagacaccaguggagccuggagggcgugaagagacuggagagcagcuggcacggcagacccacccuggagaaggagagagagaagaacagcgcccccccccacagaagagcccagaaggugaugaucagaagcagcagcgacagcagcuacaugagcggcagccccggcggcagccccggcagcggcagcgccgagaagcccagcagcgacguggacaucagcacccacagccccagccugccccuggccagagagcccguggugcugagcaucgccagcagcagacugccccaggagagccccccccugcccgagagcagagacagccaccccccccugagacugaagaagagcuucgagauccuggugagaaagcccaugagcagcaagcccaagcccccccccagaaaguacuucaagagcgacagcgacccccagaagagccuggaggagagagagaacagcagcugcagcagcggccacaccccccccaccugcggccaggaggccagagagcugcugccccugcugcugccccaggaggacaccgccggcagaagccccagcgccagcgccggcugccccggccccggcaucggcccccagaccaagagcagcaccgagggcgagcccggcuggagaagagccagccccgugacccagaccagccccaucaagcacccccugcugaagagacaggccagaauggacuacagcuucgacaccaccgccgaggaccccugggugagaaucagcgacugcaucaagaaccuguucagccccaucaugagcgagaaccacggccacaugccccugcagcccaacgccagccugaacgaggaggagggcacccagggccaccccgacggcaccccccccaagcuggacaccgccaacggcacccccaagguguacaagagcgccgacagcagcaccgugaagaagggcccccccguggcccccaagcccgccugguucagacagagccugaagggccugagaaacagagccagcgaccccagaggccugcccgaccccgcccugagcacccagcccgcccccgccagcagagagcaccugggcagccacaucagagccagcagcagcagcagcagcaucagacagagaaucagcagcuucgagaccuucggcagcagccagcugcccgacaagggcgcccagagacugagccugcagcccagcagcggcgaggccgccaagccccugggcaagcacgaggagggcagauucagcggccugcugggcagaggcgccgcccccacccuggugccccagcagcccgagcaggugcugagcagcggcagccccgccgccagcgaggccagagaccccggcgugagcgagagccccccccccggcagacagcccaaccagaagacccugccccccggccccgacccccugcugagacugcugagcacccaggccgaggagagccagggccccgugcugaagaugcccagccagagagccagaagcuucccccugaccagaagccagagcugcgagaccaagcugcuggacgagaagaccagcaagcuguacagcaucagcagccaggugagcagcgccgugaugaagagccugcugugccugcccagcagcaucagcugcgcccagacccccugcauccccaaggagggcgccagccccaccagcagcagcaacgaggacagcgccgccaacggcagcgccgagaccagcgcccuggacaccggcuucagccugaaccugagcgagcugagagaguacaccgagggccugaccgaggccaaggaggacgacgacggcgaccacagcagccugcagagcggccagagcgugaucagccugcugagcagcgaggagcugaagaagcugaucgaggaggugaaggugcuggacgaggccacccugaagcagcuggacggcauccacgugaccauccugcacaaggaggagggcgccggccugggcuucagccuggccggcggcgccgaccuggagaacaaggugaucaccgugcacagaguguuccccaacggccuggccagccaggagggcaccauccagaagggcaacgaggugcugagcaucaacggcaagagccugaagggcaccacccaccacgacgcccuggccauccugagacaggccagagagcccagacaggccgugaucgugaccagaaagcugacccccgaggccaugcccgaccugaacagcagcaccgacagcgccgccagcgccagcgccgccagcgacgugagcguggagagcaccgccgaggccaccgugugcaccgugacccuggagaagaugagcgccggccugggcuucagccuggagggcggcaagggcagccugcacggcgacaagccccugaccaucaacagaaucuucaagggcgccgccagcgagcagagcgagaccgugcagcccggcgacgagauccugcagcugggcggcaccgccaugcagggccugaccagauucgaggccuggaacaucaucaaggcccugcccgacggccccgugaccaucgugaucagaagaaagagccugcagagcaaggagaccaccgccgccggcgacagcuga

SEQ ID NO: 4231 - RNA, 3999 nt, Artificial Sequence
  derived and/or modified sequence opt5 from IL-16__Homo_sapiens__CCDS42069.1
auggagagccacuccagagccggcaagucucggaaaagcgcuaaguuccgcuccaucucuagaagccugaugcucugcaacgccaaaaccuccgacgaugggucuagccccgacgaaaaguacccugauccguuugagauuucccuggcgcagggaaaagaaggcaucuuccauagcucugugcaacuugcugacacauccgaggccgggcccagcucugucccugaucuggcccucgcuuccgaagccgcucagcugcaggccgcgggaaaugaccggggcaagacgugucgcagaaucuuuuucaugaaggagagcucuaccgccuccagccgggagaaacccgggaaacuugaagcucaguccucuaacuuucuguucccuaaggccugccaccaacgcgcuagaagcaauuccacaagcguuaaccccuauuguacccgggagauugauuuuccuaugacaaagaaaucugccgcgccgaccgaccgccagcccuacucccucugcagcaauagaaagucucugagccagcagcuggauuguccugccggaaaggcugccggcacaucccggcccacccgcucucucagcacggcucaacuggugcagccuuccggcgggcuucaggccagcgugauuucuaacaucguccugaugaaaggacaggccaagggccucggguucuccaucgugggaggcaaagacagcauuuaugggcccaucggaauuuacguuaagaccaucuuugcuggcggcgcggccgcugccgaugggagacugcaagaaggagacgagauucuugagcugaauggcgaaucuauggccgggcucacacaucaggaugcucugcagaaauucaagcaagccaaaaagggacugcucacccugacagugcggacccgccuuacggcgccgccuucccugugcagccaccucuccccuccccuguguagaucucuuagcuccucuacaugcaucaccaaggacagcuccagcuuugcucuggagucucccuccgcccccauuagcacagccaaaccuaacuaucggaucauggucgaagugucucuccagaaggaggcuggcguugggcugggaaucggccuguguuccgugccguacuuccagugcauuagcggcaucuuuguccauacccucucucccgggagcguggcccaccuggacggaagacuucgcuguggcgaugaaauuguggagaucuccgacagcccuguccacugccugacccucaaugagguuuauacaauucugucucauugcgaucccgggccugugcccaucaucgugucccggcacccggacccucaggucagcgaacaacagcuuaaagaggcuguggcccaggcgguugaaaacacgaaguucggaaaagagagacaucaguggucccuggaaggcgugaagcgccucgagucuagcuggcacgggcggcccacccuggagaaggaaagagagaaaaauuccgccccuccccaccgccgggcucaaaaggucaugauuagaucuagcuccgauucuagcuacauguccggcagcccuggaggcucucccggguccggaagcgccgaaaaaccgucuuccgacguggauaucagcacacauucuccuucccugccccucgcucgcgagcccguugugcugagcauugccuccagccggcuuccucaggaaucuccgccccugccugagagcagagacucccaucccccucuccgccugaagaaaucuuucgagauccugguccggaagcccaugagcuccaagccuaaacccccgccuagaaaguacuuuaaaucugauagcgacccccagaagucccuugaggagcgggaaaacucuagcuguuccagcggccacaccccucccacaugcgggcaggaggcgcgcgagcuccugccgcugcuccugccucaagaagauaccgccggaagaucucccuccgcuagcgccggcuguccugggcccggcauuggaccccagacgaaaucuuccacagagggcgaaccuggguggcggagagcuagcccggugacccagaccucccccaucaagcacccucuucugaagcgccaggcccggauggacuauucuuucgacacaaccgccgaggaucccugggucagaaucagcgacugcauuaaaaaucucuuuuccccuaucaugagcgaaaaccauggacacaugccccugcaaccuaaugcuucucugaacgaggaggaaggcacacaggggcacccggauggaacgcccccuaaacuugacaccgcgaacggcacacccaagguguacaaguccgccgauagcucuaccguuaaaaaggggccucccguggcuccgaaaccugccugguuccgccagagccucaagggccugagaaaucgggccuccgacccccgcggacugcccgauccugcucucucuacacaacccgccccugcgagcagagagcaucugggcucccacauucgggcuucuagcuccagcuccuccauccgccagagaauuagcuccuuugaaaccuucgggucuagccagcuuccggacaagggagcccagcggcugucccuccaacccucuagcggcgaggccgcuaaaccucuggggaagcaugaagagggacgcuuuuccggccugcuugggagaggcgccgcgcccacgcucgucccucagcagcccgaacaggugcugagcucuggauccccggcugccagcgaagcccgggauccuggcguuucugagucucccccucccgggcgccaaccuaaccagaaaacccugcccccgggaccugacccccuccugagacuucugagcacacaggcugaagagucucagggccccgugcucaagaugccuagccaacgggccagauccuucccgcugacccgcucucagagcugugaaacaaaacugcuugaugagaagaccuccaagcucuauagcaucuccucucaggucagcuccgcugugaugaaaucucugcugugccuccccagcuccauuucuugugcccaaacgccuugcauccccaaggagggggcgagcccuacauccagcucuaaugaagacuccgccgcuaacggaagcgccgagaccucugcucuggauacaggcuuuucccuuaaucugagcgaacuccgggaguacaccgagggccugaccgaagccaaagaggacgacgauggggaccacucuucccugcagagcggacaguccgugaucagccuucugucuagcgaggaacucaagaaacugauugaagagguuaagguccucgaugaggccacacugaagcagcuugacggcauccacgugacgauucugcauaaagaagagggggcuggacucggcuucucccuggcugggggagccgaucuggaaaacaaggugaucaccguccacagaguguuucccaauggccuugcuucucaagagggcacaauucagaaagggaacgaaguucugagcaucaauggaaagucccucaaaggcaccacacaucacgacgcccuggccauccuccgccaggcucgggagccuagacaggccgugauugucacccgcaagcugacgccggaggcgaugcccgaucuuaacucuagcacagacuccgcugccucugccagcgcugccuccgaugugagcguugaaucuaccgcggaggcuaccguguguacagucacccuggaaaagauguccgccgggcucggauucagccuggagggcgggaaaggaucucugcauggcgacaagccucuuacaaucaaucggauuuuuaaaggcgccgcuuccgaacaaagcgagacggugcagcccggggaugagauccugcagcucggaggcaccgccaugcaggggcugacaagauucgaagcguggaacauuaucaaggcccucccugacggacccguuaccaucgugauucgccggaaaucccugcaaucuaaggagacaaccgcggccggcgauagcuga

SEQ ID NO: 4232 - RNA, 3999 nt, Artificial Sequence
  derived and/or modified sequence opt6 from IL-16__Homo_sapiens__CCDS42069.1
auggaaucacauucaagagcggguaaaucucgaaaaucugcgaaauuccgcuccauuucaagaagucuaauguuaugcaacgcgaaaacaucggaugacggcagcucgccagaugaaaaauauccagaucccuucgaaauuucguuagcccaaggaaaggaaggaaucuuucauagcucaguucaacucgcugauacuucugaagccggaccuagcucaguaccggaccucgcucucgcuagcgaagcugcacaacugcaagccgcaggcaaugaucgaggaaaaacuuguaggagaaucuuuuuuaugaaggagagcaguacugccucaucuagagaaaaaccuggaaaauuagaagcacaaucgucaaauuuuuuguucccuaaagcaugucaccagcgagcucgaucaaauucuacaucagucaacccauacuguacacgagaaauagauuuuccgaugacuaaaaaaucggcagcuccaacugaucgacaaccuuauucacuaugcucaaauagaaaaucucugagucaacaacuugauuguccagccggaaaagccgccggaaccucaaggccgacccgaagccuaucuacugcacaauuaguacaaccaucaggggguuuacaagccucgguaauuucaaauauaguguuaaugaaaggacaagcaaagggguuaggcuucagcauugucgguggaaaggauaguauauauggcccgauagggauauacguaaaaacaauuuuugcugggggugccgccgccgcugauggaagacuccaagaaggagacgagauacuagaacuaaacggcgagagcauggccggauugacccaccaagacgcucuacaaaaauuuaaacaagcuaaaaaagggcucuuaacauuaacgguaaggacaagacuaacagcaccgccuucgcuaugcucacaccuuaguccucccuuauguagaucucucuccaguucaacauguaucacaaaagauaguucaucuuuugcacuagaauccccuagugcucccaucucaacugccaaaccaaauuauagaauuaugguagaaguaagcuuacaaaaagaggcaggggugggacuaggaauaggauuaugcagcguccccuacuuccaaugcauauccggaaucuucguccauacacuaucuccuggcucaguggcacaccucgauggaagacuuagauguggugaugaaauuguagaaauauccgauaguccuguacacugucuaacuuuaaaugaaguuuacacuauacuuucucacugugauccaggaccagugccuaucauaguaucucgacacccagauccacaaguaucagaacaacaauugaaagaagcaguagcacaagcaguggaaaauacuaaauuuggaaaagaaagacaccaguggucauuagaaggcgucaaacgcuuggaaucuagcuggcauggcagaccaacauuagagaaagagagagaaaagaacuccgcaccuccccauagaagagcacagaaaguaaugauccguagcagcagcgacaguucauacaugucagguaguccaggagguaguccaggaaguggauccgcagaaaaaccaucaucagaugucgacauaaguacccauaguccaucacuuccccuagcaagggaaccuguuguauuaucaauagcauccagccgauuaccccaagaaucaccaccacuuccagaaucuagagauucacacccccccuuacgcuuaaaaaaaucguuugaaauuuuaguacgcaaaccaaugucuucuaaaccaaaaccaccaccuagaaaauauuuuaagucagauucagacccacaaaaaucuuuagaagaacgcgaaaauaguucauguucauccggccacacaccacccacguguggacaagaagcuagagaacuauuaccacuucuucuaccccaagaagauacagcagguagaucaccaucugcaucagcgggcuguccaggcccgggaauugguccucaaaccaaaucaaguacagaaggagaaccagguuggagaagagcaaguccagucacacaaacaagcccuauaaaacauccuuuacuaaagcgacaggcgcgaauggacuauuccuuugauacuacagcugaagacccauggguccgaauaucugacugcauaaagaauuuguuuaguccaauaaugucagaaaaccauggacauaugccguuacaaccaaacgcaucauuaaacgaagaagaaggaacucaaggucauccagacgguacuccacccaaauuagauacagcaaauggaacuccaaaaguauauaaaucagcagauucaaguaccguaaaaaaggguccaccaguagcacccaaaccugcaugguucaggcaaaguuugaaaggccuccgaaaccgagccagcgacccuagaggacugccagauccugcucuaucgacucaaccagcuccagcauccagggaacacuuagguucacacauucgagcuucuaguaguuccucauccauuaggcaacgaauaucuaguuucgaaacauuuggaaguucccaacuaccagacaaaggugcucaacgcuugucccuacaacccuccucaggcgaagcagcaaaaccauuaggcaaacacgaagaagguagauucaguggucuacuagggagaggagcagcacccacacucguaccacaacaaccagaacaaguuuuauccagugggucacccgcagcaucagaagcacgagaucccggcguuagugagucuccaccuccaggcagacagccuaaucaaaaaacacuaccuccugguccugauccacuacuaagauuauuaucaacccaagcugaagaaucucaaggcccgguuuugaaaaugccuucgcagagggcaaggucauuuccucuuacccgaucucaaagcugcgagacaaaacuacuagaugaaaaaaccuccaaauuauauuccauaucaucacagguaucuagugcaguuaugaaaucuuuacucugucuaccgaguucaauuucaugcgcucaaacaccauguauccccaaagaaggcgcaucaccgacaucauccaguaaugaagauucugcugcaaacggauccgcagaaacaucugcauuagacaccggcuuuucccuaaauuuaagugaacuaagagaauacacagagggacuaacagaagcaaaggaagacgacgauggugaucauucaucccuacaauccgggcaguccguaauaagucuauuaucaucugaagaauuaaaaaagcuaauugaagaaguaaaaguauuagaugaagcuacacuuaaacaauuagacggaauccacguuaccauuuugcauaaagaagagggugcaggacuagguuucagucuagcagguggcgcagauuuagaaaauaagguuauaaccguacauagagucuucccaaacggcuuagccucucaagaaggaacaauccaaaaaggaaaugaaguucuauccaucaacggaaaaagccuaaaaggaacaacacaccaugacgcacuugccauacuaagacaagcaagagaaccaagacaagcaguaauaguaacgcguaaauuaacuccugaagcaaugcccgaucucaauucgaguacugacucagcggcaagcgccucagccgcaagugaugucucaguagaaucaacagccgaagcgacaguuugcacaguaacacucgaaaaaaugagugcaggacugggauuuucauuagaaggaggcaaggguagccuacacggagauaaaccacuaacaauaaauagaauuuuuaaaggagcugcaucagaacaaagugaaaccguacaaccgggugacgaaauucuacaauuaggugggacagccaugcaaggauuaacuagguucgaagcauggaacauaauuaaagcucucccggacggaccagucacuauaguaauaagaagaaaaucacuccaaucgaaagaaacaacugcggcgggggacuccuga

SEQ ID NO: 4233 - protein, 155 aa, Artificial Sequence
  IL-17A__Homo_sapiens__Q16552
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 4234 - RNA, 468 nt, Artificial Sequence
  IL-17A__Homo_sapiens__AAC50341
augacuccugggaagaccucauuggugucacugcuacugcugcugagccuggaggccauagugaaggcaggaaucacaaucccacgaaauccaggaugcccaaauucugaggacaagaacuucccccggacugugauggucaaccugaacauccauaaccggaauaccaauaccaaucccaaaagguccucagauuacuacaaccgauccaccucaccuuggaaucuccaccgcaaugaggacccugagagauaucccucugugaucugggaggcaaagugccgccacuugggcugcaucaacgcugaugggaacguggacuaccacaugaacucuguccccauccagcaagagauccugguccugcgcagggagccuccacacugccccaacuccuuccggcuggagaagauacugguguccgugggcugcaccugugucaccccgauuguccaccauguggccuaa

SEQ ID NO: 4235 - RNA, 468 nt, Artificial Sequence
  derived and/or modified sequence opt1 from IL-17A__Homo_sapiens__AAC50341
augacccccggcaagaccagccuggugucccuccugcugcuccugagccuggaggccaucgucaaggccgggaucaccaucccgcgcaaccccggcugccccaacuccgaggacaagaacuucccccggaccgugauggugaaccucaacauccacaaccgcaacaccaacaccaacccgaagcggagcuccgacuacuacaaccgcagcacgucccccuggaaccugcaccggaacgaggaccccgagcgcuaccccagcgucaucugggaggcgaagugccggcaccuggggugcaucaacgccgacggcaacguggacuaccacaugaacuccgugccgauccagcaggagauccucguccugcgccgggagccgccccacugccccaacagcuuccgccuggagaagauccucguguccguggggugcacgugcgucacccccaucgugcaccacguggccuga

SEQ ID NO: 4236 - RNA, 468 nt, Artificial Sequence
  derived and/or modified sequence opt2 from IL-17A__Homo_sapiens__AAC50341
augacccccggcaagaccucccucgucucccuccuccuccuccucucccucgaggccaucgucaaggccggcaucaccaucccccgcaaccccggcugccccaacuccgaggacaagaacuucccccgcaccgucauggucaaccucaacauccacaaccgcaacaccaacaccaaccccaagcgcuccuccgacuacuacaaccgcuccaccucccccuggaaccuccaccgcaacgaggaccccgagcgcuaccccuccgucaucugggaggccaagugccgccaccucggcugcaucaacgccgacggcaacgucgacuaccacaugaacuccguccccauccagcaggagauccucguccuccgccgcgagcccccccacugccccaacuccuuccgccucgagaagauccucgucuccgucggcugcaccugcgucacccccaucguccaccacgucgccuga

SEQ ID NO: 4237 - RNA, 468 nt, Artificial Sequence
  derived and/or modified sequence opt3 from IL-17A__Homo_sapiens__AAC50341
augacccccggcaagacaagccuggugucccuccuucuguuguuaucucuggaggccaucgucaaagcugggauuacuauaccuagaaacccaggaugccccaauucagaagacaagaacuucccgaggacgguuauggugaaucuaaacauccacaaucggaacaccaauacaaacccuaaacgcaguagcgauuacuauaaucgauccacuucuccauggaaccuccaucguaaugaggaccccgaaagauacccuucgguaauuugggaggcaaaguguaggcaccuggguugcaucaacgccgauggcaauguggacuaucauaugaacucagucccaauucagcaagaaauccuugugcugcggcgcgagcccccucacuguccaaauagcuuuagauuggagaaaauacucguuaguguggggugcaccugugucacaccgaucgugcaucacguagcguga

SEQ ID NO: 4238 - RNA, 468 nt, Artificial Sequence
  derived and/or modified sequence opt4 from IL-17A__Homo_sapiens__AAC50341
augacccccggcaagaccagccuggugagccugcugcugcugcugagccuggaggccaucgugaaggccggcaucaccauccccagaaaccccggcugccccaacagcgaggacaagaacuuccccagaaccgugauggugaaccugaacauccacaacagaaacaccaacaccaaccccaagagaagcagcgacuacuacaacagaagcaccagccccuggaaccugcacagaaacgaggaccccgagagauaccccagcgugaucugggaggccaagugcagacaccugggcugcaucaacgccgacggcaacguggacuaccacaugaacagcgugcccauccagcaggagauccuggugcugagaagagagcccccccacugccccaacagcuucagacuggagaagauccuggugagcgugggcugcaccugcgugacccccaucgugcaccacguggccuga

SEQ ID NO: 4239 - RNA, 468 nt, Artificial Sequence
  derived and/or modified sequence opt5 from IL-17A__Homo_sapiens__AAC50341
augacccccggcaagacaagccuggugucccuccugcuucugcucucucuggaggccaucgucaaagcugggauuacgaucccuagaaacccgggaugccccaauagcgaagacaagaacuucccucggaccguuauggugaaucuuaacauucacaaucgcaacacaaauaccaaccccaaaagauccucugauuacuauaaucggagcacauccccuuggaaccugcaucgcaaugaggaccccgaaagauacccuucugugaucugggaggccaagugucggcaccucggcugcauuaacgcggaugggaaugucgacuaucauaugaacagcgugccgauccagcaagaaauccugguucugcgcagagagcccccucacugucccaauuccuuucggcucgagaaaauucuggugagcgucggaugcaccugugugacaccuaucguucaucacguggcuuga

SEQ ID NO: 4240 - RNA, 468 nt, Artificial Sequence
  derived and/or modified sequence opt6 from IL-17A__Homo_sapiens__AAC50341
augacaccaggaaaaacaucacuaguaucccuauuacuacuacuaucacuagaagcaauaguaaaagcaggaauaacaauaccaagaaauccaggaugcccaaacucagaagacaaaaacuucccaagaacaguaaugguaaaccuaaacauacacaacagaaacacaaacacaaacccaaaaagaucauccgacuauuacaacagaucaacauccccauggaaccuacacagaaacgaagacccagaaagauacccaucaguaauaugggaagcaaaaugcagacaccuaggaugcauaaacgcagacggaaacguagacuaccacaugaacuccguaccaauacaacaagaaauacuaguauuaagacgagaaccaccacacugcccaaacucauucagacuagaaaaaauacuaguaucaguaggaugcacaugcguaacaccaauaguacaccacguagcauaa

SEQ ID NO: 4241 - protein, 502 aa, Artificial Sequence
  IL-17B__Homo_sapiens__Q9NRM6
MSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 4242 - RNA, 1509 nt, Artificial Sequence
  IL-17B__Homo_sapiens__AAH00980
augucgcucgugcugcuaagccuggccgcgcugugcaggagcgccguaccccgagagccgaccguucaauguggcucugaaacugggccaucuccagaguggaugcuacaacaugaucuaaucccgggagacuugagggaccuccgaguagaaccuguuacaacuaguguugcaacaggggacuauucaauuuugaugaauguaagcuggguacuccgggcagaugccagcauccgcuuguugaaggccaccaagauuugugugacgggcaaaagcaacuuccaguccuacagcugugugaggugcaauuacacagaggccuuccagacucagaccagacccucuggugguaaauggacauuuuccuacaucggcuucccuguagagcugaacacagucuauuucauuggggcccauaauauuccuaaugcaaauaugaaugaagauggcccuuccaugucugugaauuucaccucaccaggcugccuagaccacauaaugaaauauaaaaaaaagugugucaaggccggaagccugugggauccgaacaucacugcuuguaagaagaaugaggagacaguagaagugaacuucacaaccacuccccugggaaacagauacauggcucuuauccaacacagcacuaucaucggguuuucucagguguuugagccacaccagaagaaacaaacgcgagcuucaguggugauuccagugacuggggauagugaaggugcuacggugcagcugacuccauauuuuccuacuuguggcagcgacugcauccgacauaaaggaacaguugugcucugcccacaaacaggcgucccuuucccucuggauaacaacaaaagcaagccgggaggcuggcugccucuccuccugcugucucugcugguggccacaugggugcugguggcagggaucuaucuaauguggaggcacgaaaggaucaagaagacuuccuuuucuaccaccacacuacugccccccauuaagguucuugugguuuacccaucugaaauauguuuccaucacacaauuuguuacuucacugaauuucuucaaaaccauugcagaagugaggucauccuugaaaaguggcagaaaaagaaaauagcagagauggguccagugcaguggcuugccacucaaaagaaggcagcagacaaagucgucuuccuucuuuccaaugacgucaacagugugugcgaugguaccuguggcaagagcgagggcagucccagugagaacucucaagaccucuucccccuugccuuuaaccuuuucugcagugaucuaagaagccagauucaucugcacaaauacgugguggucuacuuuagagagauugauacaaaagacgauuacaaugcucucagugucugccccaaguaccaccucaugaaggaugccacugcuuucugugcagaacuucuccaugucaagcagcaggugucagcaggaaaaagaucacaagccugccacgauggcugcugcuccuuguag

SEQ ID NO: 4243 - RNA, 1509 nt, Artificial Sequence
  derived and/or modified sequence opt1 from IL-17B__Homo_sapiens__AAH00980
augagccuggugcuccugucccuggccgcccucugccgcagcgcggugccccgggagccgaccgugcagugcggcuccgagaccgggcccagccccgaguggaugcugcagcacgaccugauccccggcgaccuccgcgaccugcggguggagccggucacgaccuccguggccaccggggacuacagcauccugaugaacguguccuggguccuccgcgccgacgccagcauccggcugcugaaggccaccaagaucugcgugacgggcaaguccaacuuccagagcuacuccugcgugcgcugcaacuacaccgaggcguuccagacccagacccggcccagcgggggcaaguggacguucuccuacaucggcuuccccgucgagcucaacaccguguacuucaucggggcccacaacauccccaacgccaacaugaacgaggacggcccgagcauguccgugaacuucaccagccccgggugccuggaccacaucaugaaguacaagaagaagugcgucaaggccggcucccugugggaccccaacaucaccgcgugcaagaagaacgaggagacgguggaggugaacuucaccaccacgccccucgggaaccgcuacauggcccugauccagcacagcaccaucaucggcuucucccaggucuucgagccgcaccagaagaagcagacccgggccagcguggugauccccgucaccggcgacagcgagggggccaccgugcagcugacgcccuacuucccgaccugcggcuccgacugcauccgccacaaggggaccgugguccucugcccccagaccggcgugcccuucccccuggacaacaacaagagcaagcccggcggguggcugccgcuccugcugcucucccugcugguggccacguggguccucguggcgggcaucuaccugauguggcggcacgagcgcaucaagaagaccagcuucuccaccaccacgcugcucccgcccaucaagguccuggugguguaccccagcgagaucugcuuccaccacaccaucugcuacuucaccgaguuccugcagaaccacugccgguccgaggucauccucgagaaguggcagaagaagaagaucgccgagauggggcccgugcaguggcuggccacccagaagaaggccgccgacaagguggucuuccugcucagcaacgacgugaacuccgugugcgacggcacgugcggcaagagcgaggggucccccagcgagaacucccaggaccuguucccccuggcguucaaccucuucugcagcgaccugcgcucccagauccaccuccacaaguacgucgugguguacuuccgggagaucgacaccaaggacgacuacaacgcccugagcgucugccccaaguaccaccugaugaaggacgccaccgccuucugcgccgagcugcuccacgugaagcagcaggucuccgcgggcaagcgcagccaggccugccacgacgggugcugcucccuguga

SEQ ID NO: 4244 - RNA, 1509 nt, Artificial Sequence
  derived and/or modified sequence opt2 from IL-17B__Homo_sapiens__AAH00980
augucccucguccuccucucccucgccgcccucugccgcuccgccgucccccgcgagcccaccguccagugcggcuccgagaccggccccucccccgaguggaugcuccagcacgaccucauccccggcgaccuccgcgaccuccgcgucgagcccgucaccaccuccgucgccaccggcgacuacuccauccucaugaacgucuccuggguccuccgcgccgacgccuccauccgccuccucaaggccaccaagaucugcgucaccggcaaguccaacuuccaguccuacuccugcguccgcugcaacuacaccgaggccuuccagacccagacccgccccuccggcggcaaguggaccuucuccuacaucggcuuccccgucgagcucaacaccgucuacuucaucggcgcccacaacauccccaacgccaacaugaacgaggacggccccuccauguccgucaacuucaccucccccggcugccucgaccacaucaugaaguacaagaagaagugcgucaaggccggcucccucugggaccccaacaucaccgccugcaagaagaacgaggagaccgucgaggucaacuucaccaccaccccccucggcaaccgcuacauggcccucauccagcacuccaccaucaucggcuucucccaggucuucgagccccaccagaagaagcagacccgcgccuccgucgucauccccgucaccggcgacuccgagggcgccaccguccagcucacccccuacuuccccaccugcggcuccgacugcauccgccacaagggcaccgucguccucugcccccagaccggcguccccuucccccucgacaacaacaaguccaagcccggcggcuggcucccccuccuccuccucucccuccucgucgccaccuggguccucgucgccggcaucuaccucauguggcgccacgagcgcaucaagaagaccuccuucuccaccaccacccuccucccccccaucaagguccucgucgucuaccccuccgagaucugcuuccaccacaccaucugcuacuucaccgaguuccuccagaaccacugccgcuccgaggucauccucgagaaguggcagaagaagaagaucgccgagaugggccccguccaguggcucgccacccagaagaaggccgccgacaaggucgucuuccuccucuccaacgacgucaacuccgucugcgacggcaccugcggcaaguccgagggcucccccuccgagaacucccaggaccucuucccccucgccuucaaccucuucugcuccgaccuccgcucccagauccaccuccacaaguacgucgucgucuacuuccgcgagaucgacaccaaggacgacuacaacgcccucuccgucugccccaaguaccaccucaugaaggacgccaccgccuucugcgccgagcuccuccacgucaagcagcaggucuccgccggcaagcgcucccaggccugccacgacggcugcugcucccucuga

SEQ ID NO: 4245 - RNA, 1509 nt, Artificial Sequence
  derived and/or modified sequence opt3 from IL-17B__Homo_sapiens__AAH00980
augagccuggugcuccuuucccuggccgcuuugugcagaucugcaguccccagggagccuaccguucaguguggcucagaaacagggccaaguccggaguggauguuacaacacgaccugauccccggagaucuacgggaccuccgcguggaaccuguaacuacgagcguggccaccggugauuacuccauucugaugaacgucucuugggugcuucgagcggacgcuucgauacgucuguugaaggccacaaaaaucugcguuacuggcaagucaaauuuccagagcuauaguugugugagaugcaacuacaccgaggcauuucagacacagaccaggccauccgggggaaaauggacuuucucuuauauuggcuuucccgucgaacucaauacaguguacuucaucggugcccauaacauuccuaaugcuaacaugaaugaggaugggccaagcauguccguaaacuuuaccucacccggaugucuggaccacaucaugaaguauaaaaagaagugcguuaaagcaggcagucugugggauccuaauauaacggccuguaagaaaaacgaggaaacuguggaggucaauuucaccacaacuccacucggcaaccgguacauggcuuuaauccaacauagcaccauuaucggguuuucucagguguucgaaccgcaccagaagaaacagacacgcgccuccguggucauucccguuaccggagacucagagggugcgacggugcaacugacuccuuauuuuccaacaugcggcagcgauuguaucagacauaaggggaccguagugcuuugcccccagacuggagucccuuucccauuggacaauaacaagaguaaacccggcgguuggcugccgcuacuccugcuuucucuguugguggcaacauggguucucguggccgggauauaccugauguggaggcacgagcggauuaagaaaaccuccuuuagcacgaccacauuacugccucccaucaagguccucgugguauacccaucggaaauuuguuuccaccauacuaucugcuauuuuaccgaguuccuucagaaucacugccgcucugaaguuauccuggagaaauggcagaagaaaaagauugcugaaaugggaccugugcaaugguuggccacacagaagaaagcagcugauaaggucguguuccuacuguccaacgacgucaacucagugugugauggcacuugcggcaaaagugaggggagccccuccgaaaauucucaggaccucuuuccacuggccuucaaccuguuuuguagcgaccuucgaucacaaauacauuugcacaaguacguugugguauauuucagagagaucgauaccaaagacgauuacaaugcgcucagugucugccccaaguaucaccugaugaaggacgccacagcauuuugugcugaguuacugcaugugaaacagcagguuuccgccggaaagaggagccaggcuugccacgaugguuguugcucucuauga

SEQ ID NO: 4246 - RNA, 1509 nt, Artificial Sequence
  derived and/or modified sequence opt4 from IL-17B__Homo_sapiens__AAH00980
augagccuggugcugcugagccuggccgcccugugcagaagcgccgugcccagagagcccaccgugcagugcggcagcgagaccggccccagccccgaguggaugcugcagcacgaccugauccccggcgaccugagagaccugagaguggagcccgugaccaccagcguggccaccggcgacuacagcauccugaugaacgugagcugggugcugagagccgacgccagcaucagacugcugaaggccaccaagaucugcgugaccggcaagagcaacuuccagagcuacagcugcgugagaugcaacuacaccgaggccuuccagacccagaccagacccagcggcggcaaguggaccuucagcuacaucggcuuccccguggagcugaacaccguguacuucaucggcgcccacaacauccccaacgccaacaugaacgaggacggccccagcaugagcgugaacuucaccagccccggcugccuggaccacaucaugaaguacaagaagaagugcgugaaggccggcagccugugggaccccaacaucaccgccugcaagaagaacgaggagaccguggaggugaacuucaccaccaccccccugggcaacagauacauggcccugauccagcacagcaccaucaucggcuucagccagguguucgagccccaccagaagaagcagaccagagccagcguggugauccccgugaccggcgacagcgagggcgccaccgugcagcugacccccuacuuccccaccugcggcagcgacugcaucagacacaagggcaccguggugcugugcccccagaccggcgugcccuucccccuggacaacaacaagagcaagcccggcggcuggcugccccugcugcugcugagccugcugguggccaccugggugcugguggccggcaucuaccugauguggagacacgagagaaucaagaagaccagcuucagcaccaccacccugcugccccccaucaaggugcuggugguguaccccagcgagaucugcuuccaccacaccaucugcuacuucaccgaguuccugcagaaccacugcagaagcgaggugauccuggagaaguggcagaagaagaagaucgccgagaugggccccgugcaguggcuggccacccagaagaaggccgccgacaaggugguguuccugcugagcaacgacgugaacagcgugugcgacggcaccugcggcaagagcgagggcagccccagcgagaacagccaggaccuguucccccuggccuucaaccuguucugcagcgaccugagaagccagauccaccugcacaaguacguggugguguacuucagagagaucgacaccaaggacgacuacaacgcccugagcgugugccccaaguaccaccugaugaaggacgccaccgccuucugcgccgagcugcugcacgugaagcagcaggugagcgccggcaagagaagccaggccugccacgacggcugcugcagccuguga

SEQ ID NO: 4247 - RNA, 1509 nt, Artificial Sequence
  derived and/or modified sequence opt5 from IL-17B__Homo_sapiens__AAH00980
augagccuggugcuccugucccuugccgcucugugcagaucugccgucccccgggagccuaccguucaguguggcagcgaaacagggccgucccccgaguggaugcuccaacacgaccugaucccuggagaucuucgcgaccugagaguggaacccgugacgaccucugucgcgacaggcgauuacagcauucucaugaacguguccuggguucugcgggcugacgccucuauccgccugcucaaggccaccaaaauuugcgugacaggcaagagcaauuuccaguccuauagcugugucagaugcaacuacaccgaggcuuuucagacacagacccggccuucuggaggcaaauggacguucuccuauaucggguuucccguggaacugaauaccguuuacuucauuggagcccauaacaucccuaaugcuaacaugaaugaggauggcccgagcaugucugugaacuuuacaucccccggcugucuugaccacaucaugaaguauaaaaagaagugcgucaaagccgggagccugugggauccuaauauuaccgcguguaagaaaaacgaggaaacaguggaggugaauuucaccacgacaccccucggaaaccgcuacauggcccugauccaacauucuaccauuaucggcuuuucccaggucuucgaaccucaccagaagaaacagacaagagcuagcguugugauucccgugaccggggacuccgagggagccaccguccaacuuacaccguauuuuccuacgugcggcucugauuguauccggcauaaggggaccgugguucugugcccccagacaggagugccuuucccccucgacaauaacaagagcaaacccggcggcuggcugccucugcuccugcuuucccugcucgucgcuaccugggugcugguugccgggauuuaccuuauguggcgccacgagagaaucaagaaaacauccuuuucuaccacgacacugcucccgcccaucaaggugcuggucguguacccuuccgaaauuuguuuccaccauaccaucugcuauuuuaccgaguuccugcagaaucacugccggagcgaagucauucucgagaaauggcagaagaaaaagaucgcggaaaugggacccgugcaauggcuggccacacagaagaaagcugccgauaagguuguguuccuucugucuaacgacgucaacagcgugugugaugggaccugcgggaaauccgagggaucuccuagcgagaauagccaggaccucuuuccccuggcuuucaaccuguuuuguagcgaccuucgcucucaaauucaucuccacaaguacguuguggucuauuucagagaaaucgauacaaaagacgauuacaaugcccuguccgugugcccgaaguaucaccugaugaaggacgccacggcuuuuugugcggagcuccugcaugugaaacagcagguuagcgccggcaagcggucucaggcuugccacgauggguguugcucccuuuga

SEQ ID NO: 4248 - RNA, 1509 nt, Artificial Sequence
  derived and/or modified sequence opt6 from IL-17B__Homo_sapiens__AAH00980
augucauuaguauuauuaucacuagccgcacuaugucgaucggcuguuccaagagaaccaaccguacaaugcggaucagaaacagguccaucaccagaauggauguuacaacacgacuuaauaccgggcgaucuuagagauuuaagaguagaaccaguuacaacaucuguagcuacaggugauuacucaauuuuaaugaacguaagcuggguacuaagagcugacgccucaauacgccugcuaaaagcaacaaaaauuugcgucaccggaaaauccaacuuucaauccuacucauguguaagaugcaauuauaccgaagcuuuucaaacacaaacacgcccauccggaggaaaauggacauuuucauacauaggauuuccuguagaauuaaacacagucuacuuuauaggugcacauaacauuccaaacgcaaacaugaaugaagauggaccaucaaugucagucaacuucacaucaccuggaugucuagaccauauaaugaaauauaaaaaaaaaugcguaaaagcuggaucccuaugggacccaaacauaacugcaugcaaaaaaaaugaagaaacaguagaagucaauuucacaacuacaccacuuggaaauagauauauggcucuaauacaacacucaacaauaaucggauucucccaaguauuugaaccacaccaaaaaaaacaaacacgagccucaguaguaaucccagucacaggagacuccgaaggagcaacuguacaauuaacccccuacuuucccacauguggcuccgacuguauaagacauaaaggaacaguugucuuaugcccacaaacagguguacccuucccccuggacaauaauaaaagcaaacccgguggauggcuuccauuacucuuacuaucacuacuagucgccacauggguauuaguagcaggaaucuacuuaauguggcgucaugaacgaauaaaaaaaacaucuuucuccacuacaacauuacuuccaccaauaaaaguguuaguaguauaccccuccgaaauaugcuuucaccacacaauaugcuauuuuacagaauuccuacaaaaccauugcagaagugaaguaauacucgaaaaauggcaaaaaaaaaagaucgcagaaaugggaccaguccaaugguuagcaacacaaaaaaaagcagcagacaaaguaguauuccuuuuaucaaaugacguaaacucggucugugacgguacauguggaaaaucagaaggaucaccaucagaaaacucacaagaccuauucccacuagcauucaauuuauuuugcucagacuuaagaucacaaauacacuuacacaaauauguaguagucuacuuuagagaaauagacacaaaagacgauuauaacgcauuaagugucuguccaaaauaccacuuaaugaaagacgcaacagcauuuugugcugaauuacuacacguuaaacagcaaguaucugccgguaaaagaucacaagcaugucacgacggaugcuguucccuauaa

SEQ ID NO: 4249 - protein, 180 aa, Artificial Sequence
  IL-17B__Homo_sapiens__Q9UHF5
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 4250 - RNA, 543 nt, Artificial Sequence
  IL-17B__Homo_sapiens__AAF01318
auggacuggccucacaaccugcuguuucuucuuaccauuuccaucuuccuggggcugggccagcccaggagccccaaaagcaagaggaaggggcaagggcggccugggccccuggccccuggcccucaccaggugccacuggaccuggugucacggaugaaaccguaugcccgcauggaggaguaugagaggaacaucgaggagaugguggcccagcugaggaacagcucagagcuggcccagagaaagugugaggucaacuugcagcuguggauguccaacaagaggagccugucucccuggggcuacagcaucaaccacgaccccagccguauccccguggaccugccggaggcacggugccugugucugggcugugugaaccccuucaccaugcaggaggaccgcagcauggugagcgugccgguguucagccagguuccugugcgccgccgccucugcccgccaccgccccgcacagggccuugccgccagcgcgcagucauggagaccaucgcugugggcugcaccugcaucuucuga

SEQ ID NO: 4251 - RNA, 543 nt, Artificial Sequence
  derived and/or modified sequence opt1 from IL-17B__Homo_sapiens__AAF01318
auggacuggccccacaaccuccuguuccugcugaccaucagcaucuuccucggccuggggcagccccgcucccccaagagcaagcggaagggccaggggcgccccggcccccuggccccggggccccaccaggugccccucgaccuggucucccggaugaagcccuacgcccgcauggaggaguacgagcggaacaucgaggagaugguggcgcagcugcgcaacagcuccgagcucgcccagcggaagugcgaggugaaccugcagcuguggaugagcaacaagcgcucccucagcccguggggcuacuccaucaaccacgaccccagccggauccccgucgaccugcccgaggcccgcugccugugccucggcugcgugaacccguucaccaugcaggaggaccgguccauggugagcguccccguguucucccaggugcccguccgccggcgccugugcccgcccccgccccggaccgggcccugccgccagcgggccgugauggagaccaucgccgugggcugcacgugcaucuucuga

SEQ ID NO: 4252 - RNA, 543 nt, Artificial Sequence
  derived and/or modified sequence opt2 from IL-17B__Homo_sapiens__AAF01318
auggacuggccccacaaccuccucuuccuccucaccaucuccaucuuccucggccucggccagccccgcucccccaaguccaagcgcaagggccagggccgccccggcccccucgcccccggcccccaccaggucccccucgaccucgucucccgcaugaagcccuacgcccgcauggaggaguacgagcgcaacaucgaggagauggucgcccagcuccgcaacuccuccgagcucgcccagcgcaagugcgaggucaaccuccagcucuggauguccaacaagcgcucccucucccccuggggcuacuccaucaaccacgaccccucccgcauccccgucgaccuccccgaggcccgcugccucugccucggcugcgucaaccccuucaccaugcaggaggaccgcuccauggucuccguccccgucuucucccagguccccguccgccgccgccucugccccccccccccccgcaccggccccugccgccagcgcgccgucauggagaccaucgccgucggcugcaccugcaucuucuga

SEQ ID NO: 4253 - RNA, 543 nt, Artificial Sequence
  derived and/or modified sequence opt3 from IL-17B__Homo_sapiens__AAF01318
auggacuggccccacaaccuguuguuccuucugaccaucagcauuuuucucggcuuagggcagccuagauccccaaagucuaaaaggaagggacaaggucggccgggcccccuggccccugggccacaucaggugccccuagaucucgucucacgcaugaaaccuuacgcucgaauggaggaauaugagcguaauauagaagagaugguugcacagcugagaaacaguagcgaacuugcccagaggaagugcgaggugaaucugcaauuguggauguccaacaaacggucucucucgccauggggauacucaaucaaucacgaccccagccgcauuccuguagaucugccagaggcgagaugucugugccucggcugugugaacccguucacaaugcaggaagacaggaguauggucuccgugcccguguuuucucagguuccuguccggcgccgauuaugcccacccccuccaagaacuggucccuguaggcagcgggcugugauggagacgaucgccguagggugcaccuguauuuucuga

SEQ ID NO: 4254 - RNA, 543 nt, Artificial Sequence
  derived and/or modified sequence opt4 from IL-17B__Homo_sapiens__AAF01318
auggacuggccccacaaccugcuguuccugcugaccaucagcaucuuccugggccugggccagcccagaagccccaagagcaagagaaagggccagggcagacccggcccccuggcccccggcccccaccaggugccccuggaccuggugagcagaaugaagcccuacgccagaauggaggaguacgagagaaacaucgaggagaugguggcccagcugagaaacagcagcgagcuggcccagagaaagugcgaggugaaccugcagcuguggaugagcaacaagagaagccugagccccuggggcuacagcaucaaccacgaccccagcagaauccccguggaccugcccgaggccagaugccugugccugggcugcgugaaccccuucaccaugcaggaggacagaagcauggugagcgugcccguguucagccaggugcccgugagaagaagacugugcccccccccccccagaaccggccccugcagacagagagccgugauggagaccaucgccgugggcugcaccugcaucuucuga

SEQ ID NO: 4255 - RNA, 543 nt, Artificial Sequence
  derived and/or modified sequence opt5 from IL-17B__Homo_sapiens__AAF01318
auggacuggccccacaaccuccuguuccugcuuaccaucagcauuuuucugggccucgggcagccuagauccccgaagucuaaacggaagggacaaggccgccccgggccucuggcccccggaccucaucaggugccccuugaucuggucagcagaaugaaaccuuacgcucggauggaggaauaugagcgcaauaucgaagagaugguugcccagcucagaaacuccucugaacuggcgcagcggaagugcgaggugaaucugcaacucuggaugagcaacaaacgcucccugucuccguggggcuacagcauuaaucacgaccccuccagaaucccuguggaucuucccgaggcucggugucugugccucgggugugucaacccuuucacaaugcaggaagaccgcagcauggugucuguucccguguuuucccaggucccggugagacggcgccugugcccucccccucccagaacgggacccugucggcagcgcgccguuauggagaccauugccgugggcugcacauguaucuucuga

SEQ ID NO: 4256 - RNA, 543 nt, Artificial Sequence
  derived and/or modified sequence opt6 from IL-17B__Homo_sapiens__AAF01318
auggacuggccacauaacuuacuauuuuuauuaacaauaaguauauucuuaggauuaggacaaccaagaagcccaaaaucaaaaagaaaaggacaaggaagaccaggaccacuagcaccaggaccacaucaaguaccauuagacuuagucucaagaaugaaaccauacgcaagaauggaagaauacgaaagaaauauagaagaaaugguagcacaauuaagaaauagcucagaauuagcacaaagaaaaugcgaaguaaaucuacaacuauggaugucaaacaaaagaucgcuaucaccauggggauauagcauaaaccaugacccaucaagaauaccaguagacuuaccagaagcaagaugucuaugucuaggaugcguaaacccauucacaaugcaagaagauagaucaaugguaagcguaccaguauucucacaaguaccaguaagaagaagauuaugcccaccaccaccaagaacaggaccaugcagacaaagagcagucauggaaacaauagcaguaggaugcacaugcauauuuuaa

SEQ ID NO: 4257 - protein, 202 aa, Artificial Sequence
  IL-17D__Homo_sapiens__Q8TAD2
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 4258 - RNA, 609 nt, Artificial Sequence
  IL-17D__Homo_sapiens__AAH36243
augcugguagccggcuuccugcuggcgcugccgccgagcugggccgcgggcgccccgagggcgggcaggcgccccgcgcggccgcggggcugcgcggaccggccggaggagcuacuggagcagcuguacgggcgccuggcggccggcgugcucagugccuuccaccacacgcugcagcuggggccgcgugagcaggcgcgcaacgcgagcugcccggcagggggcaggcccgccgaccgccgcuuccggccgcccaccaaccugcgcagcgugucgcccugggccuacagaaucuccuacgacccggcgagguaccccagguaccugccugaagccuacugccugugccggggcugccugaccgggcuguucggcgaggaggacgugcgcuuccgcagcgccccugucuacaugcccaccgucguccugcgccgcacccccgccugcgccggcggccguuccgucuacaccgaggccuacgucaccauccccgugggcugcaccugcguccccgagccggagaaggacgcagacagcaucaacuccagcaucgacaaacagggcgccaagcuccugcugggccccaacgacgcgcccgcuggccccuga

SEQ ID NO: 4259 - RNA, 609 nt, Artificial Sequence
  derived and/or modified sequence opt1 from IL-17D__Homo_sapiens__AAH36243
augcugguggccggcuuccuccuggcccugcccccgagcugggcggccggggcgccccgcgccggccggcgccccgcccggccccgcgggugcgccgaccggccggaggagcuccuggagcagcuguacggccgccucgccgccgggguccuguccgccuuccaccacacccugcagcucggcccccgggagcaggcgcgcaacgccagcugccccgccggcgggcggcccgccgaccgccgguuccgcccgcccaccaaccugcgguccgugagccccugggccuaccgcaucuccuacgaccccgcgcgguacccgcgcuaccugcccgaggccuacugccucugccggggcugccugaccgggcuguucggcgaggaggacgugcgcuuccggagcgcccccgucuacaugcccaccguggugcuccgccggaccccggccugcgccgggggccgcuccgucuacaccgaggcguacgugacgauccccgugggcugcacgugcguccccgagcccgagaaggacgccgacagcaucaacuccagcaucgacaagcagggggccaagcugcugcucggcccgaacgacgcccccgccgggcccuga

SEQ ID NO: 4260 - RNA, 609 nt, Artificial Sequence
  derived and/or modified sequence opt2 from IL-17D__Homo_sapiens__AAH36243
augcucgucgccggcuuccuccucgcccucccccccuccugggccgccggcgccccccgcgccggccgccgccccgcccgcccccgcggcugcgccgaccgccccgaggagcuccucgagcagcucuacggccgccucgccgccggcguccucuccgccuuccaccacacccuccagcucggcccccgcgagcaggcccgcaacgccuccugccccgccggcggccgccccgccgaccgccgcuuccgcccccccaccaaccuccgcuccgucucccccugggccuaccgcaucuccuacgaccccgcccgcuacccccgcuaccuccccgaggccuacugccucugccgcggcugccucaccggccucuucggcgaggaggacguccgcuuccgcuccgcccccgucuacaugcccaccgucguccuccgccgcacccccgccugcgccggcggccgcuccgucuacaccgaggccuacgucaccauccccgucggcugcaccugcguccccgagcccgagaaggacgccgacuccaucaacuccuccaucgacaagcagggcgccaagcuccuccucggccccaacgacgcccccgccggccccuga

SEQ ID NO: 4261 - RNA, 609 nt, Artificial Sequence
  derived and/or modified sequence opt3 from IL-17D__Homo_sapiens__AAH36243
augcugguggccggcuuccuccuugcucugcccccuagcugggcagccggggcgccaagagcuggaaggcggccggcccgcccccgagguugcgcagaccguccugaggaauuguuagagcagcuguacggcagacuagccgcugggguccucuccgcauuucaccauacccugcaacuuggaccaagggaacaggcccggaacgcuucuugucccgccggcggucgcccugcggauagaagguuccggccacccacaaaucugcgcucaguuaguccuugggcauaucgaaucagcuacgacccagccagauauccgagguacuugcccgaggcuuauugccucugucgggggugccugacuggacuguuuggcgaagaggaugugcguuuccgcuccgccccuguauacaugccaacggugguccucagaaggacccccgcaugugcuggcgggcggucuguguauacagaggccuacguuacuauuccugugggaugcaccugugucccagaacccgagaaggacgcggauucgauaaacucaagcaucgacaaacagggugccaaguuacugcuuggcccgaaugaugcuccugcagggcccuga

SEQ ID NO: 4262 - RNA, 609 nt, Artificial Sequence
  derived and/or modified sequence opt4 from IL-17D__Homo_sapiens__AAH36243
augcugguggccggcuuccugcuggcccugccccccagcugggccgccggcgcccccagagccggcagaagacccgccagacccagaggcugcgccgacagacccgaggagcugcuggagcagcuguacggcagacuggccgccggcgugcugagcgccuuccaccacacccugcagcugggccccagagagcaggccagaaacgccagcugccccgccggcggcagacccgccgacagaagauucagaccccccaccaaccugagaagcgugagccccugggccuacagaaucagcuacgaccccgccagauaccccagauaccugcccgaggccuacugccugugcagaggcugccugaccggccuguucggcgaggaggacgugagauucagaagcgcccccguguacaugcccaccguggugcugagaagaacccccgccugcgccggcggcagaagcguguacaccgaggccuacgugaccauccccgugggcugcaccugcgugcccgagcccgagaaggacgccgacagcaucaacagcagcaucgacaagcagggcgccaagcugcugcugggccccaacgacgcccccgccggccccuga

SEQ ID NO: 4263 - RNA, 609 nt, Artificial Sequence
  derived and/or modified sequence opt5 from IL-17D__Homo_sapiens__AAH36243
augcugguggccggcuuccuccuggcccuucccccuagcugggcugcgggggcuccgagagccggacggcgccccgccagaccucggggcugcgcugaccgccccgaggaacugcucgagcagcuguacgggagacuugccgcuggaguccuguccgccuuucaccauacccuccaacugggcccucgggaacaggcgcgcaacgccucuugucccgcugggggaagaccugccgaucggcgcuucagaccgcccacaaaucugcggagcguuuccccuugggcuuaucgcaucucuuacgaccccgccagauauccucgguaccuccccgaggcguauugccugugucgcggcugccuuacgggccuguuuggggaagaggaugugagauuccggagcgccccgguguacaugccuaccgucgugcucagacgcacacccgcuugugccggaggccgguccguuuauaccgaggcuuacgugacaauuccugucgggugcaccugugugcccgaacccgagaaggacgccgauucuaucaacagcuccauugacaaacagggagccaagcugcuucugggcccuaaugaugcuccggcggggcccuga

SEQ ID NO: 4264 - RNA, 609 nt, Artificial Sequence
  derived and/or modified sequence opt6 from IL-17D__Homo_sapiens__AAH36243
augcuaguagcaggcuuuuuacuagcauuaccaccaaguugggcagcaggagcaccaagagcaggaagaagaccagcaagaccacgaggaugcgcagauagaccagaagaauuauuagaacaauuauauggaagauuagcagcaggaguauuaucagcauuucaucauacauuacaauuaggaccaagagaacaagcaagaaaugcaucauguccagcaggaggaagaccagcagacagaagauuuagaccaccaacaaaucuaagaaguguaucaccaugggcauauagaauaucauacgauccagcaagauauccuagauacuuaccagaagcauacuguuuauguagaggauguuuaacuggacuauuuggagaagaagauguaagauuuagaucagcaccaguauauaugccaacaguaguauuaagaagaacaccagcaugugcaggagguagaucaguauauacagaagcauauguuacaauaccaguaggaugcacauguguaccagaaccagaaaaagaugcagauaguauaaauucaucaauagacaaacaaggagcaaaauuauuauuaggaccuaacgaugcaccagcaggaccauaa

SEQ ID NO: 4265 - protein, 163 aa, Artificial Sequence [sequence omitted]

SEQ ID NO: 4266 - RNA, 492 nt, Artificial Sequence
  IL-17F__Homo_sapiens__ADY18335
augacagugaagacccugcauggcccagccauggucaaguacuugcugcugucgauauuggggcuugccuuucugagugaggcggcagcucggaaaauccccaaaguaggacauacuuuuuuccaaaagccugagaguugcccgccugugccaggagguaguaugaagcuugacauuggcaucaucaaugaaaaccagcgcguuuccaugucacguaacaucgagagccgcuccaccucccccuggaauuacacugucacuugggaccccaaccgguaccccuuggaaguuguacaggcccaguguaggaacuugggcugcaucaaugcucaaggaaaggaagacaucuccaugaauuccguucccauccagcaagagacccuggucguccggaggaagcaccaaggcugcucuguuucuuuccaguuggagaaggugcuggugacuguuggcugcaccugcgucaccccugucauccaccaugugcaguaa

SEQ ID NO: 4267 - RNA, 492 nt, Artificial Sequence
  derived and/or modified sequence opt1 from IL-17F__Homo_sapiens__ADY18335
augaccgugaagacccugcacggccccgccauggucaaguaccuccugcugagcauccucgggcuggccuuccuguccgaggcggccgcccgcaagaucccgaaggugggccacaccuucuuccagaagcccgagagcugcccgcccgugcccgggggcuccaugaagcucgacaucgggaucaucaacgagaaccagcgggucagcaugucccgcaacaucgagagccgguccaccagccccuggaacuacaccgugaccugggaccccaaccgcuacccccuggaggugguccaggcccagugccggaaccugggcugcaucaacgcccagggcaaggaggacaucuccaugaacagcgugccgauccagcaggagacgcucgugguccgccggaagcaccaggggugcuccgugagcuuccagcuggagaaggugcuggucaccgugggcugcacgugcgugacccccgucauccaccacgugcaguga

SEQ ID NO: 4268 - RNA, 492 nt, Artificial Sequence
  derived and/or modified sequence opt2 from IL-17F__Homo_sapiens__ADY18335
augaccgucaagacccuccacggccccgccauggucaaguaccuccuccucuccauccucggccucgccuuccucuccgaggccgccgcccgcaagauccccaaggucggccacaccuucuuccagaagcccgaguccugcccccccguccccggcggcuccaugaagcucgacaucggcaucaucaacgagaaccagcgcgucuccaugucccgcaacaucgagucccgcuccaccucccccuggaacuacaccgucaccugggaccccaaccgcuacccccucgaggucguccaggcccagugccgcaaccucggcugcaucaacgcccagggcaaggaggacaucuccaugaacuccguccccauccagcaggagacccucgucguccgccgcaagcaccagggcugcuccgucuccuuccagcucgagaagguccucgucaccgucggcugcaccugcgucacccccgucauccaccacguccaguga

SEQ ID NO: 4269 - RNA, 492 nt, Artificial Sequence
  derived and/or modified sequence opt3 from IL-17F__Homo_sapiens__ADY18335
augaccgugaagacacugcacggccccgccauggucaaauaccuccuucugagcaucuugggguuagcuuuccuguccgaggcagccgcgagaaagauuccuaaaguuggacauacguuuuuccagaagccagaaucuugcccgcccgugccugguggcucaaugaaacuagacauagggaucauuaacgagaaucaaaggguaaguaugagccggaacaucgaaucccgcucuacuucgccauggaauuauaccgugacaugggaucccaaccgauacccucucgaggucgugcaggcucagugucguaaucugggaugcauuaacgcccagggcaaggaagacaucucaaugaauagcguuccaauacaacaggagacucuuguggucagaaggaagcaccaggguuguaguguguccuuucagcuggagaaaguauugguuaccguggggugcacaugugucacccccgugauccaucacgugcaauga

SEQ ID NO: 4270 - RNA, 492 nt, Artificial Sequence
  derived and/or modified sequence opt4 from IL-17F__Homo_sapiens__ADY18335
augaccgugaagacccugcacggccccgccauggugaaguaccugcugcugagcauccugggccuggccuuccugagcgaggccgccgccagaaagauccccaaggugggccacaccuucuuccagaagcccgagagcugcccccccgugcccggcggcagcaugaagcuggacaucggcaucaucaacgagaaccagagagugagcaugagcagaaacaucgagagcagaagcaccagccccuggaacuacaccgugaccugggaccccaacagauacccccuggagguggugcaggcccagugcagaaaccugggcugcaucaacgcccagggcaaggaggacaucagcaugaacagcgugcccauccagcaggagacccugguggugagaagaaagcaccagggcugcagcgugagcuuccagcuggagaaggugcuggugaccgugggcugcaccugcgugacccccgugauccaccacgugcaguga

SEQ ID NO: 4271 - RNA, 492 nt, Artificial Sequence
  derived and/or modified sequence opt5 from IL-17F__Homo_sapiens__ADY18335
augaccgugaagacacugcacggccccgccauggucaaauaccuccugcuuagcauccuggggcucgcuuuccuguccgaggccgcggcuagaaagauuccuaaaguuggacauacguuuuuccagaagccggaaucuugucccccugugcccggcgggagcaugaaacuugacaucggaauuaucaaugagaaucaacggguguccaugucucgcaacauugaaagcagauccaccucuccuuggaauuauacagucaccugggaucccaaccgguacccucuggaggugguucaggcccagugccgcaaucucggcugcaucaacgcccaggggaaggaagacaucagcaugaacuccgugccgauucaacaggagacacuggucgugagacggaagcaccagggauguagcguuucuuuucagcuggagaaagugcucgucaccgugggcugcacaugugugacccccgucauccaucacguucaauga

SEQ ID NO: 4272 - RNA, 492 nt, Artificial Sequence
  derived and/or modified sequence opt6 from IL-17F__Homo_sapiens__ADY18335
augacaguaaaaacccuacacggaccagcaaugguaaaauaccuacuacuaucaauacuaggauuagcauuucuaucagaagcagcagcaagaaaaauaccaaaaguaggacacacauuuuuccaaaaaccagaaucaugcccacccguaccaggaggaucaaugaaacuagacauaggaauaauaaacgaaaaccaaagaguaucaaugucaagaaacauagaaucacgaucaacaucaccauggaacuacacaguaacaugggacccaaacagauacccacuagaaguaguacaagcacaaugcagaaaccuaggaugcauaaacgcacaaggaaaagaagacauaucaaugaacucaguuccaauacaacaagaaacauuaguaguaagaagaaaacaccaaggaugcucaguaucauuccaacuagaaaaaguacuaguaacaguaggaugcacaugcguaacaccagucauacaccacguacaauaa

SEQ ID NO: 4273 - protein, 163 aa, Artificial Sequence
  IL-17F__Homo_sapiens__Q96PD4
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 4274 - RNA, 492 nt, Artificial Sequence
  IL-17F__Homo_sapiens__AAK83350
augacagugaagacccugcauggcccagccauggucaaguacuugcugcugucgauauuggggcuugccuuucugagugaggcggcagcucggaaaauccccaaaguaggacauacuuuuuuccaaaagccugagaguugcccgccugugccaggagguaguaugaagcuugacauuggcaucaucaaugaaaaccagcgcguuuccaugucacguaacaucgagagccgcuccaccucccccuggaauuacacugucacuugggaccccaaccgguaccccucggaaguuguacaggcccaguguaggaacuugggcugcaucaaugcucaaggaaaggaagacaucuccaugaauuccguucccauccagcaagagacccuggucguccggaggaagcaccaaggcugcucuguuucuuuccaguuggagaaggugcuggugacuguuggcugcaccugcgucaccccugucauccaccaugugcaguaa

SEQ ID NO: 4275 - RNA, 492 nt, Artificial Sequence
  derived and/or modified sequence opt1 from IL-17F__Homo_sapiens__AAK83350
augaccgugaagacccugcacggccccgccauggucaaguaccuccugcugagcauccucgggcuggccuuccuguccgaggcggccgcccgcaagaucccgaaggugggccacaccuucuuccagaagcccgagagcugcccgcccgugcccgggggcuccaugaagcucgacaucgggaucaucaacgagaaccagcgggucagcaugucccgcaacaucgagagccgguccaccagccccuggaacuacaccgugaccugggaccccaaccgcuaccccuccgaggugguccaggcccagugccggaaccugggcugcaucaacgcccagggcaaggaggacaucagcaugaacuccgugccgauccagcaggagacgcuggugguccgccggaagcaccaggggugcagcguguccuuccagcucgagaaggugcuggucaccgugggcugcacgugcgugacccccgucauccaccacgugcaguga

SEQ ID NO: 4276 - RNA, 492 nt, Artificial Sequence
  derived and/or modified sequence opt2 from IL-17F__Homo_sapiens__AAK83350
augaccgucaagacccuccacggccccgccauggucaaguaccuccuccucuccauccucggccucgccuuccucuccgaggccgccgcccgcaagauccccaaggucggccacaccuucuuccagaagcccgaguccugcccccccguccccggcggcuccaugaagcucgacaucggcaucaucaacgagaaccagcgcgucuccaugucccgcaacaucgagucccgcuccaccucccccuggaacuacaccgucaccugggaccccaaccgcuaccccuccgaggucguccaggcccagugccgcaaccucggcugcaucaacgcccagggcaaggaggacaucuccaugaacuccguccccauccagcaggagacccucgucguccgccgcaagcaccagggcugcuccgucuccuuccagcucgagaagguccucgucaccgucggcugcaccugcgucacccccgucauccaccacguccaguga

SEQ ID NO: 4277 - RNA, 492 nt, Artificial Sequence
  derived and/or modified sequence opt3 from IL-17F__Homo_sapiens__AAK83350
augaccgugaagacacugcacggccccgccauggucaaauaccuccuucugagcaucuugggguuagcuuuccuguccgaggcagccgcgagaaagauuccuaaaguuggacauacguuuuuccagaagccagaaucuugcccgcccgugccugguggcucaaugaaacuagacauagggaucauuaacgagaaucaaaggguaaguaugagccggaacaucgaaucccgcucuacuucgccauggaauuauaccgugacaugggaucccaaccgauacccuucagaggucgugcaggcucagugucguaaucucggaugcauuaacgcccagggcaaggaagacaucagcaugaauaguguuccaauacaacaggagacucugguggucagaaggaagcaccaggguuguuccgugucuuuucagcuugagaaaguacugguuaccguggggugcacaugugucacccccgugauccaucacgugcaauga

SEQ ID NO: 4278 - RNA, 492 nt, Artificial Sequence
  derived and/or modified sequence opt4 from IL-17F__Homo_sapiens__AAK83350
augaccgugaagacccugcacggccccgccauggugaaguaccugcugcugagcauccugggccuggccuuccugagcgaggccgccgccagaaagauccccaaggugggccacaccuucuuccagaagcccgagagcugcccccccgugcccggcggcagcaugaagcuggacaucggcaucaucaacgagaaccagagagugagcaugagcagaaacaucgagagcagaagcaccagccccuggaacuacaccgugaccugggaccccaacagauaccccagcgagguggugcaggcccagugcagaaaccugggcugcaucaacgcccagggcaaggaggacaucagcaugaacagcgugcccauccagcaggagacccugguggugagaagaaagcaccagggcugcagcgugagcuuccagcuggagaaggugcuggugaccgugggcugcaccugcgugacccccgugauccaccacgugcaguga

SEQ ID NO: 4279 - RNA, 492 nt, Artificial Sequence
  derived and/or modified sequence opt5 from IL-17F__Homo_sapiens__AAK83350
augaccgugaagacacugcacggccccgccauggucaaauaccuccugcuuagcauccuggggcucgcuuuccuguccgaggccgcggcuagaaagauuccuaaaguuggacauacguuuuuccagaagccggaaucuugucccccugugcccggcgggagcaugaaacuugacaucggaauuaucaacgagaaucaacggguguccaugucucgcaacauugaaagcagauccaccucuccuuggaauuauacagucaccugggaucccaaccgguacccuagcgaggugguucaggcccagugccgcaaucugggcugcaucaacgcccaggggaaggaagacaucuccaugaauagcgugccgauucaacaggagacacucgucgugagacggaagcaccagggauguucuguuuccuuucagcuggagaaagugcuggucaccgugggcugcacaugugugacccccgucauccaucacguucaauga

SEQ ID NO: 4280 - RNA, 492 nt, Artificial Sequence
  derived and/or modified sequence opt6 from IL-17F__Homo_sapiens__AAK83350
augacaguaaaaacacuacacggaccagcaauggucaaauaccuacuacuaucaauacuaggacuagcauuccuaucagaagcagcagcaagaaaaauaccaaaaguaggacacacauucuuccaaaaaccagaauccugcccaccaguaccaggaggaucaaugaaacuagacauaggaauaauaaacgaaaaccaaagaguaagcaugucaagaaacauagaauccagaucaacauccccauggaacuacacaguaaccugggacccaaacagauacccaucagaaguaguacaagcacaaugcagaaaccuaggcugcauaaacgcacaaggaaaagaagacauaucaaugaacucaguaccaauacaacaagaaacauuaguaguaagaagaaaacaccaaggaugcucaguaucauuccaacuagaaaaaguacuaguaacaguaggaugcacaugcguaacuccaguaauacaccacguacaauaa

SEQ ID NO: 4281 - protein, 189 aa, Artificial Sequence
  IL-18__Homo_sapiens__A0A024R3E0
MAAEPVEDNCINFVAMKFIDNTLYFIENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 4282 - RNA, 570 nt, Artificial Sequence
  IL-18__Homo_sapiens__EAW67185
auggcugcugaaccaguagaagacaauugcaucaacuuuguggcaaugaaauuuauugacaauacgcuuuacuuuauagaaaaccuggaauccgauuacuuuggcaagcuugaaucuaaauuaucagucauaagaaauuugaaugaccaaguucucuucauugaccaaggaaaucggccucuauuugaagauaugacugauucugacuguagagauaaugcaccccggaccauauuuauuauaaguauguauaaagauagccagccuagagguauggcuguaacuaucucugugaagugugagaaaauuucaacucucuccugugagaacaaaauuauuuccuuuaaggaaaugaauccuccugauaacaucaaggauacaaaaagugacaucauauucuuucagagaagugucccaggacaugauaauaagaugcaauuugaaucuucaucauacgaaggauacuuucuagcuugugaaaaagagagagaccuuuuuaaacucauuuugaaaaaagaggaugaauugggggauagaucuauaauguucacuguucaaaacgaagacuag

SEQ ID NO: 4283 - RNA, 570 nt, Artificial Sequence
  derived and/or modified sequence opt1 from IL-18__Homo_sapiens__EAW67185
auggccgccgagcccguggaggacaacugcaucaacuucgucgccaugaaguucaucgacaacacccuguacuucaucgagaaccucgagagcgacuacuucggcaagcuggaguccaagcugagcgugauccgcaaccucaacgaccaggugcuguucaucgaccaggggaaccggccgcuguucgaggacaugaccgacuccgacugccgcgacaacgcgccccggacgaucuucaucaucagcauguacaaggacucccagccccgcggcauggccgucaccaucagcgugaagugcgagaagaucuccacccucagcugcgagaacaagaucaucuccuucaaggagaugaacccgcccgacaacaucaaggacaccaagagcgacaucaucuucuuccagcgguccgugcccgggcacgacaacaagaugcaguucgagagcuccagcuacgagggcuacuuccuggccugcgagaaggagcgcgaccuguucaagcucauccugaagaaggaggacgagcugggggaccgguccaucauguucacgguccagaacgaggacuga

SEQ ID NO: 4284 - RNA, 570 nt, Artificial Sequence
  derived and/or modified sequence opt2 from IL-18__Homo_sapiens__EAW67185
auggccgccgagcccgucgaggacaacugcaucaacuucgucgccaugaaguucaucgacaacacccucuacuucaucgagaaccucgaguccgacuacuucggcaagcucgaguccaagcucuccgucauccgcaaccucaacgaccagguccucuucaucgaccagggcaaccgcccccucuucgaggacaugaccgacuccgacugccgcgacaacgccccccgcaccaucuucaucaucuccauguacaaggacucccagccccgcggcauggccgucaccaucuccgucaagugcgagaagaucuccacccucuccugcgagaacaagaucaucuccuucaaggagaugaacccccccgacaacaucaaggacaccaaguccgacaucaucuucuuccagcgcuccguccccggccacgacaacaagaugcaguucgaguccuccuccuacgagggcuacuuccucgccugcgagaaggagcgcgaccucuucaagcucauccucaagaaggaggacgagcucggcgaccgcuccaucauguucaccguccagaacgaggacuga

SEQ ID NO: 4285 - RNA, 570 nt, Artificial Sequence
  derived and/or modified sequence opt3 from IL-18__Homo_sapiens__EAW67185
auggccgcugagcccguggaagacaacugcaucaauuucgucgcaaugaaguuuauugauaacacccuguacuucauagagaaucucgaaagcgacuauuuuggcaaacuugaguccaagcugucuguuaucagaaacuugaaugaucagguguuauucauugaccaagggaacaggccucuguuugaagauaugacagacucagauugucgggacaaugccccacgcacuaucuucauuaucaguauguacaaagauagccagccgcgaggaauggcgguaacgauauccgugaagugcgagaaaaucucuacccuaucgugugagaacaagauuaucucauuuaaggaaaugaaucccccugacaacauuaaagauacaaagagcgacaucauauucuuucagcguagugucccaggucacgauaauaaaaugcaguucgaguccucuagcuaugaaggcuacuuucucgcuugcgagaaggagagagaccuguucaaacuuauucugaagaaggaagacgaguugggggauagguccaucauguuuacugugcaaaacgaagacuga

SEQ ID NO: 4286 - RNA, 570 nt, Artificial Sequence
  derived and/or modified sequence opt4 from IL-18__Homo_sapiens__EAW67185
auggccgccgagcccguggaggacaacugcaucaacuucguggccaugaaguucaucgacaacacccuguacuucaucgagaaccuggagagcgacuacuucggcaagcuggagagcaagcugagcgugaucagaaaccugaacgaccaggugcuguucaucgaccagggcaacagaccccuguucgaggacaugaccgacagcgacugcagagacaacgcccccagaaccaucuucaucaucagcauguacaaggacagccagcccagaggcauggccgugaccaucagcgugaagugcgagaagaucagcacccugagcugcgagaacaagaucaucagcuucaaggagaugaacccccccgacaacaucaaggacaccaagagcgacaucaucuucuuccagagaagcgugcccggccacgacaacaagaugcaguucgagagcagcagcuacgagggcuacuuccuggccugcgagaaggagagagaccuguucaagcugauccugaagaaggaggacgagcugggcgacagaagcaucauguucaccgugcagaacgaggacuga

SEQ ID NO: 4287 - RNA, 570 nt, Artificial Sequence
  derived and/or modified sequence opt5 from IL-18__Homo_sapiens__EAW67185
auggccgcugagcccguggaagacaacugcaucaauuucgucgccaugaaguuuauugauaacacccuguacuucaucgagaaucucgaaagcgacuauuuuggcaaacuggaguccaagcucucuguuauuagaaaccugaaugaucaggugcuuuucaucgaccaagggaaccggccucuguuugaagauaugacagacagcgauugucgcgacaaugcgccgagaacgauuuucaucaucuccauguacaaagauucucagccccggggaauggcugugaccauuagcgucaagugcgagaaaaucuccacacuuucuugugagaacaagauuaucagcuuuaaggaaaugaauccucccgacaacauuaaagauaccaaguccgacaucauuuucuuucagcgcagcgugccuggccacgauaauaaaaugcaguucgagucuuccagcuaugaaggguacuuucuggccugcgagaaggagagagaccucuucaaacugauccugaagaaggaagacgagcucggagaucggucuaucauguuuacaguucaaaacgaagacuga

SEQ ID NO: 4288 - RNA, 570 nt, Artificial Sequence
  derived and/or modified sequence opt6 from IL-18__Homo_sapiens__EAW67185
auggcagcagaaccaguagaagacaacugcauaaacuucguagcaaugaaauucauagacaacacauuauacuucauagaaaaccuagaaucagacuacuucggaaaacuagaaucaaaacuaucaguaauacgcaacuuaaacgaccaaguacuauucauagaccaaggaaacagaccccuauucgaagacaugacagacucagacugcagagacaacgcaccaagaacaauauucauaauaucaauguacaaagacagccaaccaagaggaauggcaguaacaauaucaguaaaaugugaaaaaauaucaacacuaagcugcgaaaacaaaauaauaagcuucaaagaaaugaacccaccagacaacauaaaagacacaaaauccgacauaauauucuuccaaagaucaguacccggacacgacaacaaaaugcaauucgaaucaucaucauacgaaggauacuuccuagcaugcgaaaaagaacgagaccuauucaaacuaauacuaaaaaaagaagaugaacuaggagacagaucaauaauguucacaguacaaaacgaagacuaa

SEQ ID NO: 4289 - protein, 193 aa, Artificial Sequence [sequence omitted]

SEQ ID NO: 4290 - RNA, 582 nt, Artificial Sequence
  IL-18__Homo_sapiens__ACA06006
auggcugcugaaccaguagaagacaauugcaucaacuuuguggcaaugaaauuuauugacaauacgcuuuacuuuauaggugaacuauuaaaaaaccuggaaucagauuacuuuggcaagcuugaaucuaaauuaucagucauaagaaauuugaaugaccaaguucucuucauugaccaaggaaaucggccucuauuugaagauaugacugauucugacuguagagauaaugcaccccggaccauauuuauuauaaguauguauaaagauagccagccuagagguauggcuguaacuaucucugugaagugugagaaaauuucaacucucuccugugagaacaaaauuauuuccuuuaaggaaaugaauccuccugauaacaucaaggauacaaaaagugacaucauauucuuucagagaagugucccaggacaugauaauaagaugcaauuugaaucuucaucauacgaaggauacuuucuagcuugugaaaaagagagagaccuuuuuaaacucauuuugaaaaaagaggaugaauugggggauagaucuauaauguucacuguucaaaacgaagacuag

SEQ ID NO: 4291 - RNA, 582 nt, Artificial Sequence
  derived and/or modified sequence opt1 from IL-18__Homo_sapiens__ACA06006
auggccgccgagcccguggaggacaacugcaucaacuucgucgccaugaaguucaucgacaacacccuguacuucaucggcgagcuccugaagaaccuggagagcgacuacuucgggaagcucgaguccaagcugagcgugauccgcaaccugaacgaccagguccucuucaucgaccagggcaaccggccgcuguucgaggacaugaccgacuccgacugccgcgacaacgcgccccggacgaucuucaucaucagcauguacaaggacucccagccccgcgggauggccgugaccaucagcgugaagugcgagaagaucuccacccugagcugcgagaacaagaucaucuccuucaaggagaugaacccgcccgacaacaucaaggacaccaagagcgacaucaucuucuuccagcgguccgugcccggccacgacaacaagaugcaguucgagagcuccagcuacgagggguacuuccucgccugcgagaaggagcgcgaccuguucaagcugauccucaagaaggaggacgagcugggcgaccgguccaucauguucacgguccagaacgaggacuga

SEQ ID NO: 4292 - RNA, 582 nt, Artificial Sequence
  derived and/or modified sequence opt2 from IL-18__Homo_sapiens__ACA06006
auggccgccgagcccgucgaggacaacugcaucaacuucgucgccaugaaguucaucgacaacacccucuacuucaucggcgagcuccucaagaaccucgaguccgacuacuucggcaagcucgaguccaagcucuccgucauccgcaaccucaacgaccagguccucuucaucgaccagggcaaccgcccccucuucgaggacaugaccgacuccgacugccgcgacaacgccccccgcaccaucuucaucaucuccauguacaaggacucccagccccgcggcauggccgucaccaucuccgucaagugcgagaagaucuccacccucuccugcgagaacaagaucaucuccuucaaggagaugaacccccccgacaacaucaaggacaccaaguccgacaucaucuucuuccagcgcuccguccccggccacgacaacaagaugcaguucgaguccuccuccuacgagggcuacuuccucgccugcgagaaggagcgcgaccucuucaagcucauccucaagaaggaggacgagcucggcgaccgcuccaucauguucaccguccagaacgaggacuga

SEQ ID NO: 4293 - RNA, 582 nt, Artificial Sequence
  derived and/or modified sequence opt3 from IL-18__Homo_sapiens__ACA06006
auggccgcugagcccguggaagacaacugcaucaauuucgucgcaaugaaguuuauugauaacacccuguacuucauaggcgagcuccuuaaaaaucuggaaagcgacuauuuugggaaguuggaguccaaauuaucuguuaucagaaaccugaaugaucaggugcuauucauugaccaaggaaacaggccucucuuugaagauaugacagacucagauugucgggacaaugccccacgcacuaucuucauuaucaguauguacaaggauagccagccgcgagguauggcgguaacgauauccgugaaaugcgagaagaucucuacccugucgugugagaacaagauuaucucauuuaaagaaaugaaucccccugacaacauuaaggauacaaaaagcgacaucauauucuuucagcguagugucccaggccacgauaauaagaugcaguucgaguccucuagcuaugaaggguacuuucuugcuugcgagaaagagagagaccuguucaaguugauucucaagaaagaagacgagcugggagauagguccaucauguuuacugugcaaaacgaagacuga

SEQ ID NO: 4294 - RNA, 582 nt, Artificial Sequence
  derived and/or modified sequence opt4 from IL-18__Homo_sapiens__ACA06006
auggccgccgagcccguggaggacaacugcaucaacuucguggccaugaaguucaucgacaacacccuguacuucaucggcgagcugcugaagaaccuggagagcgacuacuucggcaagcuggagagcaagcugagcgugaucagaaaccugaacgaccaggugcuguucaucgaccagggcaacagaccccuguucgaggacaugaccgacagcgacugcagagacaacgcccccagaaccaucuucaucaucagcauguacaaggacagccagcccagaggcauggccgugaccaucagcgugaagugcgagaagaucagcacccugagcugcgagaacaagaucaucagcuucaaggagaugaacccccccgacaacaucaaggacaccaagagcgacaucaucuucuuccagagaagcgugcccggccacgacaacaagaugcaguucgagagcagcagcuacgagggcuacuuccuggccugcgagaaggagagagaccuguucaagcugauccugaagaaggaggacgagcugggcgacagaagcaucauguucaccgugcagaacgaggacuga

SEQ ID NO: 4295 - RNA, 582 nt, Artificial Sequence
  derived and/or modified sequence opt5 from IL-18__Homo_sapiens__ACA06006
auggccgcugagcccguggaagacaacugcaucaauuucgucgccaugaaguuuauugauaacacccuguacuucaucggcgagcuccugaaaaaucuugaaagcgacuauuuugggaagcuggaguccaaacucucuguuauuagaaaccugaaugaucaggugcuuuucaucgaccaaggaaaccggccucuguuugaagauaugacagacagcgauugucgcgacaaugcgccgagaacgauuuucaucaucuccauguacaaggauucucagccccggggcauggcugugaccauuagcgucaaaugcgagaagaucuccacacucucuugugagaacaagauuaucagcuuuaaagaaaugaauccucccgacaacauuaaggauaccaaauccgacaucauuuucuuucagcgcagcgugccugggcacgauaauaagaugcaguucgagucuuccagcuaugaaggauacuuucuggccugcgagaaagagagagaccuguucaagcucauccugaagaaagaagacgagcuuggcgaucggucuaucauguuuacaguucaaaacgaagacuga

SEQ ID NO: 4296 - RNA, 582 nt, Artificial Sequence
  derived and/or modified sequence opt6 from IL-18__Homo_sapiens__ACA06006
auggcagcagaaccaguagaagacaacugcauaaacuucguagcaaugaaauucauagacaacacacuauacuucauaggagaacuacuaaaaaaccuagaaucagacuacuucggaaaacuagaaucaaaacuauccguaauaagaaaccuaaacgaccaaguacuauucauagaccaaggaaacagaccacucuucgaagacaugacagacucagacugcagagacaacgcaccaagaacaauauucauaauaucaauguacaaagacucacaaccaagaggaauggcaguaaccauaucaguaaaaugcgaaaaaauaucaacacuaucaugcgaaaacaaaauaauaucauucaaagaaaugaacccaccagacaacauaaaagacacaaaaucagacauaauauucuuccaaagaucaguaccaggacacgacaacaaaaugcaauucgaaagcucaucauacgaaggauacuuccuagcaugcgaaaaagaaagagaccuauucaaauuaauacuaaaaaaagaagacgaacuaggagacagaucaauaauguucacaguccaaaacgaagacuaa

SEQ ID NO: 4297 - protein, 193 aa, Artificial Sequence
  IL-18__Homo_sapiens__Q14116
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 4298 - RNA, 582 nt, Artificial Sequence
  IL-18__Homo_sapiens__AAH07007
auggcugcugaaccaguagaagacaauugcaucaacuuuguggcaaugaaauuuauugacaauacgcuuuacuuuauagcugaagaugaugaaaaccuggaauccgauuacuuuggcaagcuugaaucuaaauuaucagucauaagaaauuugaaugaccaaguucucuucauugaccaaggaaaucggccucuauuugaagauaugacugauucugacuguagagauaaugcaccccggaccauauuuauuauaaguauguauaaagauagccagccuagagguauggcuguaacuaucucugugaagugugagaaaauuucaacucucuccugugagaacaaaauuauuuccuuuaaggaaaugaauccuccugauaacaucaaggauacaaaaagugacaucauauucuuucagagaagugucccaggacaugauaauaagaugcaauuugaaucuucaucauacgaaggauacuuucuagcuugugaaaaagagagagaccuuuuuaaacucauuuugaaaaaagaggaugaauugggggauagaucuauaauguucacuguucaaaacgaagacuag

SEQ ID NO: 4299 - RNA, 582 nt, Artificial Sequence
  derived and/or modified sequence opt1 from IL-18__Homo_sapiens__AAH07007
auggccgccgagcccguggaggacaacugcaucaacuucgucgccaugaaguucaucgacaacacccuguacuucaucgccgaggacgacgagaaccucgagagcgacuacuucggcaagcuggaguccaagcugagcgugauccgcaaccucaacgaccaggugcuguucaucgaccaggggaaccggccgcuguucgaggacaugaccgacuccgacugccgcgacaacgcgccccggacgaucuucaucaucagcauguacaaggacucccagccccgcggcauggccgucaccaucagcgugaagugcgagaagaucuccacccucagcugcgagaacaagaucaucuccuucaaggagaugaacccgcccgacaacaucaaggacaccaagagcgacaucaucuucuuccagcgguccgugcccgggcacgacaacaagaugcaguucgagagcuccagcuacgagggcuacuuccuggccugcgagaaggagcgcgaccuguucaagcucauccugaagaaggaggacgagcugggggaccgguccaucauguucacgguccagaacgaggacuga

SEQ ID NO: 4300 - RNA, 582 nt, Artificial Sequence
  derived and/or modified sequence opt2 from IL-18__Homo_sapiens__AAH07007
auggccgccgagcccgucgaggacaacugcaucaacuucgucgccaugaaguucaucgacaacacccucuacuucaucgccgaggacgacgagaaccucgaguccgacuacuucggcaagcucgaguccaagcucuccgucauccgcaaccucaacgaccagguccucuucaucgaccagggcaaccgcccccucuucgaggacaugaccgacuccgacugccgcgacaacgccccccgcaccaucuucaucaucuccauguacaaggacucccagccccgcggcauggccgucaccaucuccgucaagugcgagaagaucuccacccucuccugcgagaacaagaucaucuccuucaaggagaugaacccccccgacaacaucaaggacaccaaguccgacaucaucuucuuccagcgcuccguccccggccacgacaacaagaugcaguucgaguccuccuccuacgagggcuacuuccucgccugcgagaaggagcgcgaccucuucaagcucauccucaagaaggaggacgagcucggcgaccgcuccaucauguucaccguccagaacgaggacuga

SEQ ID NO: 4301 - RNA, 582 nt, Artificial Sequence
  derived and/or modified sequence opt3 from IL-18__Homo_sapiens__AAH07007
auggccgcugagcccguggaagacaacugcaucaauuucgucgcaaugaaguuuauugauaacacccuguacuucauagccgaggacgaugaaaaucucgagagcgacuauuuuggcaaacuugaauccaagcugucuguuaucagaaacuugaaugaucagguguuauucauugaccaagggaacaggccucuguuugaggauaugacagacucagauugucgggacaaugcgccacgcacuaucuucauuaucaguauguacaaagauagccagccgcgaggaauggcuguaacgauauccgugaagugcgagaaaaucucuacccuaucgugugaaaacaagauuaucucauuuaaggagaugaaucccccugacaacauuaaagauacaaagagcgacaucauauucuuucagcguagugucccaggucacgacaauaaaaugcaguucgaauccucuagcuaugagggcuacuuucucgccugcgagaaggaaagagaucuguucaaacuuauucugaagaaggaggacgaauugggggauagguccaucauguuuacugugcaaaacgaggacuga

SEQ ID NO: 4302 - RNA, 582 nt, Artificial Sequence
  derived and/or modified sequence opt4 from IL-18__Homo_sapiens__AAH07007
auggccgccgagcccguggaggacaacugcaucaacuucguggccaugaaguucaucgacaacacccuguacuucaucgccgaggacgacgagaaccuggagagcgacuacuucggcaagcuggagagcaagcugagcgugaucagaaaccugaacgaccaggugcuguucaucgaccagggcaacagaccccuguucgaggacaugaccgacagcgacugcagagacaacgcccccagaaccaucuucaucaucagcauguacaaggacagccagcccagaggcauggccgugaccaucagcgugaagugcgagaagaucagcacccugagcugcgagaacaagaucaucagcuucaaggagaugaacccccccgacaacaucaaggacaccaagagcgacaucaucuucuuccagagaagcgugcccggccacgacaacaagaugcaguucgagagcagcagcuacgagggcuacuuccuggccugcgagaaggagagagaccuguucaagcugauccugaagaaggaggacgagcugggcgacagaagcaucauguucaccgugcagaacgaggacuga

SEQ ID NO: 4303 - RNA, 582 nt, Artificial Sequence
  derived and/or modified sequence opt5 from IL-18__Homo_sapiens__AAH07007
auggccgcugagcccguggaagacaacugcaucaauuucgucgccaugaaguuuauugauaacacccuguacuucaucgcggaggacgaugaaaaucucgagagcgacuauuuuggcaaacuggaauccaagcucucuguuauuagaaaccugaaugaucaggugcuuuucaucgaccaagggaaccggccucuguuugaggauaugacagacagcgauugucgcgacaaugcuccgagaacgauuuucaucaucuccauguacaaagauucucagccccggggaauggccgugaccauuagcgucaagugcgagaaaaucuccacacuuucuugugaaaacaagauuaucagcuuuaaggagaugaauccucccgacaacauuaaagauaccaaguccgacaucauuuucuuucagcgcagcgugccuggccacgacaauaaaaugcaguucgaaucuuccagcuaugagggguacuuucuggccugcgagaaggaaagagaucucuucaaacugauccugaagaaggaggacgaacucggagaucggucuaucauguuuacaguucaaaacgaggacuga

SEQ ID NO: 4304 - RNA, 582 nt, Artificial Sequence
  derived and/or modified sequence opt6 from IL-18__Homo_sapiens__AAH07007
auggcagcagaaccaguagaagacaacugcauaaacuucguagcaaugaaauucaucgacaacacacuauacuucauagcagaagacgaugaaaaccuagaaagcgacuacuucggaaaauuagaaucaaaacuaucaguaauaagaaaccuaaacgaccaaguacuauucauagaccaaggaaacagaccacuauucgaagacaugacagacucagacugcagagacaacgcaccaagaacaauauucauaauaucaauguacaaagacagccaaccacgaggaauggcaguaacaauaagcguaaaaugcgaaaaaauaucaacacuaucaugcgaaaacaaaauaauaucauucaaagaaaugaacccaccagauaacauaaaagacacaaaaucagauauaauauucuuccaaagaucaguaccaggacacgacaacaaaaugcaauucgaaucaucaucauacgaaggauacuuccuagcaugcgaaaaagaacgagaccuauucaaacuaauacuaaaaaaagaagacgaauuaggagacagaucaauaauguucacaguacaaaacgaagacuaa

SEQ ID NO: 4305 - protein, 177 aa, Artificial Sequence
  IL-19__Homo_sapiens__Q9UHD0
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 4306 - RNA, 534 nt, Artificial Sequence
  IL-19__Homo_sapiens__CCDS1469.1
augaaguuacaguguguuucccuuuggcuccuggguacaauacugauauugugcucaguagacaaccacggucucaggagaugucugauuuccacagacaugcaccauauagaagagaguuuccaagaaaucaaaagagccauccaagcuaaggacaccuucccaaaugucacuauccuguccacauuggagacucugcagaucauuaagcccuuagaugugugcugcgugaccaagaaccuccuggcguucuacguggacaggguguucaaggaucaucaggagccaaaccccaaaaucuugagaaaaaucagcagcauugccaacucuuuccucuacaugcagaaaacucugcggcaaugucaggaacagaggcagugucacugcaggcaggaagccaccaaugccaccagagucauccaugacaacuaugaucagcuggagguccacgcugcugccauuaaaucccugggagagcucgacgucuuucuagccuggauuaauaagaaucaugaaguaauguucucagcuuga

SEQ ID NO: 4307 - RNA, 534 nt, Artificial Sequence
  derived and/or modified sequence opt1 from IL-19__Homo_sapiens__CCDS1469.1
augaagcugcagugcgugagccucuggcugcugggcaccauccucauccugugcuccgucgacaaccacgggcugcgccggugccucaucagcaccgacaugcaccacaucgaggaguccuuccaggagaucaagcgcgccauccaggccaaggacacguuccccaacgugaccauccugagcacccuggagacccuccagaucaucaagccgcuggacgugugcugcgucacgaagaaccugcucgcguucuacguggaccggguguucaaggaccaccaggagcccaaccccaagauccugcgcaagaucuccagcaucgccaacuccuuccuguacaugcagaagacccuccggcagugccaggagcagcgccagugccacugccggcaggaggccaccaacgccacccgcgucauccacgacaacuacgaccagcuggaggugcacgccgcggccaucaagagccugggcgagcucgacguguuccuggccuggaucaacaagaaccacgaggucauguucuccgccuga

SEQ ID NO: 4308 - RNA, 534 nt, Artificial Sequence
  derived and/or modified sequence opt2 from IL-19__Homo_sapiens__CCDS1469.1
augaagcuccagugcgucucccucuggcuccucggcaccauccucauccucugcuccgucgacaaccacggccuccgccgcugccucaucuccaccgacaugcaccacaucgaggaguccuuccaggagaucaagcgcgccauccaggccaaggacaccuuccccaacgucaccauccucuccacccucgagacccuccagaucaucaagccccucgacgucugcugcgucaccaagaaccuccucgccuucuacgucgaccgcgucuucaaggaccaccaggagcccaaccccaagauccuccgcaagaucuccuccaucgccaacuccuuccucuacaugcagaagacccuccgccagugccaggagcagcgccagugccacugccgccaggaggccaccaacgccacccgcgucauccacgacaacuacgaccagcucgagguccacgccgccgccaucaagucccucggcgagcucgacgucuuccucgccuggaucaacaagaaccacgaggucauguucuccgccuga

SEQ ID NO: 4309 - RNA, 534 nt, Artificial Sequence
  derived and/or modified sequence opt3 from IL-19__Homo_sapiens__CCDS1469.1
augaagcugcagugcgugagccucuggcuucugggcaccaucuugauuuuauguuccgucgacaaccacgggcugagaaggugccuaauaucuacagauaugcaucacaucgaggaaucauuccaagagauuaaacgggccauccaggcuaaggacacuuuucccaauguuacgauucucaguacccuggaaacacuucagaucauaaaaccucuggauguguguugcguaacuaagaacuugcucgcauucuacguggaccgcgucuuuaaagaucaucaggagccaaauccgaagauccugcgaaagauuagcuccaucgccaacucuuuccuguauaugcagaaaacccuccgucaaugucaggaacagagacaaugccacuguaggcaggaggcgacaaaugcuacccgggugauucaugacaacuacgaucaguuagagguucacgccgcagccaucaagucgcugggagaacuugacguguuuuuggcuuggauaaauaaaaaccacgaggucauguucucagcauga

SEQ ID NO: 4310 - RNA, 534 nt, Artificial Sequence
  derived and/or modified sequence opt4 from IL-19__Homo_sapiens__CCDS1469.1
augaagcugcagugcgugagccuguggcugcugggcaccauccugauccugugcagcguggacaaccacggccugagaagaugccugaucagcaccgacaugcaccacaucgaggagagcuuccaggagaucaagagagccauccaggccaaggacaccuuccccaacgugaccauccugagcacccuggagacccugcagaucaucaagccccuggacgugugcugcgugaccaagaaccugcuggccuucuacguggacagaguguucaaggaccaccaggagcccaaccccaagauccugagaaagaucagcagcaucgccaacagcuuccuguacaugcagaagacccugagacagugccaggagcagagacagugccacugcagacaggaggccaccaacgccaccagagugauccacgacaacuacgaccagcuggaggugcacgccgccgccaucaagagccugggcgagcuggacguguuccuggccuggaucaacaagaaccacgaggugauguucagcgccuga

SEQ ID NO: 4311 - RNA, 534 nt, Artificial Sequence
  derived and/or modified sequence opt5 from IL-19__Homo_sapiens__CCDS1469.1
augaagcugcagugcgugagccucuggcugcuuggcaccauccugauucucuguuccgucgacaaccacgggcugagacggugccuuaucucuacagauaugcaucacauugaggagagcuuccaagaaaucaaacgcgccauucaggcuaaggacacguuucccaauguuaccauccuguccacacucgaaacccugcagaucauuaaaccucuggauguguguugcgugacaaagaaccuccuggccuucuacgucgacagaguguuuaaagaucaucaggagccgaaucccaagauccuucggaagauuucuagcaucgcgaacuccuuccuguauaugcagaaaacccuccgccaaugucaggaacagagacaaugccacugucggcaggaggcuacaaaugccacccgcguuauucaugacaacuacgaucagcuggaggugcacgccgcugccaucaagucucuuggagaacuggacgucuuucucgcuuggauuaauaaaaaccacgaggugauguucagcgccuga

SEQ ID NO: 4312 - RNA, 534 nt, Artificial Sequence
  derived and/or modified sequence opt6 from IL-19__Homo_sapiens__CCDS1469.1
augaaacuacaaugcguaucacuauggcuacuaggaacaauacuaauacuaugcucaguagacaaucacggacuaagaagaugccuaauaucaacagacaugcaccacauagaagaaucauuucaagaaauaaaaagagcaauacaagcaaaagacacauucccaaacguaacaauacuaucaacacuagaaacacuacaaauaauaaaaccacucgacguaugcugcguaacaaaaaacuuacuagcauucuacguagacagagucuucaaagaccaccaagaaccaaacccaaaaauacuaagaaaaauaucaagcauagccaacucauuccuauacaugcaaaaaacacuaagacaaugccaagaacaaagacaaugccacugcagacaagaagcaacaaacgcaacaagaguaauacacgacaacuacgaccaauuagaaguacacgcagcagcaauaaaaucacuaggagaacuagacguauuccuagcauggauaaacaaaaaccaugaaguaauguucucagcauaa

SEQ ID NO: 4313 - protein, 271 aa, Artificial Sequence
  IL-1_alpha__Homo_sapiens__P01583
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 4314 - RNA, 816 nt, Artificial Sequence
  IL-1_alpha__Homo_sapiens__AAA59133
auggccaaaguuccagacauguuugaagaccugaagaacuguuacagugaaaaugaagaagacaguuccuccauugaucaucugucucugaaucagaaauccuucuaucauguaagcuauggcccacuccaugaaggcugcauggaucaaucugugucucugaguaucucugaaaccucuaaaacauccaagcuuaccuucaaggagagcauggugguaguagcaaccaacgggaagguucugaagaagagacgguugaguuuaagccaauccaucacugaugaugaccuggaggccaucgccaaugacucagaggaagaaaucaucaagccuaggucagcaccuuuuagcuuccugagcaaugugaaauacaacuuuaugaggaucaucaaauacgaauucauccugaaugacgcccucaaucaaaguauaauucgagccaaugaucaguaccucacggcugcugcauuacauaaucuggaugaagcagugaaauuugacaugggugcuuauaagucaucaaaggaugaugcuaaaauuaccgugauucuaagaaucucaaaaacucaauuguaugugacugcccaagaugaagaccaaccagugcugcugaaggagaugccugagauacccaaaaccaucacagguagugagaccaaccuccucuucuucugggaaacucacggcacuaagaacuauuucacaucaguugcccauccaaacuuguuuauugccacaaagcaagacuacugggugugcuuggcaggggggccacccucuaucacugacuuucagauacuggaaaaccaggcguag

SEQ ID NO: 4315 - RNA, 816 nt, Artificial Sequence
  derived and/or modified sequence opt1 from IL-1_alpha__Homo_sapiens__AAA59133
auggccaaggugcccgacauguucgaggaccugaagaacugcuacagcgagaacgaggaggacuccagcuccaucgaccaccucagccugaaccagaaguccuucuaccacgucagcuacggcccgcugcacgagggcugcauggaccaguccgugagccucuccaucagcgagaccuccaagaccagcaagcugacguucaaggaguccaugguggucguggccaccaacggcaaggugcugaagaagcgccggcucagccugucccagagcaucaccgacgacgaccuggaggcgaucgccaacgacuccgaggaggagaucaucaagccccgcagcgcccccuucuccuuccucagcaacgucaaguacaacuucaugcggaucaucaaguacgaguucauccugaacgacgcccugaaccagagcaucauccgcgccaacgaccaguaccucaccgcggccgcccugcacaaccuggacgaggccgugaaguucgacaugggggcguacaaguccagcaaggacgacgccaagaucacggugauccuccggaucuccaagacccagcuguacgucaccgcccaggacgaggaccagcccgugcugcucaaggagaugccggagauccccaagaccaucacgggcagcgagaccaaccugcuguucuucugggagacccacgggaccaagaacuacuucacguccguggcccaccccaaccucuucaucgccaccaagcaggacuacugggucugccuggcgggcgggcccccgagcaucaccgacuuccagauccuggagaaccaggccuga

SEQ ID NO: 4316 - RNA, 816 nt, Artificial Sequence
  derived and/or modified sequence opt2 from IL-1_alpha__Homo_sapiens__AAA59133
auggccaagguccccgacauguucgaggaccucaagaacugcuacuccgagaacgaggaggacuccuccuccaucgaccaccucucccucaaccagaaguccuucuaccacgucuccuacggcccccuccacgagggcugcauggaccaguccgucucccucuccaucuccgagaccuccaagaccuccaagcucaccuucaaggaguccauggucgucgucgccaccaacggcaagguccucaagaagcgccgccucucccucucccaguccaucaccgacgacgaccucgaggccaucgccaacgacuccgaggaggagaucaucaagccccgcuccgcccccuucuccuuccucuccaacgucaaguacaacuucaugcgcaucaucaaguacgaguucauccucaacgacgcccucaaccaguccaucauccgcgccaacgaccaguaccucaccgccgccgcccuccacaaccucgacgaggccgucaaguucgacaugggcgccuacaaguccuccaaggacgacgccaagaucaccgucauccuccgcaucuccaagacccagcucuacgucaccgcccaggacgaggaccagcccguccuccucaaggagaugcccgagauccccaagaccaucaccggcuccgagaccaaccuccucuucuucugggagacccacggcaccaagaacuacuucaccuccgucgcccaccccaaccucuucaucgccaccaagcaggacuacugggucugccucgccggcggcccccccuccaucaccgacuuccagauccucgagaaccaggccuga

SEQ ID NO: 4317 - RNA, 816 nt, Artificial Sequence
  derived and/or modified sequence opt3 from IL-1_alpha__Homo_sapiens__AAA59133
auggccaaggugcccgacauguucgaggaucugaaaaacugcuacagcgaaaaugaggaagacuccucuucaaucgaucaccucagucuuaaccaaaagagcuuuuaucaugucuccuacggcccucugcacgagggguguauggaccagucuguuucguugucaauuagcgaaaccaguaaaacauccaaguuaacuuucaaagagucuauggugguaguggcuacgaauggaaagguccugaagaaaagaaggcuaagccucucccagucaauaaccgaugacgaucuggaggcaaucgccaacgacagugaagaggaaauuaucaagccacggagcgcgccguuuucuuuccuuuccaaugugaaauauaacuuuaugcgcauuaucaaguacgaguucauacugaaugaugcuuugaaccagucaaucauucgagccaaugaccaguaucucacagcagccgcucugcauaaccuggaugaggcaguuaaauuugacaugggugccuacaagagcaguaaggaugacgcuaaaaucacugugauucuccguaucucuaagacccaauuauaugucacagcccaggacgaagaucagcccgugcugcuuaaagagaugccugaaauaccaaagaccauuacuggcuccgagacaaauuugcuguucuuuugggaaacccacgggacgaaaaacuacuucacuagcguagcgcaucccaaucuauuuaucgcaaccaagcaggacuacuggguuugccucgccggaggcccuccaucgauuacagauuuccaaauccuggagaaccaggcuuga

SEQ ID NO: 4318 - RNA, 816 nt, Artificial Sequence
  derived and/or modified sequence opt4 from IL-1_alpha__Homo_sapiens__AAA59133
auggccaaggugcccgacauguucgaggaccugaagaacugcuacagcgagaacgaggaggacagcagcagcaucgaccaccugagccugaaccagaagagcuucuaccacgugagcuacggcccccugcacgagggcugcauggaccagagcgugagccugagcaucagcgagaccagcaagaccagcaagcugaccuucaaggagagcaugguggugguggccaccaacggcaaggugcugaagaagagaagacugagccugagccagagcaucaccgacgacgaccuggaggccaucgccaacgacagcgaggaggagaucaucaagcccagaagcgcccccuucagcuuccugagcaacgugaaguacaacuucaugagaaucaucaaguacgaguucauccugaacgacgcccugaaccagagcaucaucagagccaacgaccaguaccugaccgccgccgcccugcacaaccuggacgaggccgugaaguucgacaugggcgccuacaagagcagcaaggacgacgccaagaucaccgugauccugagaaucagcaagacccagcuguacgugaccgcccaggacgaggaccagcccgugcugcugaaggagaugcccgagauccccaagaccaucaccggcagcgagaccaaccugcuguucuucugggagacccacggcaccaagaacuacuucaccagcguggcccaccccaaccuguucaucgccaccaagcaggacuacugggugugccuggccggcggcccccccagcaucaccgacuuccagauccuggagaaccaggccuga

SEQ ID NO: 4319 - RNA, 816 nt, Artificial Sequence
  derived and/or modified sequence opt5 from IL-1_alpha__Homo_sapiens__AAA59133
auggccaaggugcccgacauguucgaggaucugaaaaacugcuacagcgaaaaugaggaagacuccucuagcaucgaucaccucucccugaaccagaagucuuuuuaucaugucagcuacggcccucuucacgagggguguauggaccaauccguuucucugagcauuuccgaaaccagcaaaacaucuaagcucacguucaaagaguccauggugguggucgcuaccaauggaaaggugcugaagaaaagacggcuuagccugucucaguccaucacagaugacgaucucgaggccauugcgaacgacagcgaagaggaaaucauuaagccgcgcucugcucccuuuuccuuccugagcaauguuaaauauaacuuuaugagaaucaucaaguacgaguucauucugaaugaugcccucaaccaguccaucauucgggccaaugaccaguaucugaccgcugccgcccuucauaaccuggaugaggcugugaaauuugacaugggcgcguacaagucuagcaaggaugacgccaaaaucacagucauucuccgcaucuccaagacccaacuguaugugacagcucaggacgaagaucagccuguucuucugaaagagaugcccgaaauuccuaagaccaucacggggagcgagaccaaucuccuguucuuuugggaaacacacggaaccaaaaacuacuucacaucuguggcccaucccaaucuguuuaucgcuaccaagcaggacuacugggucugccucgccggcgggccuccguccauuacggauuuccaaauccuggagaaccaggcguga

SEQ ID NO: 4320 - RNA, 816 nt, Artificial Sequence
  derived and/or modified sequence opt6 from IL-1_alpha__Homo_sapiens__AAA59133
auggcaaaaguaccagacauguucgaagacuuaaaaaauugcuacucagaaaacgaagaagacucaucauccauagaccaccuaucacuaaaccaaaaauccuucuaucacguaucauacggaccacuacacgaaggaugcauggaccaaucaguaucacuaucuauaucagaaacaucaaaaacaucaaaacuaacauucaaagaaucaaugguaguaguagcaacaaacggaaaaguauuaaaaaaaagaagauuaucacuaucacaauccauaacagacgacgaccuagaagccauagcaaaugacucagaagaagaaauaauaaaaccacgaucagcaccauuuucauuccuaucaaauguaaaauacaauuucaugcgaauaauaaaauacgaauucauauuaaacgacgcacuaaaccaaucaauaauaagagccaacgaccaauaccuaacugcagcagcacuacacaaccucgacgaagcaguaaaauucgacaugggagccuauaaaucaucaaaagacgacgcaaaaauaacagucauauuaagaauaucaaaaacacaauuauacguaacagcacaagacgaagaccaaccaguacuacuaaaagaaaugccugaaauaccaaaaacaauaacaggaucagaaacaaacuuauuauucuucugggaaacacacggaacaaaaaacuacuucacaucuguagcacacccaaaccuauucauagcaaccaaacaagacuacuggguaugccuagcuggaggcccaccauccaucacagacuuccaaauacuagaaaaccaagcauaa

SEQ ID NO: 4321 - protein, 269 aa, Artificial Sequence
  IL-1_beta__Homo_sapiens__P01584
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 4322 - RNA, 810 nt, Artificial Sequence
  IL-1_beta__Homo_sapiens__AAA59135
auggcagaaguaccugagcucgccagugaaaugauggcuuauuacaguggcaaugaggaugacuuguucuuugaagcugauggcccuaaacagaugaagugcuccuuccaggaccuggaccucugcccucuggauggcggcauccagcuacgaaucuccgaccaccacuacagcaagggcuucaggcaggccgcgucaguuguuguggccauggacaagcugaggaagaugcugguucccugcccacagaccuuccaggagaaugaccugagcaccuucuuucccuucaucuuugaagaagaaccuaucuucuucgacacaugggauaacgaggcuuaugugcacgaugcaccuguacgaucacugaacugcacgcuccgggacucacagcaaaaaagcuuggugaugucugguccauaugaacugaaagcucuccaccuccagggacaggauauggagcaacaagugguguucuccauguccuuuguacaaggagaagaaaguaaugacaaaauaccuguggccuugggccucaaggaaaagaaucuguaccuguccugcguguugaaagaugauaagcccacucuacagcuggagaguguagaucccaaaaauuacccaaagaagaagauggaaaagcgauuugucuucaacaagauagaaaucaauaacaagcuggaauuugagucugcccaguuccccaacugguacaucagcaccucucaagcagaaaacaugcccgucuuccugggagggaccaaaggcggccaggauauaacugacuucaccaugcaauuugugucuuccuaa

SEQ ID NO: 4323 - RNA, 810 nt, Artificial Sequence
  derived and/or modified sequence opt1 from IL-1_beta__Homo_sapiens__AAA59135
auggccgaggugcccgagcuggccagcgagaugauggcguacuacuccggcaacgaggacgaccucuucuucgaggccgacgggccgaagcagaugaagugcagcuuccaggaccuggaccugugcccccucgacggcgggauccagcugcgcaucuccgaccaccacuacagcaagggcuuccggcaggccgccuccgucgugguggccauggacaagcugcgcaagaugcucguccccugcccccagaccuuccaggagaacgaccugagcaccuucuucccguucaucuucgaggaggagcccaucuucuucgacacgugggacaacgaggcguacgugcacgacgcccccgugcggucccugaacugcacccuccgcgacagccagcagaagucccuggucaugagcgggcccuacgagcugaaggcccuccaccuccagggccaggacauggagcagcaggucguguucuccaugagcuucgugcagggcgaggaguccaacgacaagaucccgguggcccuggggcugaaggagaagaaccuguaccugagcugcgugcucaaggacgacaagcccacccugcagcuggaguccgucgaccccaagaacuaccccaagaagaagauggagaagcgguucguguucaacaagaucgagaucaacaacaagcucgaguucgagagcgcgcaguucccgaacugguacaucuccaccagccaggccgagaacaugcccguguuccugggcgggacgaagggcgggcaggacaucaccgacuucaccaugcaguucgucuccagcuga

SEQ ID NO: 4324 - RNA, 810 nt, Artificial Sequence
  derived and/or modified sequence opt2 from IL-1_beta__Homo_sapiens__AAA59135
auggccgagguccccgagcucgccuccgagaugauggccuacuacuccggcaacgaggacgaccucuucuucgaggccgacggccccaagcagaugaagugcuccuuccaggaccucgaccucugcccccucgacggcggcauccagcuccgcaucuccgaccaccacuacuccaagggcuuccgccaggccgccuccgucgucgucgccauggacaagcuccgcaagaugcucguccccugcccccagaccuuccaggagaacgaccucuccaccuucuuccccuucaucuucgaggaggagcccaucuucuucgacaccugggacaacgaggccuacguccacgacgcccccguccgcucccucaacugcacccuccgcgacucccagcagaagucccucgucauguccggccccuacgagcucaaggcccuccaccuccagggccaggacauggagcagcaggucgucuucuccauguccuucguccagggcgaggaguccaacgacaagauccccgucgcccucggccucaaggagaagaaccucuaccucuccugcguccucaaggacgacaagcccacccuccagcucgaguccgucgaccccaagaacuaccccaagaagaagauggagaagcgcuucgucuucaacaagaucgagaucaacaacaagcucgaguucgaguccgcccaguuccccaacugguacaucuccaccucccaggccgagaacaugcccgucuuccucggcggcaccaagggcggccaggacaucaccgacuucaccaugcaguucgucuccuccuga

SEQ ID NO: 4325 - RNA, 810 nt, Artificial Sequence
  derived and/or modified sequence opt3 from IL-1_beta__Homo_sapiens__AAA59135
auggccgaggugcccgaacuggcuagcgagaugauggcauacuauuccggcaacgaagacgaucucuucuuugaggccgacgggccuaagcagaugaaaugcucuuuccaagaucuugaccuguguccauuggauggagguauccaguuaagaauuucagaccaccauuacaguaagggcuuuaggcaggcggcuagcgucguuguggccauggauaaacugcggaagaugcuaguaccgugcccccagaccuuccaagaaaaugaccucuccacauuuuucccuuuuauauucgaggaggaaccaaucuuuuucgauacuugggacaacgaggcauaugugcacgaugcccccguccgcucucugaauuguacgcuucgagacucgcagcagaaaucacuggugaugagcgggccuuacgaauugaaggcucuccaucugcagggacaagauauggagcagcagguuguguuuaguauguccuucguccagggcgaggaaucuaacgacaagauuccaguggcacugggucucaaagagaagaauuuauaucugagcugcguacuuaaagacgauaagcccaccuugcaacuggaauccguugacccuaaaaacuacccaaagaagaaaauggagaagcguuuuguguucaauaaaaucgaaauuaacaauaagcuagaguucgagucagcccaguuuccgaacugguauaucaguacaagccaggcugaaaauaugcccgucuuccucgggggaacuaaaggcggccaagauauaaccgacuuuacaaugcaguucgugucuuccuga

SEQ ID NO: 4326 - RNA, 810 nt, Artificial Sequence
  derived and/or modified sequence opt4 from IL-1_beta__Homo_sapiens__AAA59135
auggccgaggugcccgagcuggccagcgagaugauggccuacuacagcggcaacgaggacgaccuguucuucgaggccgacggccccaagcagaugaagugcagcuuccaggaccuggaccugugcccccuggacggcggcauccagcugagaaucagcgaccaccacuacagcaagggcuucagacaggccgccagcguggugguggccauggacaagcugagaaagaugcuggugcccugcccccagaccuuccaggagaacgaccugagcaccuucuuccccuucaucuucgaggaggagcccaucuucuucgacaccugggacaacgaggccuacgugcacgacgcccccgugagaagccugaacugcacccugagagacagccagcagaagagccuggugaugagcggccccuacgagcugaaggcccugcaccugcagggccaggacauggagcagcaggugguguucagcaugagcuucgugcagggcgaggagagcaacgacaagauccccguggcccugggccugaaggagaagaaccuguaccugagcugcgugcugaaggacgacaagcccacccugcagcuggagagcguggaccccaagaacuaccccaagaagaagauggagaagagauucguguucaacaagaucgagaucaacaacaagcuggaguucgagagcgcccaguuccccaacugguacaucagcaccagccaggccgagaacaugcccguguuccugggcggcaccaagggcggccaggacaucaccgacuucaccaugcaguucgugagcagcuga

SEQ ID NO: 4327 - RNA, 810 nt, Artificial Sequence
  derived and/or modified sequence opt5 from IL-1_beta__Homo_sapiens__AAA59135
auggccgaggugcccgaacuggcuagcgagaugauggccuacuauuccggcaacgaagacgaucucuucuuugaggcggacgggccuaagcagaugaaaugcucuuuccaagaucuggaccuuuguccgcuggauggaggcauccagcucagaauuagcgaccaccauuacuccaagggguuucggcaggcugccucugucguuguggccauggauaaacugcgcaagaugcuugugcccugcccucagaccuuccaagaaaaugaccugagcacauuuuuccccuuuaucuucgaggaggaaccuaucuuuuucgauacgugggacaacgaggcuuauguccacgaugcccccgugagaucccucaauuguacccugcgggacucucagcagaaaagccugguuauguccggaccuuacgaacucaaggcucugcaucuucagggccaagauauggagcaacagguggucuuuagcaugucuuucgugcagggggaggaauccaacgacaagauuccgguugcccugggacucaaagagaagaaucuguaucuuagcugcgugcugaaagacgauaagcccacacuccagcuggaaucugucgacccuaaaaacuaccccaagaagaaaauggagaagcgcuuuguguucaauaaaauugaaaucaacaauaagcuggaguucgaguccgcgcaguuuccuaacugguauaucagcaccucucaggccgaaaauaugcccguguuccucggcggcacaaaagggggacaagauauuaccgacuuuacaaugcaguucgucuccagcuga

SEQ ID NO: 4328 - RNA, 810 nt, Artificial Sequence
  derived and/or modified sequence opt6 from IL-1_beta__Homo_sapiens__AAA59135
auggcagaaguaccagaauuagcaucagaaaugauggcauauuacucaggaaacgaagaugaucuauucuucgaagcagacggaccaaaacaaaugaaauguagcuuccaagaccuagaccuauguccacuagauggcggaauacaacuaagaauaucagaccaccacuacucaaaaggauuccgacaagcagcaucaguaguaguagcuauggacaaauuaagaaaaaugcuaguaccaugcccacaaacauuccaagaaaacgaccuaucaacauucuucccauucauauucgaagaagaaccaauauucuucgacaccugggacaacgaagccuauguacacgacgcaccaguaagaucacuaaacugcacauuacgagacucacaacaaaaaucacuagucaugucaggacccuacgaacuaaaagcacuacacuuacaaggacaagacauggaacaacaaguaguauucucaaugucauuuguacaaggagaagaaucaaacgauaaaauaccaguagcacuaggacucaaagaaaaaaaccuauaucuaucauguguauuaaaagaugacaaaccaacauuacaacuagaaucagucgauccaaaaaacuacccaaaaaaaaaaauggaaaaaagauucguauucaacaaaauagaaauaaacaauaaacuagaauucgaauccgcacaauucccaaacugguacauaucaacaucccaagcagaaaacaugccaguauuccuaggaggaacaaaaggaggacaagacauaacagacuucacaaugcaauucguaucaucauaa

SEQ ID NO: 4329 - protein, 159 aa, Artificial Sequence
  IL-1ra_(antagonist)__Homo_sapiens__P18510-2
MALETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 4330 - RNA, 480 nt, Artificial Sequence
  IL-1ra_(antagonist)__Homo_sapiens__CCDS2113.1
auggcuuuagagacgaucugccgacccucugggagaaaauccagcaagaugcaagccuucagaaucugggauguuaaccagaagaccuucuaucugaggaacaaccaacuaguugcuggauacuugcaaggaccaaaugucaauuuagaagaaaagauagaugugguacccauugagccucaugcucuguucuugggaauccauggagggaagaugugccuguccugugucaagucuggugaugagaccagacuccagcuggaggcaguuaacaucacugaccugagcgagaacagaaagcaggacaagcgcuucgccuucauccgcucagacaguggccccaccaccaguuuugagucugccgccugccccgguugguuccucugcacagcgauggaagcugaccagcccgucagccucaccaauaugccugacgaaggcgucauggucaccaaauucuacuuccaggaggacgaguag

SEQ ID NO: 4331 - RNA, 480 nt, Artificial Sequence
  derived and/or modified sequence opt1 from IL-1ra_(antagonist)__Homo_sapiens__CCDS2113.1
auggcccuggagaccaucugccgccccagcggccggaaguccagcaagaugcaggccuuccgcaucugggacgugaaccagaagaccuucuaccuccggaacaaccagcuggucgcgggguaccugcagggcccgaacgugaaccucgaggagaagaucgacgugguccccaucgagccccacgcccuguuccuggggauccacggcgggaagaugugccucuccugcgucaagagcggcgacgagacgcgccugcagcuggaggccgugaacaucaccgaccucuccgagaaccggaagcaggacaagcgcuucgccuucauccggagcgacuccggccccaccaccagcuucgaguccgccgcgugcccggggugguuccugugcacggccauggaggccgaccagcccgugagccugaccaacaugcccgacgagggcgugauggugaccaaguucuacuuccaggaggacgaguga

SEQ ID NO: 4332 - RNA, 480 nt, Artificial Sequence
  derived and/or modified sequence opt2 from IL-1ra_(antagonist)__Homo_sapiens__CCDS2113.1
auggcccucgagaccaucugccgccccuccggccgcaaguccuccaagaugcaggccuuccgcaucugggacgucaaccagaagaccuucuaccuccgcaacaaccagcucgucgccggcuaccuccagggccccaacgucaaccucgaggagaagaucgacgucguccccaucgagccccacgcccucuuccucggcauccacggcggcaagaugugccucuccugcgucaaguccggcgacgagacccgccuccagcucgaggccgucaacaucaccgaccucuccgagaaccgcaagcaggacaagcgcuucgccuucauccgcuccgacuccggccccaccaccuccuucgaguccgccgccugccccggcugguuccucugcaccgccauggaggccgaccagcccgucucccucaccaacaugcccgacgagggcgucauggucaccaaguucuacuuccaggaggacgaguga

SEQ ID NO: 4333 - RNA, 480 nt, Artificial Sequence
  derived and/or modified sequence opt3 from IL-1ra_(antagonist)__Homo_sapiens__CCDS2113.1
auggcccuggagaccaucugcagacccagcggcaggaaguccucuaaaaugcaggcuuuccggauuugggacgugaaccaaaagacauuuuaccuccgcaauaaccagcuugucgcaggguaucugcagggaccuaauguuaacuuggaagagaaaauagaugugguaccaaucgaaccgcacgccuuauuccuggguauucauggcgggaagaugugucuaucaugcgugaaaaguggagacgagacucgacuccagcuggaagcggucaauaucacggaucuuagcgagaaccguaagcaagacaagagauuugcuuucauuagguccgauucuggccccaccacaucguuugagucagccgcauguccugguugguuccugugcacugccauggaagcugaccagccagugagcuugaccaauaugcccgaugaggggguuauggugacaaaauuuuacuuccaggaagacgaguga

SEQ ID NO: 4334 - RNA, 480 nt, Artificial Sequence
  derived and/or modified sequence opt4 from IL-1ra_(antagonist)__Homo_sapiens__CCDS2113.1
auggcccuggagaccaucugcagacccagcggcagaaagagcagcaagaugcaggccuucagaaucugggacgugaaccagaagaccuucuaccugagaaacaaccagcugguggccggcuaccugcagggccccaacgugaaccuggaggagaagaucgacguggugcccaucgagccccacgcccuguuccugggcauccacggcggcaagaugugccugagcugcgugaagagcggcgacgagaccagacugcagcuggaggccgugaacaucaccgaccugagcgagaacagaaagcaggacaagagauucgccuucaucagaagcgacagcggccccaccaccagcuucgagagcgccgccugccccggcugguuccugugcaccgccauggaggccgaccagcccgugagccugaccaacaugcccgacgagggcgugauggugaccaaguucuacuuccaggaggacgaguga

SEQ ID NO: 4335 - RNA, 480 nt, Artificial Sequence
  derived and/or modified sequence opt5 from IL-1ra_(antagonist)__Homo_sapiens__CCDS2113.1
auggcccuggagaccaucugcagacccagcggccggaaguccucuaaaaugcaggcuuuccgcauuugggacgugaaccaaaagacauuuuaccucagaaauaaccagcuggucgccggguaucuucagggaccuaauguuaaccuggaagagaaaaucgauguggugccgauugaaccccacgcucucuuccugggcauccaugggggaaagaugugucuuagcugcgucaaauccggcgacgagacgcggcugcagcucgaagcggugaauauuaccgaucugucugagaaccgcaagcaagacaagagauuugccuucauccggagcgauuccgggccuacaaccucuuuugagagcgccgcuugucccggaugguuccugugcacagccauggaagcugaccagccuguuucccucaccaauaugcccgaugagggcgugauggucacaaaauuuuacuuccaggaagacgaguga

SEQ ID NO: 4336 - RNA, 480 nt, Artificial Sequence
  derived and/or modified sequence opt6 from IL-1ra_(antagonist)__Homo_sapiens__CCDS2113.1
auggcacuagaaacaauaugcagaccaucaggaagaaaaucaucaaaaaugcaagcauucagaauaugggacguaaaccaaaaaacauucuauuuaagaaacaaccaacuaguagcaggauacuuacaaggaccaaacguaaaccuagaagaaaaaauagacguaguaccaauagaaccacacgcacuauuccuaggaauacacggaggaaaaaugugccuaagcugcguaaaaucaggagacgaaacaagauuacaauuagaagccguaaacauaacagaccuaucagaaaacagaaaacaagacaaaagauucgcauucauaagaucagacucaggaccaacaacaucauucgaaucagcagcaugcccaggaugguuccuauguacagcaauggaagcagaccaaccaguaucacuaacaaacaugccagacgaaggaguaaugguaacaaaauucuacuuccaagaagacgaauaa

SEQ ID NO: 4337 - protein, 180 aa, Artificial Sequence
  IL-1ra_(antagonist)__Homo_sapiens__P18510-3
MALADLYEEGGGGGGEGEDNADSKETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 4338 - RNA, 543 nt, Artificial Sequence
  IL-1ra_(antagonist)__Homo_sapiens__CCDS2114.1
auggcuuuagcugacuuguaugaagaaggagguggaggaggaggagaaggugaagacaaugcugacucaaaggagacgaucugccgacccucugggagaaaauccagcaagaugcaagccuucagaaucugggauguuaaccagaagaccuucuaucugaggaacaaccaacuaguugcuggauacuugcaaggaccaaaugucaauuuagaagaaaagauagaugugguacccauugagccucaugcucuguucuugggaauccauggagggaagaugugccuguccugugucaagucuggugaugagaccagacuccagcuggaggcaguuaacaucacugaccugagcgagaacagaaagcaggacaagcgcuucgccuucauccgcucagacaguggccccaccaccaguuuugagucugccgccugccccgguugguuccucugcacagcgauggaagcugaccagcccgucagccucaccaauaugccugacgaaggcgucauggucaccaaauucuacuuccaggaggacgaguag

SEQ ID NO: 4339 - RNA, 543 nt, Artificial Sequence
  derived and/or modified sequence opt1 from IL-1ra_(antagonist)__Homo_sapiens__CCDS2114.1
auggcccuggccgaccucuacgaggagggcgggggcgggggcggggagggcgaggacaacgcggacagcaaggagaccaucugccgccccuccggccgcaagagcuccaagaugcaggccuuccggaucugggacgugaaccagaagaccuucuaccugcggaacaaccagcuggucgccggguaccuccagggcccgaacgugaaccuggaggagaagaucgacgugguccccaucgagccccacgcccuguuccucgggauccacggcgggaagaugugccugagcugcgugaaguccggcgacgagacgcgccugcagcucgaggccgugaacaucaccgaccugagcgagaaccggaagcaggacaagcgcuucgcguucauccgguccgacagcggccccaccaccuccuucgagagcgccgccugcccggggugguuccugugcacggccauggaggcggaccagcccgucucccucaccaacaugcccgacgagggcgugauggugaccaaguucuacuuccaggaggacgaguga

SEQ ID NO: 4340 - RNA, 543 nt, Artificial Sequence
  derived and/or modified sequence opt2 from IL-1ra_(antagonist)__Homo_sapiens__CCDS2114.1
auggcccucgccgaccucuacgaggagggcggcggcggcggcggcgagggcgaggacaacgccgacuccaaggagaccaucugccgccccuccggccgcaaguccuccaagaugcaggccuuccgcaucugggacgucaaccagaagaccuucuaccuccgcaacaaccagcucgucgccggcuaccuccagggccccaacgucaaccucgaggagaagaucgacgucguccccaucgagccccacgcccucuuccucggcauccacggcggcaagaugugccucuccugcgucaaguccggcgacgagacccgccuccagcucgaggccgucaacaucaccgaccucuccgagaaccgcaagcaggacaagcgcuucgccuucauccgcuccgacuccggccccaccaccuccuucgaguccgccgccugccccggcugguuccucugcaccgccauggaggccgaccagcccgucucccucaccaacaugcccgacgagggcgucauggucaccaaguucuacuuccaggaggacgaguga

SEQ ID NO: 4341 - RNA, 543 nt, Artificial Sequence
  derived and/or modified sequence opt3 from IL-1ra_(antagonist)__Homo_sapiens__CCDS2114.1
auggcccuggcugaccucuacgaggaaggcgggggagguggcggggagggagaagauaacgcagacagcaaggagaccaucugcagacccuccggcaggaaaucuucaaagaugcaggccuuccggauuugggaugugaaucaaaagacauuuuaucuucgcaacaaucagcuggucgcggguuacuugcaggggccuaacguuaauuuagaagagaagauagacgugguaccaaucgagccgcacgcucuguuccuaggcauucauggaggcaaaaugugucucaguugcgugaaaagcggggaugaaacucgacugcagcuugaggccgucaacaucacggaccuguccgaaaaucguaagcaagauaaaagauuugcauucauuaggucugacucgggacccaccacaucauuugagagcgccgcuuguccugguugguucuugugcacugcaauggaggccgaucagccagugagucucaccaacaugcccgacgaaggcguuauggugacaaaguuuuauuuccaggaggaugaauga

SEQ ID NO: 4342 - RNA, 543 nt, Artificial Sequence
  derived and/or modified sequence opt4 from IL-1ra_(antagonist)__Homo_sapiens__CCDS2114.1
auggcccuggccgaccuguacgaggagggcggcggcggcggcggcgagggcgaggacaacgccgacagcaaggagaccaucugcagacccagcggcagaaagagcagcaagaugcaggccuucagaaucugggacgugaaccagaagaccuucuaccugagaaacaaccagcugguggccggcuaccugcagggccccaacgugaaccuggaggagaagaucgacguggugcccaucgagccccacgcccuguuccugggcauccacggcggcaagaugugccugagcugcgugaagagcggcgacgagaccagacugcagcuggaggccgugaacaucaccgaccugagcgagaacagaaagcaggacaagagauucgccuucaucagaagcgacagcggccccaccaccagcuucgagagcgccgccugccccggcugguuccugugcaccgccauggaggccgaccagcccgugagccugaccaacaugcccgacgagggcgugauggugaccaaguucuacuuccaggaggacgaguga

SEQ ID NO: 4343 - RNA, 543 nt, Artificial Sequence
  derived and/or modified sequence opt5 from IL-1ra_(antagonist)__Homo_sapiens__CCDS2114.1
auggcccuggcugaccucuacgaggaaggcgggggaggcgggggagagggcgaagauaacgccgacagcaaggagaccaucugcagacccuccgggcggaaaucuagcaagaugcaggcguuccgcauuugggaugugaaucagaaaacauuuuaucugagaaacaaucaacuugucgcuggauaccugcagggcccuaacguuaaucucgaagagaagaucgacguggugccgauugagccccacgcccuguuccuuggcauccaugggggaaaaaugugucuguccugcgucaagucuggcgaugaaacgcggcuccagcuggaggccgugaacauuaccgaccugagcgaaaaucgcaagcaagauaaaagauuugcuuucauccgguccgacucugggccuacaaccagcuuugaguccgccgcuugucccggaugguuccucugcacagccauggaggcggaucagccuguuagccugaccaacaugcccgacgaaggcgugauggucacaaaguuuuauuuccaggaggaugaauga

SEQ ID NO: 4344 - RNA, 543 nt, Artificial Sequence
  derived and/or modified sequence opt6 from IL-1ra_(antagonist)__Homo_sapiens__CCDS2114.1
auggcacuagcagacuuauacgaagaaggaggaggaggaggaggagaaggagaagauaaugcagacagcaaagaaacaauauguagaccaagcggaagaaaaagcucaaaaaugcaagcauucagaauaugggacguaaaccaaaaaacauucuaucuaagaaacaaucaauuaguagcaggauauuuacaaggaccaaacguaaacuuagaagaaaaaauagacguaguaccaauagaaccacaugcauuauucuuaggaauacacggaggaaaaaugugucuaucaugcguaaaaucaggagaugaaacaagauuacaauuagaagcaguaaauauaacagaccuaagugaaaacagaaaacaagacaaaagauuugcauuuauaagaagcgacagcggaccaacaacaaguuucgaaagcgcagcauguccaggaugguuucuauguacagcaauggaagcagaucaaccaguaucacuaacaaacaugccagaugaaggaguaaugguaacaaaauuuuacuuucaagaagacgaauaa

SEQ ID NO: 4345 - protein, 177 aa, Artificial Sequence
  IL-1ra_(antagonist)__Homo_sapiens__P18510
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 4346 - RNA, 534 nt, Artificial Sequence
  IL-1ra_(antagonist)__Homo_sapiens__CCDS46396.1
auggaaaucugcagaggccuccgcagucaccuaaucacucuccuccucuuccuguuccauucagagacgaucugccgacccucugggagaaaauccagcaagaugcaagccuucagaaucugggauguuaaccagaagaccuucuaucugaggaacaaccaacuaguugcuggauacuugcaaggaccaaaugucaauuuagaagaaaagauagaugugguacccauugagccucaugcucuguucuugggaauccauggagggaagaugugccuguccugugucaagucuggugaugagaccagacuccagcuggaggcaguuaacaucacugaccugagcgagaacagaaagcaggacaagcgcuucgccuucauccgcucagacaguggccccaccaccaguuuugagucugccgccugccccgguugguuccucugcacagcgauggaagcugaccagcccgucagccucaccaauaugccugacgaaggcgucauggucaccaaauucuacuuccaggaggacgaguag

SEQ ID NO: 4347 - RNA, 534 nt, Artificial Sequence
  derived and/or modified sequence opt1 from IL-1ra_(antagonist)__Homo_sapiens__CCDS46396.1
auggagaucugccgcggccugcggagccaccucaucacccugcuccucuuccuguuccacuccgagaccaucugccgccccagcgggcggaaguccagcaagaugcaggccuuccgcaucugggacgugaaccagaagacguucuaccugcggaacaaccagcucgucgccggcuaccugcaggggccgaacgugaaccuggaggagaagaucgacgugguccccaucgagccccacgcgcuguuccugggcauccacgggggcaagaugugccuguccugcgucaagagcggcgacgagacccgccuccagcuggaggccgugaacaucaccgaccuguccgagaaccggaagcaggacaagcgcuucgccuucauccggagcgacuccgggcccaccacgagcuucgaguccgccgccugcccgggcugguuccucugcaccgcgauggaggccgaccagcccgugagccugaccaacaugcccgacgagggggugauggugaccaaguucuacuuccaggaggacgaguga

SEQ ID NO: 4348 - RNA, 534 nt, Artificial Sequence
  derived and/or modified sequence opt2 from IL-1ra_(antagonist)__Homo_sapiens__CCDS46396.1
auggagaucugccgcggccuccgcucccaccucaucacccuccuccucuuccucuuccacuccgagaccaucugccgccccuccggccgcaaguccuccaagaugcaggccuuccgcaucugggacgucaaccagaagaccuucuaccuccgcaacaaccagcucgucgccggcuaccuccagggccccaacgucaaccucgaggagaagaucgacgucguccccaucgagccccacgcccucuuccucggcauccacggcggcaagaugugccucuccugcgucaaguccggcgacgagacccgccuccagcucgaggccgucaacaucaccgaccucuccgagaaccgcaagcaggacaagcgcuucgccuucauccgcuccgacuccggccccaccaccuccuucgaguccgccgccugccccggcugguuccucugcaccgccauggaggccgaccagcccgucucccucaccaacaugcccgacgagggcgucauggucaccaaguucuacuuccaggaggacgaguga

SEQ ID NO: 4349 - RNA, 534 nt, Artificial Sequence
  derived and/or modified sequence opt3 from IL-1ra_(antagonist)__Homo_sapiens__CCDS46396.1
auggagaucugcagaggccugaggagccaccucauuacccuucuguuguucuuauuucauuccgaaacaauaugucggcccucugggcgcaagucaaguaaaaugcaggccuuccgaaucugggacgugaaccaaaagacuuuuuaccugcguaauaaccagcuagucgcuggauaucuccaggguccuaauguuaaccuggaggagaaaauugaugugguaccaaucgaaccgcacgcacuuuuccugggcauucaugggggaaagaugugcuugagcugugugaaauccggcgacgaaacgagacuccagcuggaggccgucaauaucaccgaucugucugagaacaggaagcaagacaagcgguuugcguucauacgcucggauucaggucccacaacuagcuuugaaagugcugccugcccugggugguuccucuguaccgcaauggaggccgaccagccaguguccuuaacaaauaugcccgaugaaggaguuauggugaccaaauuuuacuuccaggaggacgaguga

SEQ ID NO: 4350 - RNA, 534 nt, Artificial Sequence
  derived and/or modified sequence opt4 from IL-1ra_(antagonist)__Homo_sapiens__CCDS46396.1
auggagaucugcagaggccugagaagccaccugaucacccugcugcuguuccuguuccacagcgagaccaucugcagacccagcggcagaaagagcagcaagaugcaggccuucagaaucugggacgugaaccagaagaccuucuaccugagaaacaaccagcugguggccggcuaccugcagggccccaacgugaaccuggaggagaagaucgacguggugcccaucgagccccacgcccuguuccugggcauccacggcggcaagaugugccugagcugcgugaagagcggcgacgagaccagacugcagcuggaggccgugaacaucaccgaccugagcgagaacagaaagcaggacaagagauucgccuucaucagaagcgacagcggccccaccaccagcuucgagagcgccgccugccccggcugguuccugugcaccgccauggaggccgaccagcccgugagccugaccaacaugcccgacgagggcgugauggugaccaaguucuacuuccaggaggacgaguga

SEQ ID NO: 4351 - RNA, 534 nt, Artificial Sequence
  derived and/or modified sequence opt5 from IL-1ra_(antagonist)__Homo_sapiens__CCDS46396.1
auggagaucugcagaggccugcggagccaccucauuacccugcuucuguuccucuuucauuccgaaacaaucugucgccccucugggagaaagagcuccaaaaugcaggccuuccggauuugggacgugaaccaaaagacguuuuaccugcgcaauaaccagcuugucgcuggauaucugcagggcccuaauguuaaccucgaggagaaaaucgauguggugccgauugaaccccacgcccuguuccuggggauccauggaggcaagaugugccucucuugugucaaaagcggggacgaaaccagacugcagcuugaggcggugaauaucacagaucuguccgagaaccggaagcaagacaagcgcuuugcuuucauuagaucugauagcggaccuaccacauccuuugaaagcgccgccugccccggcugguuccucuguaccgcuauggaggccgaccagccuguuucucugacaaauaugcccgaugaaggcgugauggucaccaaauuuuacuuccaggaggacgaguga

SEQ ID NO: 4352 - RNA, 534 nt, Artificial Sequence
  derived and/or modified sequence opt6 from IL-1ra_(antagonist)__Homo_sapiens__CCDS46396.1
auggaaauaugccgaggacuaagaucacacuuaauaacacuacuacuauuccuauuccacagcgaaacaauaugcagaccaucaggaagaaaaucaucaaaaaugcaagcauucagaauaugggacguaaaccaaaaaacauucuaccuaagaaacaaccaacuaguagcaggauaccuacaaggaccaaacguaaaccuagaagaaaaaauagacguaguaccaauagaaccacacgcacuauuccuaggaauacacggaggaaaaaugugccuaucaugcguaaaaucaggagacgaaacaagacuacaacuagaagcaguaaacauaacagaucuaucagaaaacagaaaacaagacaaaagauucgcauucauaagaucagacucaggaccaacaacaucauuugaaucagcagcaugcccaggaugguucuuaugcacagccauggaagcagaucaaccaguaucauuaacaaacaugccagacgaaggaguaaugguaacaaaauucuacuuccaagaagacgaauaa

SEQ ID NO: 4353 - protein, 176 aa, Artificial Sequence
  IL-20__Homo_sapiens__Q9NYY1
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 4354 - RNA, 531 nt, Artificial Sequence
  IL-20__Homo_sapiens__AAH69311
augaaagccucuagucuugccuucagccuucucucugcugcguuuuaucuccuauggacuccuuccacuggacugaagacacucaauuugggaagcugugugaucgccacaaaccuucaggaaauacgaaauggauuuucugagauacggggcagugugcaagccaaagauggaaacauugacaucagaaucuuaaggaggacugagucuuugcaagacacaaagccugcgaaucgaugcugccuccugcgccauuugcuaagacucuaucuggacaggguauuuaaaaacuaccagaccccugaccauuauacucuccggaagaucagcagccucgccaauuccuuucuuaccaucaagaaggaccuccggcucugucaugcccacaugacaugccauuguggggaggaagcaaugaagaaauacagccagauucugagucacuuugaaaagcuggaaccucaggcagcaguugugaaggcuuugggggaacuagacauucuucugcaauggauggaggagacagaauag

SEQ ID NO: 4355 - RNA, 531 nt, Artificial Sequence
  derived and/or modified sequence opt1 from IL-20__Homo_sapiens__AAH69311
augaaggccagcucccuggccuucagccuccuguccgcggccuucuaccugcucuggacccccagcaccggccugaagacgcugaaccucggguccugcgugaucgccaccaaccugcaggagauccgcaacggcuucagcgagauccggggguccguccaggccaaggacggcaacaucgacauccgcauccugcggcgcaccgagagccuccaggacaccaagccggccaaccggugcugccugcugcgccaccuccugcggcuguaccucgaccgcguguucaagaacuaccagacgcccgaccacuacacccugcggaagaucuccagccuggcgaacuccuuccucaccaucaagaaggaccugcgccugugccacgcccacaugaccugccacugcggggaggaggccaugaagaaguacagccagauccucucccacuucgagaagcuggagccccaggccgcgguggucaaggcccugggcgagcucgacauccugcugcaguggauggaggagacggaguga

SEQ ID NO: 4356 - RNA, 531 nt, Artificial Sequence
  derived and/or modified sequence opt2 from IL-20__Homo_sapiens__AAH69311
augaaggccuccucccucgccuucucccuccucuccgccgccuucuaccuccucuggacccccuccaccggccucaagacccucaaccucggcuccugcgucaucgccaccaaccuccaggagauccgcaacggcuucuccgagauccgcggcuccguccaggccaaggacggcaacaucgacauccgcauccuccgccgcaccgagucccuccaggacaccaagcccgccaaccgcugcugccuccuccgccaccuccuccgccucuaccucgaccgcgucuucaagaacuaccagacccccgaccacuacacccuccgcaagaucuccucccucgccaacuccuuccucaccaucaagaaggaccuccgccucugccacgcccacaugaccugccacugcggcgaggaggccaugaagaaguacucccagauccucucccacuucgagaagcucgagccccaggccgccgucgucaaggcccucggcgagcucgacauccuccuccaguggauggaggagaccgaguga

SEQ ID NO: 4357 - RNA, 531 nt, Artificial Sequence
  derived and/or modified sequence opt3 from IL-20__Homo_sapiens__AAH69311
augaaggccagcucccuggcuuucucucuccuuucagcagccuuuuaccuguuguggacccccaguacaggcuuaaaaacucugaaccuagggagcugcgugaucgcgacgaaucuccaggagauuagaaacggauucuccgaaauaagggguucuguccaagcuaaggacggcaauaucgauauucggauccugcgccgaaccgagucgcuucaggacacaaaaccugccaaccguuguugccuguugagacaccuccugaggcuguaucucgaucggguuuuuaagaauuaccagacuccagaccauuauaccuuacgcaaaauuucaagccuggcaaacaguuuccuuacaaucaagaaggauuugagacugugucacgcccauaugaccugccacuguggggaagaggcuaugaaaaaguacucccagauacuaucucauuuugaaaaacucgagccgcaagcagccgugguaaaggcucugggagagcuugacauccuguugcaguggauggaagagacugaauga

SEQ ID NO: 4358 - RNA, 531 nt, Artificial Sequence
  derived and/or modified sequence opt4 from IL-20__Homo_sapiens__AAH69311
augaaggccagcagccuggccuucagccugcugagcgccgccuucuaccugcuguggacccccagcaccggccugaagacccugaaccugggcagcugcgugaucgccaccaaccugcaggagaucagaaacggcuucagcgagaucagaggcagcgugcaggccaaggacggcaacaucgacaucagaauccugagaagaaccgagagccugcaggacaccaagcccgccaacagaugcugccugcugagacaccugcugagacuguaccuggacagaguguucaagaacuaccagacccccgaccacuacacccugagaaagaucagcagccuggccaacagcuuccugaccaucaagaaggaccugagacugugccacgcccacaugaccugccacugcggcgaggaggccaugaagaaguacagccagauccugagccacuucgagaagcuggagccccaggccgccguggugaaggcccugggcgagcuggacauccugcugcaguggauggaggagaccgaguga

SEQ ID NO: 4359 - RNA, 531 nt, Artificial Sequence
  derived and/or modified sequence opt5 from IL-20__Homo_sapiens__AAH69311
augaaggccagcucccuggcuuucucucuccugagcgccgcguuuuaccuucuguggacccccuccacaggccucaaaacgcugaaccuugggucuugcgugaucgcuaccaaucugcaggagauuagaaacggauucagcgaaauccggggcuccguccaagccaaggacgggaauauugauauccgcauucucagacggacagagucucugcaggacaccaaaccugccaaccgcuguugccugcucagacaucugcuucggcuguaucucgaucgcguuuuuaagaauuaccagacaccggaccacuauacccugagaaaaaucagcucccuugcuaacagcuuccugacaaucaagaaggaucuccggcugugucacgcccauaugaccugccacuguggagaagaggcuaugaaaaaguacucucagauucugucccauuuugaaaaacucgagccccaagccgcgguggugaaggcccugggcgagcuugacauccugcuccaguggauggaagagacggaauga

SEQ ID NO: 4360 - RNA, 531 nt, Artificial Sequence
  derived and/or modified sequence opt6 from IL-20__Homo_sapiens__AAH69311
augaaagcaucaucacuagcauucucauuauuaucagcagcauucuaccuacuauggacaccaucaacaggacuaaaaacacuaaacuuaggaucaugcguaauagcaacaaaccuacaagaaauaagaaacggauucucagaaauaagaggaucaguacaagcaaaagacggaaacauagacauaagaauacuaagaagaacagaaucacuacaagacacaaaaccagcaaacagaugcugccuacuaagacaccuacuaagacuauaucuagacagaguauucaaaaacuaccaaacaccagaccacuacacacuaagaaaaauauccucacuagcaaacucauuccuaacaauaaaaaaagaccuaagacuaugccacgcccacaugacaugccacugcggagaagaagcaaugaaaaaauacucacaaauacuaucacacuucgaaaaacuagaaccacaagccgcaguaguaaaagcacuaggagaacuagacauacuacuacaauggauggaagaaacagaauaa

SEQ ID NO: 4361 - protein, 153 aa, Artificial Sequence
  IL-21__Homo_sapiens__NP_001193935.1
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKVSTLSFI

SEQ ID NO: 4362 - RNA, 462 nt, Artificial Sequence
  IL-21__Homo_sapiens__CCDS75189.1
augagauccaguccuggcaacauggagaggauugucaucugucugauggucaucuucuuggggacacugguccacaaaucaagcucccaaggucaagaucgccacaugauuagaaugcgucaacuuauagauauuguugaucagcugaaaaauuaugugaaugacuuggucccugaauuucugccagcuccagaagauguagagacaaacugugaguggucagcuuuuuccugcuuucagaaggcccaacuaaagucagcaaauacaggaaacaaugaaaggauaaucaauguaucaauuaaaaagcugaagaggaaaccaccuuccacaaaugcagggagaagacagaaacacagacuaacaugcccuucaugugauucuuaugagaaaaaaccacccaaagaauuccuagaaagauucaaaucacuucuccaaaagguaucuaccuuaaguuucauuuga

SEQ ID NO: 4363 - RNA, 462 nt, Artificial Sequence
  derived and/or modified sequence opt1 from IL-21__Homo_sapiens__CCDS75189.1
augcgcagcucccccggcaacauggagcggaucgugaucugccugauggucaucuuccucgggacccuggugcacaagagcuccagccagggccaggaccgccacaugauccggaugcgccagcugaucgacaucguggaccagcucaagaacuacgucaacgaccuggugcccgaguuccugcccgcccccgaggacguggagaccaacugcgagugguccgccuucagcugcuuccagaaggcgcagcucaaguccgccaacacggggaacaacgagcggaucaucaacgucagcaucaagaagcugaagcgcaagcccccguccaccaacgccggccggcgccagaagcaccggcugaccugccccagcugcgacuccuacgagaagaagccgcccaaggaguuccucgagcgcuucaagagccugcugcagaagguguccacccucagcuucaucuga

SEQ ID NO: 4364 - RNA, 462 nt, Artificial Sequence
  derived and/or modified sequence opt2 from IL-21__Homo_sapiens__CCDS75189.1
augcgcuccucccccggcaacauggagcgcaucgucaucugccucauggucaucuuccucggcacccucguccacaaguccuccucccagggccaggaccgccacaugauccgcaugcgccagcucaucgacaucgucgaccagcucaagaacuacgucaacgaccucguccccgaguuccuccccgcccccgaggacgucgagaccaacugcgagugguccgccuucuccugcuuccagaaggcccagcucaaguccgccaacaccggcaacaacgagcgcaucaucaacgucuccaucaagaagcucaagcgcaagccccccuccaccaacgccggccgccgccagaagcaccgccucaccugccccuccugcgacuccuacgagaagaagccccccaaggaguuccucgagcgcuucaagucccuccuccagaaggucuccacccucuccuucaucuga

SEQ ID NO: 4365 - RNA, 462 nt, Artificial Sequence
  derived and/or modified sequence opt3 from IL-21__Homo_sapiens__CCDS75189.1
augagaagcucccccggcaacauggagaggaucgugauuugccugauggucauauuccucgggacccuuguucacaagucuucaagucagggacaagaccggcauaugauccgcaugcgacagcugauugauaucguggaccaguugaaaaauuacguaaacgauuuagugccugaauuucugccagccccggaggacgucgaaacaaauugugaguggagcgcuuucuccugcuuucagaaggcacaacuaaaaucugccaacacugguaauaacgaacguauuaucaaugugucgauaaagaaacucaagagaaagcccccuucaacgaacgcgggcaggcggcagaaacaccgccugaccuguccaagcugcgauaguuaugagaagaaacccccuaaggaguuccuugaaagauuuaaaucccuguugcagaagguuucuacacucagcuucaucuga

SEQ ID NO: 4366 - RNA, 462 nt, Artificial Sequence
  derived and/or modified sequence opt4 from IL-21__Homo_sapiens__CCDS75189.1
augagaagcagccccggcaacauggagagaaucgugaucugccugauggugaucuuccugggcacccuggugcacaagagcagcagccagggccaggacagacacaugaucagaaugagacagcugaucgacaucguggaccagcugaagaacuacgugaacgaccuggugcccgaguuccugcccgcccccgaggacguggagaccaacugcgaguggagcgccuucagcugcuuccagaaggcccagcugaagagcgccaacaccggcaacaacgagagaaucaucaacgugagcaucaagaagcugaagagaaagccccccagcaccaacgccggcagaagacagaagcacagacugaccugccccagcugcgacagcuacgagaagaagccccccaaggaguuccuggagagauucaagagccugcugcagaaggugagcacccugagcuucaucuga

SEQ ID NO: 4367 - RNA, 462 nt, Artificial Sequence
  derived and/or modified sequence opt5 from IL-21__Homo_sapiens__CCDS75189.1
augagaagcucccccggcaacauggagcggaucgugauuugccugauggucaucuuccucgggacccugguucacaagucuagcucccagggacaagaccgccauaugauuagaaugcggcagcuuaucgauauuguggaccagcugaaaaauuacgugaacgaucucgucccugaauuucugccggcccccgaggacguggaaacaaauugugaguggucugcuuucagcugcuuucagaaggcccaacuuaaauccgcgaacacgggcaauaacgaacgcaucaucaauguuucuauuaagaaacugaagagaaagccucccagcaccaacgcugggcggcgccagaaacacagacucacauguccuuccugcgauagcuaugagaagaaacccccuaaggaguuccuggaacgguuuaaaucucugcuccagaagguguccacccugagcuucaucuga

SEQ ID NO: 4368 - RNA, 462 nt, Artificial Sequence
  derived and/or modified sequence opt6 from IL-21__Homo_sapiens__CCDS75189.1
augagaucaagcccaggaaacauggaaagaauaguaauaugcuuaaugguaauauuccuaggaacacuaguacacaaaucaucaucacaaggacaagacagacacaugauaagaaugagacaacuaauagacauaguagaccaacuaaaaaacuacguaaacgaccuaguaccagaauuccuaccagcaccagaagacguagaaacaaacugcgaauggucagcauucucaugcuuccaaaaagcacaacuaaaaagcgcaaacacaggaaacaacgaaagaauaauaaacguaucaauaaaaaaacuaaaaagaaaaccaccaucaacaaacgcaggaagaagacaaaaacacagacuaacaugcccaagcugcgacucauacgaaaaaaaaccaccaaaagaauucuuagaaagauucaaaagccuacuacaaaaaguaagcacacuaucauucauauaa

SEQ ID NO: 4369 - protein, 162 aa, Artificial Sequence
  IL-21__Homo_sapiens__NP_068575.1
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 4370 - RNA, 489 nt, Artificial Sequence
  IL-21__Homo_sapiens__CCDS3727.1
augagauccaguccuggcaacauggagaggauugucaucugucugauggucaucuucuuggggacacugguccacaaaucaagcucccaaggucaagaucgccacaugauuagaaugcgucaacuuauagauauuguugaucagcugaaaaauuaugugaaugacuuggucccugaauuucugccagcuccagaagauguagagacaaacugugaguggucagcuuuuuccugcuuucagaaggcccaacuaaagucagcaaauacaggaaacaaugaaaggauaaucaauguaucaauuaaaaagcugaagaggaaaccaccuuccacaaaugcagggagaagacagaaacacagacuaacaugcccuucaugugauucuuaugagaaaaaaccacccaaagaauuccuagaaagauucaaaucacuucuccaaaagaugauucaucagcaucuguccucuagaacacacggaagugaagauuccuga

SEQ ID NO: 4371 - RNA, 489 nt, Artificial Sequence
  derived and/or modified sequence opt1 from IL-21__Homo_sapiens__CCDS3727.1
augcgcagcucccccggcaacauggagcggaucgugaucugccugauggucaucuuccucgggacccuggugcacaagagcuccagccagggccaggaccgccacaugauccggaugcgccagcugaucgacaucguggaccagcucaagaacuacgucaacgaccuggugcccgaguuccugcccgcccccgaggacguggagaccaacugcgagugguccgccuucagcugcuuccagaaggcgcagcucaaguccgccaacacggggaacaacgagcggaucaucaacgucagcaucaagaagcugaagcgcaagcccccguccaccaacgccggccggcgccagaagcaccggcugaccugccccagcugcgacuccuacgagaagaagccgcccaaggaguuccucgagcgcuucaagagccugcugcagaagaugauccaccagcaccucuccagccggacccacggguccgaggacagcuga

SEQ ID NO: 4372 - RNA, 489 nt, Artificial Sequence
  derived and/or modified sequence opt2 from IL-21__Homo_sapiens__CCDS3727.1
augcgcuccucccccggcaacauggagcgcaucgucaucugccucauggucaucuuccucggcacccucguccacaaguccuccucccagggccaggaccgccacaugauccgcaugcgccagcucaucgacaucgucgaccagcucaagaacuacgucaacgaccucguccccgaguuccuccccgcccccgaggacgucgagaccaacugcgagugguccgccuucuccugcuuccagaaggcccagcucaaguccgccaacaccggcaacaacgagcgcaucaucaacgucuccaucaagaagcucaagcgcaagccccccuccaccaacgccggccgccgccagaagcaccgccucaccugccccuccugcgacuccuacgagaagaagccccccaaggaguuccucgagcgcuucaagucccuccuccagaagaugauccaccagcaccucuccucccgcacccacggcuccgaggacuccuga

SEQ ID NO: 4373 - RNA, 489 nt, Artificial Sequence
  derived and/or modified sequence opt3 from IL-21__Homo_sapiens__CCDS3727.1
augagaagcucccccggcaacauggagaggaucgugauuugccugauggucauauuccucgggacccuuguucacaagucuucaagucagggacaagaccggcauaugauccgcaugcgacagcugauugauaucguggaccaguugaaaaauuacguaaacgauuuagugccugaauuucugccagccccggaggacgucgaaacaaauugugaguggagcgcuuucuccugcuuucagaaggcacaacuaaaaucugccaacacugguaauaacgaacguauuaucaaugugucgauaaagaaacucaagagaaagcccccuucaacgaacgcgggcaggcggcagaaacaccgccugaccuguccaagcugcgauaguuaugagaagaaacccccuaaggaguuccuugaaagauuuaaaucccuguugcagaagaugauccaucagcaccucucuagcaggacacauggguccgaggacucauga

SEQ ID NO: 4374 - RNA, 489 nt, Artificial Sequence
  derived and/or modified sequence opt4 from IL-21__Homo_sapiens__CCDS3727.1
augagaagcagccccggcaacauggagagaaucgugaucugccugauggugaucuuccugggcacccuggugcacaagagcagcagccagggccaggacagacacaugaucagaaugagacagcugaucgacaucguggaccagcugaagaacuacgugaacgaccuggugcccgaguuccugcccgcccccgaggacguggagaccaacugcgaguggagcgccuucagcugcuuccagaaggcccagcugaagagcgccaacaccggcaacaacgagagaaucaucaacgugagcaucaagaagcugaagagaaagccccccagcaccaacgccggcagaagacagaagcacagacugaccugccccagcugcgacagcuacgagaagaagccccccaaggaguuccuggagagauucaagagccugcugcagaagaugauccaccagcaccugagcagcagaacccacggcagcgaggacagcuga

SEQ ID NO: 4375 - RNA, 489 nt, Artificial Sequence
  derived and/or modified sequence opt5 from IL-21__Homo_sapiens__CCDS3727.1
augagaagcucccccggcaacauggagcggaucgugauuugccugauggucaucuuccucgggacccugguucacaagucuagcucccagggacaagaccgccauaugauuagaaugcggcagcuuaucgauauuguggaccagcugaaaaauuacgugaacgaucucgucccugaauuucugccggcccccgaggacguggaaacaaauugugaguggucugcuuucagcugcuuucagaaggcccaacuuaaauccgcgaacacgggcaauaacgaacgcaucaucaauguuucuauuaagaaacugaagagaaagccucccagcaccaacgcugggcggcgccagaaacacagacucacauguccuuccugcgauagcuaugagaagaaacccccuaaggaguuccuggaacgguuuaaaucucugcuccagaagaugauccaucagcaccuguccagccgcacccauggaucugaggacuccuga

SEQ ID NO: 4376 - RNA, 489 nt, Artificial Sequence
  derived and/or modified sequence opt6 from IL-21__Homo_sapiens__CCDS3727.1
augagaucaucaccaggaaacauggaaagaauaguaauaugccuaaugguaauauuccucggaacacuaguacacaaaucaucaucacaaggacaagacagacacaugauaagaaugagacaacuaauagacauaguagaccaacuaaaaaacuacguaaacgaccuaguaccagaauuccuaccagcaccagaagacguagaaacaaacugcgaauggucagcauucucaugcuuccaaaaagcacaacuaaaaucagcaaacacaggaaacaacgaaagaauaauaaacguaucaauaaaaaaauuaaaaagaaaaccaccaucaacaaacgcaggacgaagacaaaaacacagacucacaugcccaucaugcgacucauacgaaaaaaaaccaccaaaagaauuccuagaaagauucaaaucacuacuacaaaaaaugauacaccaacaccuaucaucaagaacacacggaucagaagacagcuaa

SEQ ID NO: 4377 - protein, 179 aa, Artificial Sequence
  IL-22__Homo_sapiens__Q9GZX6
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 4378 - RNA, 540 nt, Artificial Sequence
  IL-22__Homo_sapiens__AAG22064
auggccgcccugcagaaaucugugagcucuuuccuuauggggacccuggccaccagcugccuccuucucuuggcccucuugguacagggaggagcagcugcgcccaucagcucccacugcaggcuugacaaguccaacuuccagcagcccuauaucaccaaccgcaccuucaugcuggcuaaggaggcuagcuuggcugauaacaacacagacguucgucucauuggggagaaacuguuccacggagucaguaugagugagcgcugcuaucugaugaagcaggugcugaacuucacccuugaagaagugcuguucccucaaucugauagguuccagccuuauaugcaggagguggugcccuuccuggccaggcucagcaacaggcuaagcacaugucauauugaaggugaugaccugcauauccagaggaaugugcaaaagcugaaggacacagugaaaaagcuuggagagaguggagagaucaaagcaauuggagaacuggauuugcuguuuaugucucugagaaaugccugcauuuga

SEQ ID NO: 4379 - RNA, 540 nt, Artificial Sequence
  derived and/or modified sequence opt1 from IL-22__Homo_sapiens__AAG22064
auggccgcccugcagaaguccgugagcagcuuccucaugggcacccuggcgaccuccugccugcuccugcuggcccuccugguccagggcggggccgccgcccccaucagcucccacugccgccuggacaagagcaacuuccagcagccguacaucacgaaccggaccuucaugcucgcgaaggaggccucccuggccgacaacaacaccgacgugcgccugaucggggagaagcuguuccacggcgugagcauguccgagcggugcuaccucaugaagcagguccugaacuucacccucgaggaggugcuguucccccagagcgaccgcuuccagcccuacaugcaggaggugguccccuuccuggcccggcucuccaaccgccugagcacgugccacaucgagggggacgaccugcacauccagcggaacgugcagaagcucaaggacaccgugaagaagcugggcgaguccggcgagaucaaggcgaucggggagcuggaccuccuguucaugagccugcgcaacgccugcaucuga

SEQ ID NO: 4380 - RNA, 540 nt, Artificial Sequence
  derived and/or modified sequence opt2 from IL-22__Homo_sapiens__AAG22064
auggccgcccuccagaaguccgucuccuccuuccucaugggcacccucgccaccuccugccuccuccuccucgcccuccucguccagggcggcgccgccgcccccaucuccucccacugccgccucgacaaguccaacuuccagcagcccuacaucaccaaccgcaccuucaugcucgccaaggaggccucccucgccgacaacaacaccgacguccgccucaucggcgagaagcucuuccacggcgucuccauguccgagcgcugcuaccucaugaagcagguccucaacuucacccucgaggagguccucuucccccaguccgaccgcuuccagcccuacaugcaggaggucguccccuuccucgcccgccucuccaaccgccucuccaccugccacaucgagggcgacgaccuccacauccagcgcaacguccagaagcucaaggacaccgucaagaagcucggcgaguccggcgagaucaaggccaucggcgagcucgaccuccucuucaugucccuccgcaacgccugcaucuga

SEQ ID NO: 4381 - RNA, 540 nt, Artificial Sequence
  derived and/or modified sequence opt3 from IL-22__Homo_sapiens__AAG22064
auggccgcucugcagaaaagcguguccucuuuccucaugggcacccuugcaacaucaugccuguuguuacuggcccuacucguccaagggggagcggcugcccccaucaguagccacuguagacuggacaaguccaacuuucagcagccuuacauuacuaauaggacguucaugcuugcaaaggaggccucucuggcugauaacaauaccgacguucgguugauaggugaaaaacucuuucauggcgugucgaugucagagcgcugcuaucugaugaagcagguacugaacuucacacucgaagagguguuauuuccacaaagcgaucgauuccagccguacaugcaggaagucgugcccuuucuggcacgucuuaguaauagauuguccacuugucacaucgagggggacgaucugcauauucagaggaacguucaaaaacuaaaggacaccgugaagaaacucggagagucuggcgaaaucaaggccauuggugagcuggaucuucuguucaugagcuugcggaaugcuugcaucuga

SEQ ID NO: 4382 - RNA, 540 nt, Artificial Sequence
  derived and/or modified sequence opt4 from IL-22__Homo_sapiens__AAG22064
auggccgcccugcagaagagcgugagcagcuuccugaugggcacccuggccaccagcugccugcugcugcuggcccugcuggugcagggcggcgccgccgcccccaucagcagccacugcagacuggacaagagcaacuuccagcagcccuacaucaccaacagaaccuucaugcuggccaaggaggccagccuggccgacaacaacaccgacgugagacugaucggcgagaagcuguuccacggcgugagcaugagcgagagaugcuaccugaugaagcaggugcugaacuucacccuggaggaggugcuguucccccagagcgacagauuccagcccuacaugcaggagguggugcccuuccuggccagacugagcaacagacugagcaccugccacaucgagggcgacgaccugcacauccagagaaacgugcagaagcugaaggacaccgugaagaagcugggcgagagcggcgagaucaaggccaucggcgagcuggaccugcuguucaugagccugagaaacgccugcaucuga

SEQ ID NO: 4383 - RNA, 540 nt, Artificial Sequence
  derived and/or modified sequence opt5 from IL-22__Homo_sapiens__AAG22064
auggccgcucugcagaaaagcguguccucuuuccucaugggcacccuggccacaagcugccuucugcuccuggcgcuucugguccaagggggagcugccgcccccaucuccucucacuguagacucgacaagagcaacuuucagcagccuuacauuacgaaucggaccuucaugcuggcuaaggaggccucccuggcugauaacaauacagacguucgccucaucggcgaaaaacuguuucauggggugucuaugagcgagagaugcuaucuuaugaaacaggugcugaacuucacccucgaagagguccuguuuccgcaauccgaucgguuccagcccuacaugcaggaagugguuccuuuucuugcccgccugagcaauagacucucuacaugucacauugagggagacgaucugcauauccagcggaacgugcaaaagcugaaggacaccgucaagaaacucggcgaguccggggaaauuaaggcgaucggagagcuggaucuucuguucaugagccuccgcaaugccugcaucuga

SEQ ID NO: 4384 - RNA, 540 nt, Artificial Sequence
  derived and/or modified sequence opt6 from IL-22__Homo_sapiens__AAG22064
auggcagcacuacaaaaaucaguaucaucauuccuaaugggaacacuagcaacaucaugccuacuacuacuagcacuacuaguacaaggaggagcagcagcaccaauaucaucacacugcagauuagacaaaucaaacuuccaacaaccauacauaacaaacagaacauucaugcuagcaaaagaagcaucacuagcagacaacaacacagacguaagauuaauaggagaaaaacuuuuccacggaguaucaaugucagaaagaugcuaccuaaugaaacaaguacuaaacuucacauuagaagaaguacuauucccacaaagcgacagauuccaaccauacaugcaagaaguaguaccauuccuagcaagacuaucaaacagacuauccacaugccacauagaaggagacgaccuacacauacaaagaaacguacaaaaacuaaaagacacaguaaaaaaacuaggagaaucaggagaaauaaaagcaauaggagaacuagaccuacuauucaugucacuaagaaacgcaugcauauaa

SEQ ID NO: 4385 - protein, 189 aa, Artificial Sequence
  IL-23__Homo_sapiens__Q9NPF7
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 4386 - RNA, 570 nt, Artificial Sequence
  IL-23__Homo_sapiens__AAH66268
augcuggggagcagagcuguaaugcugcuguugcuacugcccuggacagcucagggcagagcugugccugggggcagcagcccugccuggacucagugccagcagcuuucacagaagcucugcacacuggccuggagugcacauccacuagugggacacauggaucuaagagaagagggagaugaagagacuacaaaugauguuccccauauccaguguggagauggcugugacccccaaggacucagggacaacagucaguucugcuugcaaaggauccaccagggucugauuuuuuaugagaagcugcuaggaucggauauuuucacaggggagccuucucugcucccugauagcccugugggccagcuucaugccucccuacugggccucagccaacuccugcagccugagggucaccacugggagacucagcagauuccaagccucagucccagccagccauggcagcgucuccuucuccgcuucaagauccuucgcagccuccaggccuuuguggccguagccgcccgggucuuugcccauggagcagcaacccugagucccuaa

SEQ ID NO: 4387 - RNA, 570 nt, Artificial Sequence
  derived and/or modified sequence opt1 from IL-23__Homo_sapiens__AAH66268
augcugggcagccgcgccgugaugcuccugcugcuccugcccuggaccgcccaggggcgggcggucccgggcggguccagccccgccuggacccagugccagcagcugucccagaagcucugcacgcuggccuggagcgcccacccccuggugggccacauggaccuccgcgaggagggggacgaggagaccaccaacgacgugccccacauccagugcggcgacggcugcgacccgcaggggcugcgggacaacucccaguucugccugcagcgcauccaccagggccucaucuucuacgagaagcugcuggggagcgacaucuucaccggcgagcccucccuccugcccgacagccccgucgggcagcugcacgccucccuccugggccugagccagcuccugcagccggagggccaccacugggagacgcagcagauccccucccugagccccucccagcccuggcagcggcuccugcugcgcuucaagauccuccggagccugcaggcguucguggccguggccgcccgcgucuucgcgcacggggccgccacccuguccccguga

SEQ ID NO: 4388 - RNA, 570 nt, Artificial Sequence
  derived and/or modified sequence opt2 from IL-23__Homo_sapiens__AAH66268
augcucggcucccgcgccgucaugcuccuccuccuccuccccuggaccgcccagggccgcgccguccccggcggcuccucccccgccuggacccagugccagcagcucucccagaagcucugcacccucgccugguccgcccacccccucgucggccacauggaccuccgcgaggagggcgacgaggagaccaccaacgacgucccccacauccagugcggcgacggcugcgacccccagggccuccgcgacaacucccaguucugccuccagcgcauccaccagggccucaucuucuacgagaagcuccucggcuccgacaucuucaccggcgagcccucccuccuccccgacucccccgucggccagcuccacgccucccuccucggccucucccagcuccuccagcccgagggccaccacugggagacccagcagauccccucccucucccccucccagcccuggcagcgccuccuccuccgcuucaagauccuccgcucccuccaggccuucgucgccgucgccgcccgcgucuucgcccacggcgccgccacccucucccccuga

SEQ ID NO: 4389 - RNA, 570 nt, Artificial Sequence
  derived and/or modified sequence opt3 from IL-23__Homo_sapiens__AAH66268
augcugggcagcagagccgugaugcuccuucuguuguuacccuggaccgcucaggggagggcagucccuggagguuccucuccagccuggacacaaugccagcagcugucacagaagcuauguacucucgcguggagugcucacccgcugguuggccauauggaccuucgggaggaaggggaugaggaaacgaccaacgacgugccccacauccaaugcggagauggcugugacccucagggucugcgcgauaauagccaguucugcuugcagcguauucaucaagggcucauauuuuacgagaaacugcugggauccgacaucuucacaggcgaaccaucucucuuacccgauucgccuguaggccagcugcacgccucacuuuuggggcugagccagcuacuccagccagagggacaucacugggagacucaacagauucccagucuguccccuucucagccauggcaacgacuucuguugagauuuaagauccucaggagccugcaggcauucguggccgucgcugcacggguguuugcccacggugcugccaccuuauccccguga

SEQ ID NO: 4390 - RNA, 570 nt, Artificial Sequence
  derived and/or modified sequence opt4 from IL-23__Homo_sapiens__AAH66268
augcugggcagcagagccgugaugcugcugcugcugcugcccuggaccgcccagggcagagccgugcccggcggcagcagccccgccuggacccagugccagcagcugagccagaagcugugcacccuggccuggagcgcccacccccuggugggccacauggaccugagagaggagggcgacgaggagaccaccaacgacgugccccacauccagugcggcgacggcugcgacccccagggccugagagacaacagccaguucugccugcagagaauccaccagggccugaucuucuacgagaagcugcugggcagcgacaucuucaccggcgagcccagccugcugcccgacagccccgugggccagcugcacgccagccugcugggccugagccagcugcugcagcccgagggccaccacugggagacccagcagauccccagccugagccccagccagcccuggcagagacugcugcugagauucaagauccugagaagccugcaggccuucguggccguggccgccagaguguucgcccacggcgccgccacccugagccccuga

SEQ ID NO: 4391 - RNA, 570 nt, Artificial Sequence
  derived and/or modified sequence opt5 from IL-23__Homo_sapiens__AAH66268
augcugggcagcagagccgugaugcuccugcuucugcuccccuggaccgcucaggggcgggccgucccuggaggcuccucuccggcguggacacaaugccagcagcugagccagaagcuguguacgcuugcuugguccgcccacccccucguugggcauauggaccugcgcgaggaaggagaugaggaaaccacaaacgacgugccucacauccaaugcggcgaugggugugacccccagggacugagagauaauucucaguucugccuccagcggauucaucaaggccugaucuuuuacgagaaacuucugggcagcgacauuuucaccggggaaccuucccuccugcccgauucuccugugggacagcuucacgccagccugcucggccugucccagcugcuccagccggaggggcaucacugggagacacaacagauccccagccugucuccuucccagcccuggcaacgccuucugcucagauuuaagauucugcggagccuucaggcuuucgucgccguggcugcccgcguuuuugcgcacggagccgcuacccugucuccuuga

SEQ ID NO: 4392 - RNA, 570 nt, Artificial Sequence
  derived and/or modified sequence opt6 from IL-23__Homo_sapiens__AAH66268
augcuaggaucaagagcaguaaugcuacuauuauuacuaccauggacagcucaaggaagagcaguaccaggaggaucaucaccagcauggacacaaugccaacaacuaucacaaaaauuauguacacuagcauggucagcacacccacuaguaggacacauggacuuaagagaagaaggagacgaagaaacaacaaacgacguaccacacauacaaugcggagacggaugcgacccacaaggacuaagagacaacucacaauucugucuacaaagaauacaccaaggccuaauauucuacgaaaaacuauuaggaucagacauauucacaggagaaccaucacuauuacccgacucaccaguaggacaauuacacgcaucacuuuuaggacuaucacaacuacuacaaccagaaggacaucacugggaaacccaacaaaucccaucauuaucacccucacaaccauggcaaagacuacuacuaagauuuaaaauacuaagaucacuacaagcauucguagcaguagcagcaagaguauucgcacacggagcagcaacacuaucaccauaa

SEQ ID NO: 4393 - protein, 206 aa, Artificial Sequence
  IL-24__Homo_sapiens__Q13007
MNFQQRLQSLWTLARPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 4394 - RNA, 621 nt, Artificial Sequence
  IL-24__Homo_sapiens__AAA91780
augaauuuucaacagaggcugcaaagccuguggacuuuagccagacccuucugcccuccuuugcuggcgacagccucucaaaugcagaugguugugcucccuugccuggguuuuacccugcuucucuggagccagguaucaggggcccagggccaagaauuccacuuugggcccugccaagugaaggggguuguuccccagaaacugugggaagccuucugggcugugaaagacacuaugcaagcucaggauaacaucacgagugcccggcugcugcagcaggagguucugcagaacgucucggaugcugagagcuguuaccuuguccacacccugcuggaguucuacuugaaaacuguuuucaaaaacuaccacaauagaacaguugaagucaggacucugaagucauucucuacucuggccaacaacuuuguucucaucgugucacaacugcaacccagucaagaaaaugagauguuuuccaucagagacagugcacacaggcgguuucugcuauuccggagagcauucaaacaguuggacguagaagcagcucugaccaaagcccuuggggaaguggacauucuucugaccuggaugcagaaauucuacaagcucuga

SEQ ID NO: 4395 - RNA, 621 nt, Artificial Sequence
  derived and/or modified sequence opt1 from IL-24__Homo_sapiens__AAA91780
augaacuuccagcagcgccugcagagccucuggacccuggcccggcccuucugcccgccccugcucgccaccgcgucccagaugcagauggugguccugcccugccugggcuucacgcuccugcuguggagccagguguccggggcccagggccaggaguuccacuucgggcccugccaggugaagggcgucgugccgcagaagcucugggaggccuucugggccgugaaggacaccaugcaggcccaggacaacaucaccagcgcgcgccugcugcagcaggagguccuccagaacguguccgacgccgagagcugcuaccuggugcacacccugcucgaguucuaccugaagacggucuucaagaacuaccacaaccggaccguggaggugcgcacccugaaguccuucagcacccucgccaacaacuucguccugaucgugucccagcugcagcccagccaggagaacgagauguucuccauccgggacagcgcccaccgccgguuccuccuguuccgccgggcguucaagcagcuggacguggaggccgcccucacgaaggcccugggggaggucgacauccugcucaccuggaugcagaaguucuacaagcuguga

SEQ ID NO: 4396 - RNA, 621 nt, Artificial Sequence
  derived and/or modified sequence opt2 from IL-24__Homo_sapiens__AAA91780
augaacuuccagcagcgccuccagucccucuggacccucgcccgccccuucugccccccccuccucgccaccgccucccagaugcagauggucguccuccccugccucggcuucacccuccuccucuggucccaggucuccggcgcccagggccaggaguuccacuucggccccugccaggucaagggcgucgucccccagaagcucugggaggccuucugggccgucaaggacaccaugcaggcccaggacaacaucaccuccgcccgccuccuccagcaggagguccuccagaacgucuccgacgccgaguccugcuaccucguccacacccuccucgaguucuaccucaagaccgucuucaagaacuaccacaaccgcaccgucgagguccgcacccucaaguccuucuccacccucgccaacaacuucguccucaucgucucccagcuccagcccucccaggagaacgagauguucuccauccgcgacuccgcccaccgccgcuuccuccucuuccgccgcgccuucaagcagcucgacgucgaggccgcccucaccaaggcccucggcgaggucgacauccuccucaccuggaugcagaaguucuacaagcucuga

SEQ ID NO: 4397 - RNA, 621 nt, Artificial Sequence
  derived and/or modified sequence opt3 from IL-24__Homo_sapiens__AAA91780
augaacuuccagcaaagacugcagagccucuggacccuugccaggcccuuuugcccuccacuguuggcuacagcaucccagaugcagaugguggucuuaccgugucugggcuucacucuacuccuguggucucaaguuucaggggcccagggacaggaguuucacuucggucccugccaggugaagggcguagugccucaaaaacuuugggaagcguuuugggcugucaaggacacgaugcaggcccaggauaauaucaccagugcacggcuguugcagcaagaggugcuccagaacguuagcgacgccgaauccuguuaccuggugcauacacugcucgaguucuauuuaaaaacugucuuuaagaauuaccacaaccgcaccguggaaguacgaacacugaaaucuuucucgacccuugcuaauaacuuuguuuugauugugucacagcugcaaccaagccaggagaaugagauguucaguauacgugauuccgcacauagaagguuucuacucuuccggcgcgccuuuaagcagcuggacgucgaagcugcccuuacuaaggcgcugggggagguggauaucuugcucacauggaugcagaaauucuauaagcuguga

SEQ ID NO: 4398 - RNA, 621 nt, Artificial Sequence
  derived and/or modified sequence opt4 from IL-24__Homo_sapiens__AAA91780
augaacuuccagcagagacugcagagccuguggacccuggccagacccuucugccccccccugcuggccaccgccagccagaugcagaugguggugcugcccugccugggcuucacccugcugcuguggagccaggugagcggcgcccagggccaggaguuccacuucggccccugccaggugaagggcguggugccccagaagcugugggaggccuucugggccgugaaggacaccaugcaggcccaggacaacaucaccagcgccagacugcugcagcaggaggugcugcagaacgugagcgacgccgagagcugcuaccuggugcacacccugcuggaguucuaccugaagaccguguucaagaacuaccacaacagaaccguggaggugagaacccugaagagcuucagcacccuggccaacaacuucgugcugaucgugagccagcugcagcccagccaggagaacgagauguucagcaucagagacagcgcccacagaagauuccugcuguucagaagagccuucaagcagcuggacguggaggccgcccugaccaaggcccugggcgagguggacauccugcugaccuggaugcagaaguucuacaagcuguga

SEQ ID NO: 4399 - RNA, 621 nt, Artificial Sequence
  derived and/or modified sequence opt5 from IL-24__Homo_sapiens__AAA91780
augaacuuccagcaaagacugcagagccucuggacccuggcccggcccuuuugcccuccgcuucuggcuacagccucccagaugcagauggugguccuccccugucugggcuucacgcuucugcucuggucucaaguuagcggggcgcagggacaggaguuucacuucggcccuugccaggugaaggggguggucccccaaaaacugugggaggcuuuuugggccgugaaggacaccaugcaggcccaggauaauaucacauccgcucgccugcuccagcaagaaguucugcagaacgugucugacgccgaaagcuguuaccuuguccauacccugcucgaguucuaucugaaaacaguguuuaagaauuaccacaacagaaccguugaagugcggacacuuaaauccuucucuacccuggcuaauaacuuuguccucauugugagccagcugcaaccuucccaggagaaugagauguucagcauccgcgauucugcccauagacgguuucuucucuuccgcagagcguuuaagcagcuggacguggaagccgcucuuacgaaggcccugggagaggucgauauucuccugaccuggaugcagaaauucuauaagcuguga

SEQ ID NO: 4400 - RNA, 621 nt, Artificial Sequence
  derived and/or modified sequence opt6 from IL-24__Homo_sapiens__AAA91780
augaacuuccaacaaagacuacaaucacuauggacauuagcaagaccauucugcccaccacuacuagcaacagcaucacaaaugcaaaugguaguacucccaugccuaggauucacauuacuauuauggucacaaguauccggagcccaaggacaagaauuccacuucggaccaugccaaguaaaaggaguaguaccacaaaaacuaugggaagcauucugggcaguaaaagauacaaugcaagcacaagacaacauaacaucagccagacuacuacaacaagaaguacuacaaaacguaucagacgcagaaucaugcuaccuaguacacacacuccuagaauucuaccuaaaaacaguauucaaaaacuaucacaacagaacaguagaaguaagaacacuaaaaucauucucaacacuagcaaacaacuucguauuaauaguuucacaacuacaaccaucccaagaaaacgaaauguucucaauaagagauuccgcacacagaagauuccuacuauucagaagagcauucaaacaacuagacgucgaagcagcacuaacaaaagcacuaggagaaguagacauacuacuaacauggaugcaaaaauucuacaaauuauaa

SEQ ID NO: 4401 - protein, 51 aa, Artificial Sequence [sequence omitted]

SEQ ID NO: 4402 - RNA, 156 nt, Artificial Sequence
  IL-24__Homo_sapiens__AAV52800
augaauuuucaacagaggcugcaaagccuguggacuuuagccagcaagcucaggauaacaucacgagugcccggcugcugcaacaggagguucugcagaacgucucggaugcugagggcuguuaccuuguccacacccugcuggaguucuacuuga

SEQ ID NO: 4403 - RNA, 156 nt, Artificial Sequence
  derived and/or modified sequence opt1 from IL-24__Homo_sapiens__AAV52800
augaacuuccagcagcgccugcagagccucuggacccuggccuccaagcugcggaucaccagccgcgugcccggcugcugcaaccggcgcuucugccggacgucccgcaugcuccgggccgucacccugagcaccccgugcugguccagcaccuga

SEQ ID NO: 4404 - RNA, 156 nt, Artificial Sequence
  derived and/or modified sequence opt2 from IL-24__Homo_sapiens__AAV52800
augaacuuccagcagcgccuccagucccucuggacccucgccuccaagcuccgcaucaccucccgcguccccggcugcugcaaccgccgcuucugccgcaccucccgcaugcuccgcgccgucacccucuccacccccugcugguccuccaccuga

SEQ ID NO: 4405 - RNA, 156 nt, Artificial Sequence
  derived and/or modified sequence opt3 from IL-24__Homo_sapiens__AAV52800
augaacuuccagcaaagacugcagagccucuggacccuugccuccaagcugaggaucacaucucgggugcccggcugcuguaaucgccgauuuugccguacuucaagaauguugagggcugucacguuaaguaccccuuguuggagcuccacauga

SEQ ID NO: 4406 - RNA, 156 nt, Artificial Sequence
  derived and/or modified sequence opt4 from IL-24__Homo_sapiens__AAV52800
augaacuuccagcagagacugcagagccuguggacccuggccagcaagcugagaaucaccagcagagugcccggcugcugcaacagaagauucugcagaaccagcagaaugcugagagccgugacccugagcacccccugcuggagcagcaccuga

SEQ ID NO: 4407 - RNA, 156 nt, Artificial Sequence
  derived and/or modified sequence opt5 from IL-24__Homo_sapiens__AAV52800
augaacuuccagcaaagacugcagagccucuggacccuggccuccaagcugcggaucacaucucgcgugcccggcugcuguaauagacgguuuugccgcacgagcagaaugcuucgggcugucacccucuccacaccuuguuggucuagcaccuga

SEQ ID NO: 4408 - RNA, 156 nt, Artificial Sequence
  derived and/or modified sequence opt6 from IL-24__Homo_sapiens__AAV52800
augaacuuucaacaaagacuacaaucacuauggacauuagcaucaaaauuaagaauaacaucaagaguaccaggaugcuguaacagaagauucugcagaacaucaagaaugcuaagagcaguaacauuaagcacaccaugcuggucaagcacauaa

SEQ ID NO: 4409 - protein, 173 aa, Artificial Sequence
  IL-25__Homo_sapiens__Q969H8
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAVAHRPGAFKAELSKLVIVAKASRTEL

SEQ ID NO: 4410 - RNA, 522 nt, Artificial Sequence
  IL-25__Homo_sapiens__AAH10129
auggcggcgcccagcggaggguggaacggcgucggcgcgagcuugugggccgcgcugcuccuaggggccguggcgcugaggccggcggaggcgguguccgagcccacgacgguggcguuugacgugcggcccggcggcgucgugcauuccuucucccauaacgugggcccgggggacaaauauacguguauguucacuuacgccucucaaggagggaccaaugagcaauggcagaugagucuggggaccagcgaagaccaccagcacuucaccugcaccaucuggaggccccaggggaaguccuaucuguacuucacacaguucaaggcagaggugcggggcgcugagauugaguacgccauggccuacucuaaagccgcauuugaaagggaaagugaugucccucugaaaacugaggaauuugaagugaccaaaacagcaguggcucacaggcccggggcauucaaagcugagcuguccaagcuggugauuguggccaaggcaucgcgcacugagcuguga

SEQ ID NO: 4411 - RNA, 522 nt, Artificial Sequence
  derived and/or modified sequence opt1 from IL-25__Homo_sapiens__AAH10129
auggccgcccccagcggcggguggaacggcgugggggcgucccugugggccgcccuccugcugggcgccgucgcccuccgcccggcggaggccgugagcgagcccaccaccguggccuucgacguccggcccgggggcguggugcacuccuucagccacaacgucggccccggggacaaguacacgugcauguucaccuacgccucccagggcgggaccaacgagcaguggcagaugagccugggcaccuccgaggaccaccagcacuucacgugcaccaucuggcgcccgcaggggaaguccuaccuguacuucacccaguucaaggcggaggugcggggcgccgagaucgaguacgccauggccuacagcaaggccgcguucgagcgcgagagcgacgugccccucaagaccgaggaguucgaggucacgaagaccgccguggcccaccggcccggcgccuucaaggccgagcuguccaagcuggugaucgucgcgaaggccagccgcaccgagcucuga

SEQ ID NO: 4412 - RNA, 522 nt, Artificial Sequence
  derived and/or modified sequence opt2 from IL-25__Homo_sapiens__AAH10129
auggccgcccccuccggcggcuggaacggcgucggcgccucccucugggccgcccuccuccucggcgccgucgcccuccgccccgccgaggccgucuccgagcccaccaccgucgccuucgacguccgccccggcggcgucguccacuccuucucccacaacgucggccccggcgacaaguacaccugcauguucaccuacgccucccagggcggcaccaacgagcaguggcagaugucccucggcaccuccgaggaccaccagcacuucaccugcaccaucuggcgcccccagggcaaguccuaccucuacuucacccaguucaaggccgagguccgcggcgccgagaucgaguacgccauggccuacuccaaggccgccuucgagcgcgaguccgacgucccccucaagaccgaggaguucgaggucaccaagaccgccgucgcccaccgccccggcgccuucaaggccgagcucuccaagcucgucaucgucgccaaggccucccgcaccgagcucuga

SEQ ID NO: 4413 - RNA, 522 nt, Artificial Sequence
  derived and/or modified sequence opt3 from IL-25__Homo_sapiens__AAH10129
auggccgcucccagcggcggguggaacggagugggugcaucccugugggccgcgcuccuucugggcgcugucgccuugagaccugcagaggccguuucugaaccaaccacaguggcuuucgacguaaggcccgggggagugguccacucauuuagucauaaugugggcccgggugauaaguacacuugcauguucacguaugcaagccaagggggaaccaacgagcaguggcagauguccuuaggcacaucugaagaccaccagcauuuuacuuguaccaucuggcggccucagggcaaaucguaccuguauuucacacaauuuaaggccgagguucgcggggcugaaauugaguacgccauggcguauucaaaagcagccuucgagcgagaaagcgaugugccacuaaagaccgaggaauuugaggucacuaaaacagcuguggcccaccgucccggagcauucaaggcugagcucaguaagcugguaauaguugccaaagcguccagaaccgaacuuuga

SEQ ID NO: 4414 - RNA, 522 nt, Artificial Sequence
  derived and/or modified sequence opt4 from IL-25__Homo_sapiens__AAH10129
auggccgcccccagcggcggcuggaacggcgugggcgccagccugugggccgcccugcugcugggcgccguggcccugagacccgccgaggccgugagcgagcccaccaccguggccuucgacgugagacccggcggcguggugcacagcuucagccacaacgugggccccggcgacaaguacaccugcauguucaccuacgccagccagggcggcaccaacgagcaguggcagaugagccugggcaccagcgaggaccaccagcacuucaccugcaccaucuggagaccccagggcaagagcuaccuguacuucacccaguucaaggccgaggugagaggcgccgagaucgaguacgccauggccuacagcaaggccgccuucgagagagagagcgacgugccccugaagaccgaggaguucgaggugaccaagaccgccguggcccacagacccggcgccuucaaggccgagcugagcaagcuggugaucguggccaaggccagcagaaccgagcuguga

SEQ ID NO: 4415 - RNA, 522 nt, Artificial Sequence
  derived and/or modified sequence opt5 from IL-25__Homo_sapiens__AAH10129
auggccgcucccagcggcggguggaacggagugggcgccucccugugggcggcucuccugcuuggggccgucgcccugagaccugcugaggccguuucugaaccgaccacaguggcuuucgacgugcggcccggaggcgucgugcacagcuuuucccauaauguugggccuggagauaaguacacgugcauguucaccuaugccucucagggcggcacaaacgagcaauggcagaugagccucgggaccuccgaagaccaccagcauuuuacauguaccaucuggcgcccccagggaaaaucuuaccuguauuucacacaauuuaaggcggaggugagaggcgccgaaauugaguacgcuauggccuauagcaaagcugccuucgagcgggaauccgaugucccucuuaagaccgaggaauuugaggugacgaaaaccgcgguugcccaccgccccggggcuuucaaggccgagcugagcaagcucgugaucgucgcuaaagccucuagaacagaacuguga

SEQ ID NO: 4416 - RNA, 522 nt, Artificial Sequence
  derived and/or modified sequence opt6 from IL-25__Homo_sapiens__AAH10129
auggcagcaccaucaggaggauggaauggaguaggcgcaucauuaugggcagcauuauuauuaggagcaguagcauuaagaccagcagaagcaguaucagaaccaacaacaguagcauucgauguaagaccaggaggaguuguacauucauuuucacauaacguaggaccaggagauaaauauacauguauguuuacauaugcaucacaaggaggaacaaacgaacaauggcaaaugucauuaggaacaucagaagaucaucaacauuucacaugcacaauauggagaccacaaggaaaaucauauuuauacuuuacacaauucaaagcagaaguaagaggagcagaaauagaauaugcaauggcauauucaaaagcagcauucgaaagagaaucagauguaccacuaaaaacagaagaauuugaaguaacaaaaacagcaguagcacacagaccaggagcauuuaaagcagaauuaucaaaacuaguaauaguagcaaaagcaucaagaacagaacuauaa

SEQ ID NO: 4417 - protein, 177 aa, Artificial Sequence
  IL-25__Homo_sapiens__Q9H293
MRERPRLGEDSSLISLFLQVVAFLAMVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 4418 - RNA, 534 nt, Artificial Sequence
  IL-25__Homo_sapiens__AAG40848
augagggagcgacccagauuaggugaggacaguucucucauuagccuuuuccuacaggugguugcauucuuggcaauggucaugggaacccacaccuacagccacuggcccagcugcugccccagcaaagggcaggacaccucugaggagcugcugagguggagcacugugccugugccuccccuagagccugcuaggcccaaccgccacccagaguccuguagggccagugaagauggaccccucaacagcagggccaucucccccuggagauaugaguuggacagagacuugaaccggcucccccaggaccuguaccacgcccguugccugugcccgcacugcgucagccuacagacaggcucccacauggacccccggggcaacucggagcugcucuaccacaaccagacugucuucuacaggcggccaugccauggcgagaagggcacccacaagggcuacugccuggagcgcaggcuguaccguguuuccuuagcuugugugugugugcggccccgugugaugggcuag

SEQ ID NO: 4419 - RNA, 534 nt, Artificial Sequence
  derived and/or modified sequence opt1 from IL-25__Homo_sapiens__AAG40848
augcgcgagcggccccgccugggcgaggacagcucccucaucagccuguuccugcaggucgucgccuuccucgccauggugauggggacccacaccuacucccacuggccgagcugcugccccuccaagggccaggacacgagcgaggagcugcugcggugguccaccgugcccgugcccccgcucgagcccgcgcgccccaaccggcaccccgagagcugccgcgccuccgaggacgggccgcugaacagccgggccaucucccccuggcgcuacgagcuggaccgggaccucaaccgccugccccaggaccuguaccacgcccggugccucugcccccacugcgugagccugcagaccggcucccacauggacccgcgcgggaacagcgagcugcucuaccacaaccagaccguguucuaccggcgccccugccacggcgagaagggcacgcacaagggguacugccuggagcggcgccuguaccgggucucccucgccugcgugugcgugcgcccccgggucaugggcuga

SEQ ID NO: 4420 - RNA, 534 nt, Artificial Sequence
  derived and/or modified sequence opt2 from IL-25__Homo_sapiens__AAG40848
augcgcgagcgcccccgccucggcgaggacuccucccucaucucccucuuccuccaggucgucgccuuccucgccauggucaugggcacccacaccuacucccacuggcccuccugcugccccuccaagggccaggacaccuccgaggagcuccuccgcugguccaccguccccguccccccccucgagcccgcccgccccaaccgccaccccgaguccugccgcgccuccgaggacggcccccucaacucccgcgccaucucccccuggcgcuacgagcucgaccgcgaccucaaccgccucccccaggaccucuaccacgcccgcugccucugcccccacugcgucucccuccagaccggcucccacauggacccccgcggcaacuccgagcuccucuaccacaaccagaccgucuucuaccgccgccccugccacggcgagaagggcacccacaagggcuacugccucgagcgccgccucuaccgcgucucccucgccugcgucugcguccgcccccgcgucaugggcuga

SEQ ID NO: 4421 - RNA, 534 nt, Artificial Sequence
  derived and/or modified sequence opt3 from IL-25__Homo_sapiens__AAG40848
augagagagaggccccggcugggcgaagacagcucccucaucucucuuuuccugcaaguggucgccuuuuuggcuaugguuauggggacccacacauacucacauuggccuaguugcuguccaagcaagggacaggauacuuccgaggaauuacugcgcuggucuacggugccgguacccccucuagagccagcacgacccaaccgucacccugaaucgugcagagccucagaggacgguccacucaauagcagggcgauuagucccuggcgguaugagcuggaucgcgaccuuaacagacugccucaggauuuguaccaugcuaggugucucugcccacacugugugucccugcagaccggcucucauauggacccgcgggggaauagcgaacugcucuaucacaaccagacagucuucuaccgccgacccugccacggagagaaaggcacucauaaggguuauuguuuagaaagaaggcuguaccgggugucccuugccugcguuugugugcguccucgcgucaugggguga

SEQ ID NO: 4422 - RNA, 534 nt, Artificial Sequence
  derived and/or modified sequence opt4 from IL-25__Homo_sapiens__AAG40848
augagagagagacccagacugggcgaggacagcagccugaucagccuguuccugcaggugguggccuuccuggccauggugaugggcacccacaccuacagccacuggcccagcugcugccccagcaagggccaggacaccagcgaggagcugcugagauggagcaccgugcccgugcccccccuggagcccgccagacccaacagacaccccgagagcugcagagccagcgaggacggcccccugaacagcagagccaucagccccuggagauacgagcuggacagagaccugaacagacugccccaggaccuguaccacgccagaugccugugcccccacugcgugagccugcagaccggcagccacauggaccccagaggcaacagcgagcugcuguaccacaaccagaccguguucuacagaagacccugccacggcgagaagggcacccacaagggcuacugccuggagagaagacuguacagagugagccuggccugcgugugcgugagacccagagugaugggcuga

SEQ ID NO: 4423 - RNA, 534 nt, Artificial Sequence
  derived and/or modified sequence opt5 from IL-25__Homo_sapiens__AAG40848
augagagagcggccccgccugggcgaagacagcucccucaucucucuguuccuucagguggucgccuuucuggcuaugguuauggggacccacacauacagccauuggccuuccugcuguccgucuaagggacaagauacgagcgaggaacuccugagaugguccaccgugcccgugccuccccuugagccugcccggcccaaccgccacccugaaucuugcagagcgagcgaggacggcccgcucaauucccgggcuauuagccccuggcgcuaugagcuggauagagaccugaaccggcugccucaggaucucuaccaugcccgcugucugugcccccacugugucucucuucagacagggucccauauggacccuagaggaaauagcgaacugcucuaucacaaccagaccguguucuaccggcgccccugccacggcgagaaagggacacauaagggauauugucuggaaagacggcuuuaccgcguuucucuggccugcgugugugucagaccgcgggugaugggcuga

SEQ ID NO: 4424 - RNA, 534 nt, Artificial Sequence
  derived and/or modified sequence opt6 from IL-25__Homo_sapiens__AAG40848
augagagaaagaccaagauuaggagaagacucaucacuaauaucacuauuucuacaaguaguagcauuuuuagcaaugguaaugggaacacauacauauucacauuggccaucauguugcccaagcaaaggacaagacacaagcgaagaacuacuaagauggucaacaguaccaguaccaccacuagaaccagcaagaccaaacagacacccagaaucaugcagagcaucagaagauggaccauuaaauucaagagcaauaucaccauggagauacgaacuagauagagauuuaaauagauuaccacaagacuuauaccaugcaagaugcuuaugcccacacuguguaucacuacaaacaggaucacauauggauccaagaggaaauucagaauuacuauaccauaaccaaacaguauuuuauagaagaccaugucacggagaaaaaggaacacacaaaggauauugcuuagaaagaagauuauacagaguaucacuagcaugcguaugcguaagaccaagaguaaugggauaa

SEQ ID NO: 4425 - protein, 171 aa, Artificial Sequence
  IL-26__Homo_sapiens__Q9NPH9
MLVNFILRCGLLLVTLSLAIAKHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 4426 - RNA, 516 nt, Artificial Sequence
  IL-26__Homo_sapiens__AAH66270
augcuggugaauuucauuuugagguguggguugcuguuagucacucugucucuugccauugccaagcacaagcaaucuuccuucaccaaaaguuguuacccaaggggaacauugucccaagcuguugacgcucucuauaucaaagcagcauggcucaaagcaacgauuccagaagaccgcauaaaaaauauacgauuauuaaaaaagaaaacaaaaaagcaguuuaugaaaaacugucaauuucaagaacagcuucuguccuucuucauggaagacguuuuuggucaacugcaauugcaaggcugcaagaaaauacgcuuuguggaggacuuucauagccuuaggcagaaauugagccacuguauuuccugugcuucaucagcuagagagaugaaauccauuaccaggaugaaaagaauauuuuauaggauuggaaacaaaggaaucuacaaagccaucagugaacuggauauucuucuuuccuggauuaaaaaauuauuggaaagcagucaguaa

SEQ ID NO: 4427 - RNA, 516 nt, Artificial Sequence
  derived and/or modified sequence opt1 from IL-26__Homo_sapiens__AAH66270
augcuggugaacuucauccuccgcugcggccugcugcucgucacccugagccuggccaucgccaagcacaagcaguccagcuucaccaaguccugcuacccccgggggacgcucagccaggcgguggacgcccuguacaucaaggccgccuggcugaaggccaccaucccggaggaccgcaucaagaacauccggcuccugaagaagaagaccaagaagcaguucaugaagaacugccaguuccaggagcagcugcucuccuucuucauggaggacguguucggccagcugcagcugcaggggugcaagaagauccgcuucgucgaggacuuccacagccuccggcagaagcugucccacugcaucagcugcgcguccagcgcccgcgagaugaaguccaucacccggaugaagcgcaucuucuaccggaucggcaacaaggggaucuacaaggccaucagcgagcuggacauccuccuguccuggaucaagaagcugcucgagagcucccaguga

SEQ ID NO: 4428 - RNA, 516 nt, Artificial Sequence
  derived and/or modified sequence opt2 from IL-26__Homo_sapiens__AAH66270
augcucgucaacuucauccuccgcugcggccuccuccucgucacccucucccucgccaucgccaagcacaagcaguccuccuucaccaaguccugcuacccccgcggcacccucucccaggccgucgacgcccucuacaucaaggccgccuggcucaaggccaccauccccgaggaccgcaucaagaacauccgccuccucaagaagaagaccaagaagcaguucaugaagaacugccaguuccaggagcagcuccucuccuucuucauggaggacgucuucggccagcuccagcuccagggcugcaagaagauccgcuucgucgaggacuuccacucccuccgccagaagcucucccacugcaucuccugcgccuccuccgcccgcgagaugaaguccaucacccgcaugaagcgcaucuucuaccgcaucggcaacaagggcaucuacaaggccaucuccgagcucgacauccuccucuccuggaucaagaagcuccucgaguccucccaguga

SEQ ID NO: 4429 - RNA, 516 nt, Artificial Sequence
  derived and/or modified sequence opt3 from IL-26__Homo_sapiens__AAH66270
augcuggugaacuucauacucagaugcggccuucuguuggucaccuuaagccuggccauugcuaagcacaaacaguccucuuuuacaaagucauguuaccccagggggacucuaagucaagcaguugacgcccucuauauaaaagcggcuuggcugaaggccacgaucccugaggaucggauuaaaaauauccgccuucugaagaagaaaaccaagaaacaguucaugaagaacugccaguuucaggaacaauugcucagcuucuuuauggaggacguguucggacagcugcagcugcaggguuguaaaaagauucgauuuguagaagauuuccauucccuccgucaaaaguuaucucacugcaucucgugugcaucaagcgccagagagaugaaaaguauaacaaggaugaagcggaucuuuuaccgcauuggcaauaaagggaucuauaaggcuauuuccgaacuggacauccuuuugucuuggaucaaaaagcugcuagagagcucccaguga

SEQ ID NO: 4430 - RNA, 516 nt, Artificial Sequence
  derived and/or modified sequence opt4 from IL-26__Homo_sapiens__AAH66270
augcuggugaacuucauccugagaugcggccugcugcuggugacccugagccuggccaucgccaagcacaagcagagcagcuucaccaagagcugcuaccccagaggcacccugagccaggccguggacgcccuguacaucaaggccgccuggcugaaggccaccauccccgaggacagaaucaagaacaucagacugcugaagaagaagaccaagaagcaguucaugaagaacugccaguuccaggagcagcugcugagcuucuucauggaggacguguucggccagcugcagcugcagggcugcaagaagaucagauucguggaggacuuccacagccugagacagaagcugagccacugcaucagcugcgccagcagcgccagagagaugaagagcaucaccagaaugaagagaaucuucuacagaaucggcaacaagggcaucuacaaggccaucagcgagcuggacauccugcugagcuggaucaagaagcugcuggagagcagccaguga

SEQ ID NO: 4431 - RNA, 516 nt, Artificial Sequence
  derived and/or modified sequence opt5 from IL-26__Homo_sapiens__AAH66270
augcuggugaacuucauccucagaugcggccugcuucuggucacccucagccuggccauugcuaagcacaaacaguccucuuuuacaaagagcuguuacccccgggggacgcuuucccaagccguugacgcgcuguauaucaaagcugccuggcucaaggccaccauuccugaggaucgcaucaaaaauauuagacugcugaagaagaaaacaaagaaacaguucaugaagaacugccaguuucaggaacaacuccugucuuucuuuauggaggacguguucggacagcuucagcugcagggcuguaaaaagauccgguuuguggaagauuuccauagccuccgccaaaagcugucccacugcaucucuugugcuagcuccgccagagagaugaaaagcauuacccggaugaagcgcaucuuuuacagaauugggaauaaaggaaucuauaaggcuauuucugaacuugacauccugcucuccuggauuaaaaagcugcuggagagcucucaguga

SEQ ID NO: 4432 - RNA, 516 nt, Artificial Sequence
  derived and/or modified sequence opt6 from IL-26__Homo_sapiens__AAH66270
augcuaguaaacuucauacuaagaugcggacuacuacuaguaacccuaucacuagcaauagcaaaacacaaacaaucaucauucacaaaauccugcuacccaagaggaaccuuaucacaagcaguagacgcauuauacauaaaagcagcauggcuaaaagcaaccauaccagaagacagaauaaaaaacauaagacuacuaaaaaaaaaaacaaaaaaacaauucaugaaaaacugccaauuccaagaacaacuacuaucauucuucauggaagacguauucggacaacuacaacuacaaggaugcaaaaaaauaagauucguagaagacuuccacucacuaagacaaaaacuaucccacugcauaucaugcgcaagcucagcaagagaaaugaaaucaauaacaagaaugaaaagaauauucuacagaauaggaaacaaaggaauauacaaagcaauaucagaacuagacauacuacuaucauggaucaaaaaacuacucgaaucaucacaauaa

SEQ ID NO: 4433 - protein, 243 aa, Artificial Sequence
  IL-27A__Homo_sapiens__Q8NEV9
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 4434 - RNA, 732 nt, Artificial Sequence
  IL-27A__Homo_sapiens__ABK41903
augggccagacggcaggcgaccuuggcuggcggcucagccuguugcugcuucccuugcuccugguucaagcuggugucuggggauucccaaggcccccagggaggccccagcugagccugcaggagcugcggagggaguucacagucagccugcaucucgccaggaagcugcucuccgagguucggggccaggcccaccgcuuugcggaaucucaccugccaggagugaaccuguaccuccugccccugggagagcagcucccugauguuucccugaccuuccaggccuggcgccgccucucugacccggagcgucucugcuucaucuccaccacgcuucagcccuuccaugcccugcugggagggcuggggacccagggccgcuggaccaacauggagaggaugcagcugugggccaugaggcuggaccuccgcgaucugcagcggcaccuccgcuuccaggugcuggcugcaggauucaaccucccggaggaggaggaggaggaagaggaggaggaggaggaggagaggaaggggcugcucccaggggcacugggcagcgccuuacagggcccggcccagguguccuggccccagcuccucuccaccuaccgccugcugcacuccuuggagcucgucuuaucucgggccgugcgggaguugcugcugcuguccaaggcugggcacucagucuggcccuugggguucccaacauugagcccccagcccuga

SEQ ID NO: 4435 - RNA, 732 nt, Artificial Sequence
  derived and/or modified sequence opt1 from IL-27A__Homo_sapiens__ABK41903
augggccagaccgccggggaccugggcuggcgccucucccugcugcuccugccccugcuccuggugcaggccggggucuggggcuucccgcggccgcccgggcgcccccagcugucccuccaggagcugcggcgcgaguucaccgugagccugcaccucgcgcggaagcugcuguccgaggugcgcggccaggcccaccgguucgccgagagccaccuccccggcgucaaccuguaccugcucccccugggggagcagcugcccgacgugucccucacguuccaggccuggcgccggcugagcgaccccgagcgccugugcuucaucuccaccacccuccagccguuccacgcccugcugggcgggcucggcacccaggggcgguggacgaacauggagcgcaugcagcugugggcgaugcggcuggaccuccgcgaccugcagcggcaccuccgcuuccaggugcuggccgccggcuucaaccugcccgaggaggaggaggaggaggaggaggaggaggaggaggagcggaagggccugcuccccggggcccugggcagcgcgcugcaggggcccgcccaggucuccuggccgcagcuccugagcaccuaccgccugcuccacucccuggagcuggugcucagccgggccgugcgcgagcugcugcuccuguccaaggccggccacagcgucuggccccugggcuuccccacccugagcccccagccguga

SEQ ID NO: 4436 - RNA, 732 nt, Artificial Sequence
  derived and/or modified sequence opt2 from IL-27A__Homo_sapiens__ABK41903
augggccagaccgccggcgaccucggcuggcgccucucccuccuccuccucccccuccuccucguccaggccggcgucuggggcuucccccgcccccccggccgcccccagcucucccuccaggagcuccgccgcgaguucaccgucucccuccaccucgcccgcaagcuccucuccgagguccgcggccaggcccaccgcuucgccgagucccaccuccccggcgucaaccucuaccuccucccccucggcgagcagcuccccgacgucucccucaccuuccaggccuggcgccgccucuccgaccccgagcgccucugcuucaucuccaccacccuccagcccuuccacgcccuccucggcggccucggcacccagggccgcuggaccaacauggagcgcaugcagcucugggccaugcgccucgaccuccgcgaccuccagcgccaccuccgcuuccagguccucgccgccggcuucaaccuccccgaggaggaggaggaggaggaggaggaggaggaggaggagcgcaagggccuccuccccggcgcccucggcuccgcccuccagggccccgcccaggucuccuggccccagcuccucuccaccuaccgccuccuccacucccucgagcucguccucucccgcgccguccgcgagcuccuccuccucuccaaggccggccacuccgucuggccccucggcuuccccacccucuccccccagcccuga

SEQ ID NO: 4437 - RNA, 732 nt, Artificial Sequence
  derived and/or modified sequence opt3 from IL-27A__Homo_sapiens__ABK41903
augggccagaccgccggggaccugggauggagacucagccuucuguuguuaccccugcuacucgugcaagcuggugucuggggcuucccuaggccaccggggcggccccagcugucccuucaggagcugcgccgagaauuuacaguuucuuugcaccucgcacguaagcugcugucagaggugagaggacaggcccauagguucgcggaaagucaccucccuggcguaaacuuauaccugcuuccauugggugagcaacugcccgaugugagccuaacuuuucaggcuuggcggcgccucuccgacccugaaagacugugcuucaucucuacgacccuucagccauuucaugcccuguugggcggacucggcacacaggggagguggacuaauauggagcggaugcaacugugggcaaugcgcuuagaucugcgagaccuccagagacaccuuagguuccagguccuggccgcuggguuuaacuugcccgaggaagaggaagaggaggaagaggaagaggaagaggagcggaaaggacuacugccuggugcacucggcucggcccugcaggggccagcucaagugucauggccgcagcuucugagcaccuaucguuugcuccauagucuggaauuaguucugucccgcgccgugagagagcuacuccugcuuucuaaggcgggacacagcgucuggcccuugggcuucccuacacuguccccacagcccuga

SEQ ID NO: 4438 - RNA, 732 nt, Artificial Sequence
  derived and/or modified sequence opt4 from IL-27A__Homo_sapiens__ABK41903
augggccagaccgccggcgaccugggcuggagacugagccugcugcugcugccccugcugcuggugcaggccggcguguggggcuuccccagaccccccggcagaccccagcugagccugcaggagcugagaagagaguucaccgugagccugcaccuggccagaaagcugcugagcgaggugagaggccaggcccacagauucgccgagagccaccugcccggcgugaaccuguaccugcugccccugggcgagcagcugcccgacgugagccugaccuuccaggccuggagaagacugagcgaccccgagagacugugcuucaucagcaccacccugcagcccuuccacgcccugcugggcggccugggcacccagggcagauggaccaacauggagagaaugcagcugugggccaugagacuggaccugagagaccugcagagacaccugagauuccaggugcuggccgccggcuucaaccugcccgaggaggaggaggaggaggaggaggaggaggaggaggagagaaagggccugcugcccggcgcccugggcagcgcccugcagggccccgcccaggugagcuggccccagcugcugagcaccuacagacugcugcacagccuggagcuggugcugagcagagccgugagagagcugcugcugcugagcaaggccggccacagcguguggccccugggcuuccccacccugagcccccagcccuga

SEQ ID NO: 4439 - RNA, 732 nt, Artificial Sequence
  derived and/or modified sequence opt5 from IL-27A__Homo_sapiens__ABK41903
augggccagaccgccggggaccugggauggagacucagccugcuucugcucccccugcuucuggugcaagcuggcgucuggggguucccucggccgcccggacgcccucagcucucccugcaggagcugagacgggaauuuacaguuucucuccaccuggcccgcaagcugcugagcgaggugagaggccaggcgcaucgguucgcugaaucccaccuccccggggugaaccuguaccuucugccucucggagagcaacugcccgaugucucucugacguuucaggccuggcgcagacucagcgacccugaacggcugugcuucaucuccaccacacuucagccguuucaugcccugcucggcggccuggggacccagggacgcuggacaaauauggagagaaugcaacuuugggcuaugcggcuggaucuccgcgaccugcagagacaccuucgguuccaggugcucgccgcuggcuuuaaccugcccgaggaagaggaagaggaggaagaggaagaggaagaggagcgcaaagggcuucugccuggagcccucggcucugcgcugcaggggcccgcccaaguuagcuggccucagcuucuguccaccuauagacuccugcauagccuggaacucgugcugucucgggcugucagagagcuucugcuccuguccaaggccggacacagcguguggccccugggcuucccgacacuuucuccucagcccuga

SEQ ID NO: 4440 - RNA, 732 nt, Artificial Sequence
  derived and/or modified sequence opt6 from IL-27A__Homo_sapiens__ABK41903
augggacaaacagcaggagacuuaggauggagauuaucacuacucuuauuaccacuccuacuaguacaagcuggaguuuggggauucccuagaccaccaggaagaccacaauuaagcuuacaagaacuaagaagagaauuuacuguaucacuacaucuagcaagaaaauuauuaucagaaguaagaggacaagcacacagauucgcagaaucccaucuaccaggaguaaacuuauacuuacuaccacuaggcgaacaacuaccagacguuucauuaaccuuucaagcuuggagaagauuaucagauccagaaagauuaugcuuuauauccacaacacuacaacccuuucacgcacuauuaggaggucuaggaacacaaggaagauggacuaacauggaaagaaugcaauuaugggccaugagauuagacuuaagagaucuacaaagacauuuaagauuccaaguacuagcagcaggauuuaaccuaccagaagaagaagaagaagaagaagaagaagaagaagaagaaagaaaaggccuucuaccaggagcacuaggaagcgcacuacaaggaccagcccaaguaucauggccccaauuacuaucaacauauagauuacuacauagccuagaauuaguauuaucaagagcaguaagagaacuauuacuauuaagcaaagcaggacacucuguauggccacuagguuuuccaacacuaucuccacaaccauaa

SEQ ID NO: 4441 - protein, 229 aa, Artificial Sequence
  IL-27B__Homo_sapiens__Q14213
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 4442 - RNA, 690 nt, Artificial Sequence
  IL-27B__Homo_sapiens__AAC33488
augaccccgcagcuucuccuggcccuuguccucugggccagcugcccgcccugcaguggaaggaaagggcccccagcagcucugacacugccccgggugcaaugccgagccucucgguacccgaucgccguggauugcuccuggacccugccgccugcuccaaacuccaccagccccguguccuucauugccacguacaggcucggcauggcugcccggggccacagcuggcccugccugcagcagacgccaacguccaccagcugcaccaucacggauguccagcuguucuccauggcucccuacgugcucaaugucaccgccguccaccccuggggcuccagcagcagcuucgugccuuucauaacagagcacaucaucaagcccgacccuccagaaggcgugcgccuaagcccccucgcugagcgccagcuacaggugcagugggagccucccggguccuggcccuucccagagaucuucucacugaaguacuggauccguuacaagcgucagggagcugcgcgcuuccaccggguggggcccauugaagccacguccuucauccucagggcugugcggccccgagccagguacuacguccaaguggcggcucaggaccucacagacuacggggaacugagugacuggagucuccccgccacugccacaaugagccugggcaaguag

SEQ ID NO: 4443 - RNA, 690 nt, Artificial Sequence
  derived and/or modified sequence opt1 from IL-27B__Homo_sapiens__AAC33488
augacgccccagcugcuccuggcccuggugcucugggccagcugcccgcccugcuccggccgcaaggggccgcccgcggcccugacccugccccggguccagugccgcgccagccgguaccccaucgccguggacugcuccuggacccucccgcccgcccccaacagcaccucccccgugagcuucaucgcgaccuaccgccugggcauggccgcccgggggcacuccuggcccugccugcagcagacccccacgagcaccuccugcaccaucaccgacguccagcuguucagcauggccccguacgugcucaacgugacggcgguccaccccuggggcuccagcuccagcuucgugcccuucaucaccgagcacaucaucaagcccgacccgcccgagggggugcgccugagcccccucgccgagcggcagcugcagguccagugggagcccccgggcuccuggcccuuccccgagaucuucucccugaaguacuggauccgcuacaagcggcagggcgccgcccgcuuccaccggguggggcccaucgaggccaccagcuucauccuccgcgcggugcggccgcgcgcccgguacuacguccagguggccgcccaggaccugaccgacuacggcgagcuguccgacuggagccuccccgccacggcgaccaugagccuggggaaguga

SEQ ID NO: 4444 - RNA, 690 nt, Artificial Sequence
  derived and/or modified sequence opt2 from IL-27B__Homo_sapiens__AAC33488
augaccccccagcuccuccucgcccucguccucugggccuccugcccccccugcuccggccgcaagggcccccccgccgcccucacccucccccgcguccagugccgcgccucccgcuaccccaucgccgucgacugcuccuggacccucccccccgcccccaacuccaccucccccgucuccuucaucgccaccuaccgccucggcauggccgcccgcggccacuccuggcccugccuccagcagacccccaccuccaccuccugcaccaucaccgacguccagcucuucuccauggcccccuacguccucaacgucaccgccguccaccccuggggcuccuccuccuccuucguccccuucaucaccgagcacaucaucaagcccgacccccccgagggcguccgccucuccccccucgccgagcgccagcuccagguccagugggagccccccggcuccuggcccuuccccgagaucuucucccucaaguacuggauccgcuacaagcgccagggcgccgcccgcuuccaccgcgucggccccaucgaggccaccuccuucauccuccgcgccguccgcccccgcgcccgcuacuacguccaggucgccgcccaggaccucaccgacuacggcgagcucuccgacuggucccuccccgccaccgccaccaugucccucggcaaguga

SEQ ID NO: 4445 - RNA, 690 nt, Artificial Sequence
  derived and/or modified sequence opt3 from IL-27B__Homo_sapiens__AAC33488
augacaccccagcugcuccuugcccugguguugugggcuagcugcccuccauguuccggcagaaaggggccgcccgcagccuuaacccugccuaggguccaaugccgggcgucucgcuacccaaucgcuguugacuguucauggacucuacccccugccccaaacaguacgagccccguguccuucauugcaaccuaucgacucggaauggccgcucguggucacucuuggccuugccugcagcagacaccaacuucgaccucauguacaauaaccgauguacagcuuuuuagcauggcaccguacgugcugaaugucacugccgugcaucccuggggcaguuccucuagcuucguuccuuuuaucacagagcacauuaucaaaccagaucccccugaaggggugagauuguccccacucgcugagaggcaacugcagguccagugggaacccccgggaucauggccuuuccccgagauuuuuagucugaaguauuggauccgguacaaacgccagggcgccgcgagauuccauaggguggguccaauagaagcaaccagcuuuauccuccgggccguacgcccucgagcuagauauuacguucaaguggccgcacaggacuuaacggacuauggggagcugucugauuggucccuucccgcuacugccaccaugucauugggaaaguga

SEQ ID NO: 4446 - RNA, 690 nt, Artificial Sequence
  derived and/or modified sequence opt4 from IL-27B__Homo_sapiens__AAC33488
augaccccccagcugcugcuggcccuggugcugugggccagcugcccccccugcagcggcagaaagggcccccccgccgcccugacccugcccagagugcagugcagagccagcagauaccccaucgccguggacugcagcuggacccugccccccgcccccaacagcaccagccccgugagcuucaucgccaccuacagacugggcauggccgccagaggccacagcuggcccugccugcagcagacccccaccagcaccagcugcaccaucaccgacgugcagcuguucagcauggcccccuacgugcugaacgugaccgccgugcaccccuggggcagcagcagcagcuucgugcccuucaucaccgagcacaucaucaagcccgacccccccgagggcgugagacugagcccccuggccgagagacagcugcaggugcagugggagccccccggcagcuggcccuuccccgagaucuucagccugaaguacuggaucagauacaagagacagggcgccgccagauuccacagagugggccccaucgaggccaccagcuucauccugagagccgugagacccagagccagauacuacgugcagguggccgcccaggaccugaccgacuacggcgagcugagcgacuggagccugcccgccaccgccaccaugagccugggcaaguga

SEQ ID NO: 4447 - RNA, 690 nt, Artificial Sequence
  derived and/or modified sequence opt5 from IL-27B__Homo_sapiens__AAC33488
augacaccccagcugcuccuggcccuugugcugugggcuagcugcccuccguguuccggcagaaaggggcccccugccgcgcucacccugccccggguccaaugccgcgcuucuagauacccuaucgccguugacuguagcuggacgcuucccccugccccgaacuccaccucucccgugagcuucauugcuacauaucggcugggaauggccgcucgcggccacuccuggccuugccuccagcagacccccacaucuaccagcuguacaaucaccgaugugcagcuguuuuccauggccccuuacguccugaaugugacggcgguucaucccugggggucuagcuccagcuucgugccguuuauuaccgagcacaucauuaaaccugaucccccugaaggagucagacucucuccccuggccgagcggcaacuucaggugcagugggaacccccuggcuccuggccguuccccgagaucuuuagccugaaguauuggauccgcuacaaaagacagggggcugcccgguuccaucgcguuggaccuauugaagcuacaucuuuuauccucagagccgugcggccccgcgcgagauauuacguccaaguggccgcucaggaccugaccgacuauggcgagcuuuccgauuggagccugccugccacagcuaccaugucccucggcaaguga

SEQ ID NO: 4448 - RNA, 690 nt, Artificial Sequence
  derived and/or modified sequence opt6 from IL-27B__Homo_sapiens__AAC33488
augacaccacaacuauuauuagcacuaguacuaugggcaucaugcccaccaugcucaggaagaaaaggacccccagcugcauuaacacuaccaagaguacaaugcagagcaucaagauacccaauagcaguagacugcucauggacacuaccaccagccccaaacucaacaucaccaguaucauucaucgcaacauacagacuaggaauggcagcaagaggacacucauggccaugccuacaacaaacaccuacaucaacauccugcacaauaacagacguacaauuauuuucaauggcaccauacguacuaaacguaacagcaguacacccauggggaucaucaagcucauucgucccauucauaacagaacacauaauaaaaccagacccacccgaaggagucagacuaucaccauuagcagaaagacaauuacaaguacaaugggaaccaccaggaucuuggccauucccagaaauauucucccuaaaauauuggauacgauacaaaagacaaggagcagcaagauuucauagaguaggaccaauagaagcaacaucauucauauuaagagcaguaagaccaagagcaagauacuacguccaaguagcugcacaagaccuaacagacuacggagaacuaucagacuggucauuaccugcaacagcaacaaugucccuaggaaaauaa

SEQ ID NO: 4449 - protein, 200 aa, Artificial Sequence
  IL-28A__Homo_sapiens__Q8IZJ0
MKLDMTGDCTPVLVLMAAVLTVTGAVPVARLHGALPDARGCHIAQFKSLSPQELQAFKRAKDALEESLLLKDCRCHSRLFPRTWDLRQLQVRERPMALEAELALTLKVLEATADTDPALVDVLDQPLHTLHHILSQFRACIQPQPTAGPRTRGRLHHWLYRLQEAPKKESPGCLEASVTFNLFRLLTRDLNCVASGDLCV

SEQ ID NO: 4450 - RNA, 603 nt, Artificial Sequence
  IL-28A__Homo_sapiens__AAI13582
augaaacuagacaugacuggggacugcacgccagugcuggugcugauggccgcagugcugaccgugacuggagcaguuccugucgccaggcuccacggggcucucccggaugcaaggggcugccacauagcccaguucaagucccugucuccacaggagcugcaggccuuuaagagggccaaagaugccuuagaagagucgcuucugcugaaggacugcaggugccacucccgccucuuccccaggaccugggaccugaggcagcugcaggugagggagcgccccauggcuuuggaggcugagcuggcccugacgcugaagguucuggaggccaccgcugacacugacccagcccugguggacgucuuggaccagccccuucacacccugcaccauauccucucccaguuccgggccuguauccagccucagcccacggcagggcccaggacccggggccgccuccaccauuggcuguaccggcuccaggaggccccaaaaaaggaguccccuggcugccucgaggccucugucaccuucaaccucuuccgccuccucacgcgagaccugaauuguguugccaguggggaccugugugucuga

SEQ ID NO: 4451 - RNA, 603 nt, Artificial Sequence
  derived and/or modified sequence opt1 from IL-28A__Homo_sapiens__AAI13582
augaagcuggacaugaccggcgacugcacccccgugcucguccugauggccgccgugcugacggugaccggggcggucccgguggcccgccuccacggcgcccugcccgacgcccgggggugccacaucgcccaguucaagagccugagcccccaggagcuccaggcguucaagcgcgccaaggacgcccuggaggagucccugcuccugaaggacugccggugccacucccgccuguucccccggaccugggaccuccgccagcuccaggugcgggagcgcccgauggcccuggaggcggagcuggcccugacccugaagguccucgaggccacggccgacaccgaccccgcccugguggacgugcuggaccagccccuccacacccugcaccacauccugagccaguuccgggcgugcauccagccccagccgaccgccggcccccgcacgcgggggcgccuccaccacuggcuguaccggcugcaggaggcccccaagaaggagucccccggcugccucgaggccagcgucaccuucaaccuguuccgccugcucacccgggaccugaacugcguggccuccggcgaccugugcguguga

SEQ ID NO: 4452 - RNA, 603 nt, Artificial Sequence
  derived and/or modified sequence opt2 from IL-28A__Homo_sapiens__AAI13582
augaagcucgacaugaccggcgacugcacccccguccucguccucauggccgccguccucaccgucaccggcgccguccccgucgcccgccuccacggcgcccuccccgacgcccgcggcugccacaucgcccaguucaagucccucuccccccaggagcuccaggccuucaagcgcgccaaggacgcccucgaggagucccuccuccucaaggacugccgcugccacucccgccucuucccccgcaccugggaccuccgccagcuccagguccgcgagcgccccauggcccucgaggccgagcucgcccucacccucaagguccucgaggccaccgccgacaccgaccccgcccucgucgacguccucgaccagccccuccacacccuccaccacauccucucccaguuccgcgccugcauccagccccagcccaccgccggcccccgcacccgcggccgccuccaccacuggcucuaccgccuccaggaggcccccaagaaggagucccccggcugccucgaggccuccgucaccuucaaccucuuccgccuccucacccgcgaccucaacugcgucgccuccggcgaccucugcgucuga

SEQ ID NO: 4453 - RNA, 603 nt, Artificial Sequence
  derived and/or modified sequence opt3 from IL-28A__Homo_sapiens__AAI13582
augaagcuggacaugaccggcgauugcacacccgugcucguccuuauggccgcuguucugacugugacgggggcaguaccuguggccagauugcacggagcguuaccagacgcuagggguugucauaucgcccaguucaaaagccuguccccgcaagagcuacaggcauuuaagcgggccaaagaugcucucgaagagucucugcuucugaaggacugccgcugucacucacgauuguucccccguaccugggaucucagacagcugcaggucagggaacggccuauggcacuggaggccgaacucgcuuuaacacugaaagugcuugaggccacugcggacaccgauccagcauugguugacgugcuggaucaaccccuacauacacuccaccauauucugagucaguuucgcgccugcauacagccucagccaaccgcuggccccagaacuagggggcggcuucaccacuggcuguaccgcuugcaagaggccccuaagaaggaaagcccaggaugucucgaggcauccgucacauucaaccuguuucgauuacugaccagagaccucaauugcguggcuucuggcgaucuuuguguauga

SEQ ID NO: 4454 - RNA, 603 nt, Artificial Sequence
  derived and/or modified sequence opt4 from IL-28A__Homo_sapiens__AAI13582
augaagcuggacaugaccggcgacugcacccccgugcuggugcugauggccgccgugcugaccgugaccggcgccgugcccguggccagacugcacggcgcccugcccgacgccagaggcugccacaucgcccaguucaagagccugagcccccaggagcugcaggccuucaagagagccaaggacgcccuggaggagagccugcugcugaaggacugcagaugccacagcagacuguuccccagaaccugggaccugagacagcugcaggugagagagagacccauggcccuggaggccgagcuggcccugacccugaaggugcuggaggccaccgccgacaccgaccccgcccugguggacgugcuggaccagccccugcacacccugcaccacauccugagccaguucagagccugcauccagccccagcccaccgccggccccagaaccagaggcagacugcaccacuggcuguacagacugcaggaggcccccaagaaggagagccccggcugccuggaggccagcgugaccuucaaccuguucagacugcugaccagagaccugaacugcguggccagcggcgaccugugcguguga

SEQ ID NO: 4455 - RNA, 603 nt, Artificial Sequence
  derived and/or modified sequence opt5 from IL-28A__Homo_sapiens__AAI13582
augaagcuggacaugaccggcgauugcacacccgugcucguccugauggccgcuguucuuacggugaccggggccgugccugucgcgagacugcacggagcucucccggacgcccggggcugucauaucgcccaguucaaaagccugucuccccaagagcuucaggcuuuuaagcgcgccaaagaugcucuggaagagucccuccugcugaaggacugcagaugucacagccgccucuucccucggacaugggaucugagacagcuucaggugcgggaacgccccauggcccuggaggcggaacucgcccugacccuuaaaguucuggaggcuacagccgacaccgauccugcucucguggacguccuggaucaaccccugcauacacuccaccauauucugucccaguuuagagccugcauccagccucagccgaccgcggggccccggacgcgcggaagacuucaccacuggcuguaccggcuccaagaggccccuaagaaggaaucucccggcugucuggaggcuagcgugaccuucaaccuuuuucgccugcucacaagagaccugaauugcguugccuccggggaucuguguguguga

SEQ ID NO: 4456 - RNA, 603 nt, Artificial Sequence
  derived and/or modified sequence opt6 from IL-28A__Homo_sapiens__AAI13582
augaaauuagacaugacaggagacuguacaccaguacucguacuaauggcagcaguacuaacaguuacaggagcaguaccaguagcaagacuacacggagcacuaccagacgcaagaggaugucacauagcacaauucaaaucauuaucaccacaagaacuccaagcauuuaaaagagccaaagacgcacuagaagaaucauuacuauuaaaagacugcagaugccacucacgacuauucccaagaacaugggaccuaagacaacuacaaguaagagaaagaccaauggcauuagaagccgaacuagcauuaacauuaaaaguacuagaagcaacagcagacacagauccagcccuagucgacguacuagaccaaccacuacacacacuacaccacauacuaucacaauuuagagccugcauacaaccacaaccaacagcaggaccacgaacaagaggcagacuacaccacuggcuauacagacuacaagaagccccaaaaaaagaaucaccaggaugccuagaagcaucaguaacauucaaccuauucagacuauuaacaagagaccuaaacugcguagcaucaggagaccuaugcguauaa

SEQ ID NO: 4457 - protein, 196 aa, Artificial Sequence
  IL-28B__Homo_sapiens__Q8IZI9
MTGDCMPVLVLMAAVLTVTGAVPVARLRGALPDARGCHIAQFKSLSPQELQAFKRAKDALEESLLLKDCKCRSRLFPRTWDLRQLQVRERPVALEAELALTLKVLEATADTDPALGDVLDQPLHTLHHILSQLRACIQPQPTAGPRTRGRLHHWLHRLQEAPKKESPGCLEASVTFNLFRLLTRDLNCVASGDLCV

SEQ ID NO: 4458 - RNA, 591 nt, Artificial Sequence
  IL-28B__Homo_sapiens__AAI30315
augaccggggacugcaugccagugcuggugcugauggccgcagugcugaccgugacuggagcaguuccugucgccaggcuccgcggggcucucccggaugcaaggggcugccacauagcccaguucaagucccugucuccacaggagcugcaggccuuuaagagggccaaagaugccuuagaagagucgcuucugcugaaggacugcaagugccgcucccgccucuuccccaggaccugggaccugaggcagcugcaggugagggagcgccccguggcuuuggaggcugagcuggcccugacgcugaagguucuggaggccaccgcugacacugacccagcccugggggaugucuuggaccagccccuucacacccugcaccauauccucucccagcuccgggccuguauccagccucagcccacggcagggcccaggacccggggccgccuccaccauuggcugcaccggcuccaggaggccccaaaaaaggaguccccuggcugccucgaggccucugucaccuucaaccucuuccgccuccucacgcgagaccugaauuguguugccagcggggaccugugugucuga

SEQ ID NO: 4459 - RNA, 591 nt, Artificial Sequence
  derived and/or modified sequence opt1 from IL-28B__Homo_sapiens__AAI30315
augaccggcgacugcaugcccgugcugguccucauggccgccgugcugaccgugacgggggcggucccgguggcccgccugcggggcgcccuccccgacgcccgcgggugccacaucgcccaguucaagagccugagcccccaggagcugcaggcguucaagcgggccaaggacgcccucgaggagucccugcugcucaaggacugcaagugccgcucccggcuguucccccgcaccugggaccugcggcagcuccaggugcgcgagcggccggucgcccuggaggcggagcuggcccucacccugaaggugcuggaggccaccgccgacacggaccccgcccucggcgacgugcuggaccagccccugcacacccuccaccacauccugagccagcugcgcgcgugcauccagccccagccgaccgccgggccccggacccgcggccggcuccaccacuggcugcaccgccugcaggaggcccccaagaaggagucccccggcugccucgaggccagcgucacguucaaccuguuccggcugcucacccgcgaccugaacugcguggccuccggggaccugugcguguga

SEQ ID NO: 4460 - RNA, 591 nt, Artificial Sequence
  derived and/or modified sequence opt2 from IL-28B__Homo_sapiens__AAI30315
augaccggcgacugcaugcccguccucguccucauggccgccguccucaccgucaccggcgccguccccgucgcccgccuccgcggcgcccuccccgacgcccgcggcugccacaucgcccaguucaagucccucuccccccaggagcuccaggccuucaagcgcgccaaggacgcccucgaggagucccuccuccucaaggacugcaagugccgcucccgccucuucccccgcaccugggaccuccgccagcuccagguccgcgagcgccccgucgcccucgaggccgagcucgcccucacccucaagguccucgaggccaccgccgacaccgaccccgcccucggcgacguccucgaccagccccuccacacccuccaccacauccucucccagcuccgcgccugcauccagccccagcccaccgccggcccccgcacccgcggccgccuccaccacuggcuccaccgccuccaggaggcccccaagaaggagucccccggcugccucgaggccuccgucaccuucaaccucuuccgccuccucacccgcgaccucaacugcgucgccuccggcgaccucugcgucuga

SEQ ID NO: 4461 - RNA, 591 nt, Artificial Sequence
  derived and/or modified sequence opt3 from IL-28B__Homo_sapiens__AAI30315
augaccggcgacugcaugcccgugcugguccucauggccgcuguucuuacagugacuggggcaguaccuguggccagacugaggggagcguugccagaugcucgggguugucacaucgcccaguucaagagcuuauccccgcaagagcugcaggcauuuaaacgcgccaaggacgcucuagaagagucucuccugcuuaaagauugcaagugucgaucacgucuguuccccagaacgugggacuugaggcagcuccagguccgggaacgcccuguggcacuggaggccgaacuggcucucaccuuaaaaguucuggaggccacagcggauacugacccagcacuuggcgauguguuggaccaaccccugcauacccuacaccauauucucagucagcugagagccugcauacagccucagccaacagcugggcccaggacccggggacgccuucaccauuggcugcaccgauugcaagaggccccuaagaaggaaagcccaggcugucucgaggcauccgucacuuuuaaccuguucagauuacugacaagggaucucaauugcguggcuucuggugaccuuuguguauga

SEQ ID NO: 4462 - RNA, 591 nt, Artificial Sequence
  derived and/or modified sequence opt4 from IL-28B__Homo_sapiens__AAI30315
augaccggcgacugcaugcccgugcuggugcugauggccgccgugcugaccgugaccggcgccgugcccguggccagacugagaggcgcccugcccgacgccagaggcugccacaucgcccaguucaagagccugagcccccaggagcugcaggccuucaagagagccaaggacgcccuggaggagagccugcugcugaaggacugcaagugcagaagcagacuguuccccagaaccugggaccugagacagcugcaggugagagagagacccguggcccuggaggccgagcuggcccugacccugaaggugcuggaggccaccgccgacaccgaccccgcccugggcgacgugcuggaccagccccugcacacccugcaccacauccugagccagcugagagccugcauccagccccagcccaccgccggccccagaaccagaggcagacugcaccacuggcugcacagacugcaggaggcccccaagaaggagagccccggcugccuggaggccagcgugaccuucaaccuguucagacugcugaccagagaccugaacugcguggccagcggcgaccugugcguguga

SEQ ID NO: 4463 - RNA, 591 nt, Artificial Sequence
  derived and/or modified sequence opt5 from IL-28B__Homo_sapiens__AAI30315
augaccggcgacugcaugcccgugcugguccucauggccgcuguucugacagugacgggggccgugccugucgcgagacuucggggagcucugccggaugcccgcggcugucacaucgcccaguucaagagccucucuccccaagagcugcaggcuuuuaaaagagccaaggacgcucuugaagagucccugcuccugaaagauugcaagugucggagccgccuguucccuagaaccugggaccuccggcagcuucaggugcgcgaaagacccguugcccuggaggcggaacuggcccucacacugaaagugcuugaggcuaccgccgauacagacccugcucugggggauguccucgaccaaccccugcauacccugcaccauauucucucccagcugcgggccugcauccagccucagccgacagcgggaccccgcaccagaggccggcuucaccauuggcugcaccgccuccaagaggccccuaagaaggaaucucccgggugucuggaggcuagcgugacguuuaaccuuuucagacugcucacccgggaucugaauugcguugccuccggagaccuguguguguga

SEQ ID NO: 4464 - RNA, 591 nt, Artificial Sequence
  derived and/or modified sequence opt6 from IL-28B__Homo_sapiens__AAI30315
augacaggagacuguaugccaguacuaguauuaauggcagcaguauuaacaguaacaggagcaguaccaguagcaagacuaagaggagcauuaccagacgcaagaggaugccacauagcacaauucaaaagucuaucaccacaagaacuacaagcauucaaaagagcaaaagacgcacuagaagaaucacuauuacuaaaagacuguaaaugcagaucaagacuauucccaagaacaugggaucuaagacaauuacaaguaagagaaagaccaguagcacuagaagcagaauuagcacuaacauuaaaaguacuagaagcaacagcagacacagaccccgcauuaggagacguacuagaccaaccauuacacacacuacaccacauauuaucacaacuuagagcaugcauacaaccacaaccaacagcaggaccaagaacaagaggaagacuacaccacuggcuacacagacuacaagaagcaccaaaaaaagaaagcccaggaugccuagaagcaucagucacauucaaccucuucagacuacuaacaagagacuuaaacugcguagcauccggagaccuauguguauaa

SEQ ID NO: 4465 - protein, 200 aa, Artificial Sequence
  IL-29__Homo_sapiens__Q8IU54
MAAAWTVVLVTLVLGLAVAGPVPTSKPTTTGKGCHIGRFKSLSPQELASFKKARDALEESLKLKNWSCSSPVFPGNWDLRLLQVRERPVALEAELALTLKVLEAAAGPALEDVLDQPLHTLHHILSQLQACIQPQPTAGPRPRGRLHHWLHRLQEAPKKESAGCLEASVTFNLFRLLTRDLKYVADGNLCLRTSTHPEST

SEQ ID NO: 4466 - RNA, 603 nt, Artificial Sequence
  IL-29__Homo_sapiens__AAH74985
auggcugcagcuuggaccguggugcuggugacuuuggugcuaggcuuggccguggcaggcccuguccccacuuccaagcccaccacaacugggaagggcugccacauuggcagguucaaaucucugucaccacaggagcuagcgagcuucaagaaggccagggacgccuuggaagagucacucaagcugaaaaacuggaguugcagcucuccugucuuccccgggaauugggaccugaggcuucuccaggugagggagcgcccuguggccuuggaggcugagcuggcccugacgcugaagguccuggaggccgcugcuggcccagcccuggaggacguccuagaccagccccuucacacccugcaccacauccucucccagcuccaggccuguauccagccucagcccacagcagggcccaggccccggggccgccuccaccacuggcugcaccggcuccaggaggcccccaaaaaggaguccgcuggcugccuggaggcaucugucaccuucaaccucuuccgccuccucacgcgagaccucaaauauguggccgaugggaaccugugucugagaacgucaacccacccugaguccaccuga

SEQ ID NO: 4467 - RNA, 603 nt, Artificial Sequence
  derived and/or modified sequence opt1 from IL-29__Homo_sapiens__AAH74985
auggccgccgcguggaccgugguccuggugacccucgugcugggccuggccgucgccgggcccgugccgacgagcaagcccaccaccaccggcaaggggugccacaucggccgcuucaagucccucagcccccaggagcuggccuccuucaagaaggcccgggacgcgcuggaggagagccucaagcugaagaacugguccugcagcucccccguguucccggggaacugggaccugcgccuccugcagguccgggagcgccccguggcccuggaggccgagcucgcccugacgcugaaggugcucgaggcggccgccggccccgcccuggaggacguccuggaccagccccuccacacccugcaccacauccugagccagcuccaggccugcauccagccgcagcccaccgcgggcccccggccccgcgggcggcugcaccacuggcugcaccgccuccaggaggccccgaagaaggaguccgccggcugccuggaggccagcgugaccuucaaccuguuccggcuccugacgcgcgaccugaaguacguggccgacgggaaccucugccugcggaccuccacccaccccgagagcaccuga

SEQ ID NO: 4468 - RNA, 603 nt, Artificial Sequence
  derived and/or modified sequence opt2 from IL-29__Homo_sapiens__AAH74985
auggccgccgccuggaccgucguccucgucacccucguccucggccucgccgucgccggccccguccccaccuccaagcccaccaccaccggcaagggcugccacaucggccgcuucaagucccucuccccccaggagcucgccuccuucaagaaggcccgcgacgcccucgaggagucccucaagcucaagaacugguccugcuccucccccgucuuccccggcaacugggaccuccgccuccuccagguccgcgagcgccccgucgcccucgaggccgagcucgcccucacccucaagguccucgaggccgccgccggccccgcccucgaggacguccucgaccagccccuccacacccuccaccacauccucucccagcuccaggccugcauccagccccagcccaccgccggcccccgcccccgcggccgccuccaccacuggcuccaccgccuccaggaggcccccaagaaggaguccgccggcugccucgaggccuccgucaccuucaaccucuuccgccuccucacccgcgaccucaaguacgucgccgacggcaaccucugccuccgcaccuccacccaccccgaguccaccuga

SEQ ID NO: 4469 - RNA, 603 nt, Artificial Sequence
  derived and/or modified sequence opt3 from IL-29__Homo_sapiens__AAH74985
auggccgcugcauggaccgugguccugguuacacucgugcuuggccuggccguagcggggcccgugccuacuagcaagccaacgaccacaggaaaagguugccacaucggcagauucaaguccuugucuccgcaggaguuagcuucauuuaaaaaggccagggacgcacuggaagagagucuaaaacucaagaacuggagcuguuccucucccgucuucccugggaauugggaucugcggcuucugcaagugcgcgaacgaccaguugccuuggaggcugaacucgcacugacucugaaggugcucgaggccgcugccggacccgcguuagaggacguccuggaucagccucuucauaccuugcaccauauucugucgcagcuacaggcaugcauacaaccacagcccacagccggcccucguccaagagguaggcuccaccauuggcugcaccggcuucaggaagcuccgaaaaaggagucagccgggugucuggaagcaagcgugaccuuuaacuuguuccgccuccugacuagagacuuaaaauacguagcugauggaaaucugugccucaggacaaguacccaccccgaguccacguga

SEQ ID NO: 4470 - RNA, 603 nt, Artificial Sequence
  derived and/or modified sequence opt4 from IL-29__Homo_sapiens__AAH74985
auggccgccgccuggaccguggugcuggugacccuggugcugggccuggccguggccggccccgugcccaccagcaagcccaccaccaccggcaagggcugccacaucggcagauucaagagccugagcccccaggagcuggccagcuucaagaaggccagagacgcccuggaggagagccugaagcugaagaacuggagcugcagcagccccguguuccccggcaacugggaccugagacugcugcaggugagagagagacccguggcccuggaggccgagcuggcccugacccugaaggugcuggaggccgccgccggccccgcccuggaggacgugcuggaccagccccugcacacccugcaccacauccugagccagcugcaggccugcauccagccccagcccaccgccggccccagacccagaggcagacugcaccacuggcugcacagacugcaggaggcccccaagaaggagagcgccggcugccuggaggccagcgugaccuucaaccuguucagacugcugaccagagaccugaaguacguggccgacggcaaccugugccugagaaccagcacccaccccgagagcaccuga

SEQ ID NO: 4471 - RNA, 603 nt, Artificial Sequence
  derived and/or modified sequence opt5 from IL-29__Homo_sapiens__AAH74985
auggccgcugccuggaccgugguccugguuacacucgugcugggccuugcgguggcugggcccgucccuacgagcaagccgaccacaaccggaaaaggcugccacaucgggagauucaagucccugucuccccaggagcucgccagcuuuaaaaaggcccgggacgcucuggaagagucccuuaaacugaagaacuggucuuguagcuccccuguguuccccggaaauugggaucuccgccugcugcaaguuagagaacggccuguggcccucgaggcugaacuggcccuuacacugaagguccucgaggcggccgcuggccccgcccuggaggacgugcuugaucagccucugcauacccuccaccauauucugucucagcugcaggcuugcauccaaccgcagcccacagccgggccucgccccagaggacggcuccaccauuggcugcaccgccuucaggaagcgccuaaaaaggagagcgccggcugucuggaggcuuccguuaccuuuaaccucuucagacugcuuacgcgggaccugaaauacguggccgauggcaaucucugccugcgcaccagcacacaccccgaaucuaccuga

SEQ ID NO: 4472 - RNA, 603 nt, Artificial Sequence
  derived and/or modified sequence opt6 from IL-29__Homo_sapiens__AAH74985
auggcagcagcauggacaguaguacuaguaacacuaguauuaggacuagcaguagcaggaccaguaccaacaucaaaaccaacaacaacuggaaaaggaugucacauaggaagauucaaaucauuaucaccacaagaacuagcaaguuucaaaaaagcaagagacgcacuagaagaaucacuaaaauuaaaaaacuggagcugcaguucacccguauucccaggaaacugggaucuaagacuacuacaaguaagagaacgaccaguagcacuagaagcagaacuagcacuaacauuaaaaguauuagaagcagcagccggcccagccuuagaagacguauuagaccaaccacuacauacacuacaccauauacuaucucaacuacaagcaugcauacaaccacaaccaacagcaggaccaagaccacgaggaagacuacaccacugguuacacagacuacaagaagcaccaaaaaaagaaucagcaggauguuuagaagcaucagucacauucaaccuauucagacuacuaacaagagaccuaaaauacguagcagacggaaacuuaugccuaagaaccucaacacaucccgaaucaacauaa

SEQ ID NO: 4473 - protein, 153 aa, Artificial Sequence
  IL-2__Homo_sapiens__P60568
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 4474 - RNA, 462 nt, Artificial Sequence
  IL-2__Homo_sapiens__AAA98792
auguacaggaugcaacuccugucuugcauugcacuaagucuugcacuugucacaaacagugcaccuacuucaaguucuacaaagaaaacacagcuacaacuggagcauuuacugcuggauuuacagaugauuuugaauggaauuaauaauuacaagaaucccaaacucaccaggaugcucacauuuaaguuuuacaugcccaagaaggccacagaacugaaacaucuucagugucuagaagaagaacucaaaccucuggaggaagugcuaaauuuagcucaaagcaaaaacuuucacuuaagacccagggacuuaaucagcaauaucaacguaauaguucuggaacuaaagggaucugaaacaacauucaugugugaauaugcugaugagacagcaaccauuguagaauuucugaacagauggauuaccuuuugucaaagcaucaucucaacacugacuuga

SEQ ID NO: 4475 - RNA, 462 nt, Artificial Sequence
  derived and/or modified sequence opt1 from IL-2__Homo_sapiens__AAA98792
auguaccgcaugcagcugcucagcugcaucgcccugucccuggcccucgugaccaacagcgcgcccaccuccagcuccacgaagaagacccagcugcagcuggagcaccuccugcuggaccuccagaugauccugaacggcaucaacaacuacaagaacccgaagcugacccggaugcucaccuucaaguucuacaugcccaagaaggccacggagcugaagcaccuccagugccuggaggaggagcugaagccccuggaggagguccucaaccuggcccagagcaagaacuuccaccuccgcccccgggaccugaucuccaacaucaacgugaucgugcuggagcugaaggggagcgagaccaccuucaugugcgaguacgccgacgagaccgccacgaucgucgaguuccucaaccgcuggaucaccuucugccaguccaucaucagcacccugaccuga

SEQ ID NO: 4476 - RNA, 462 nt, Artificial Sequence
  derived and/or modified sequence opt2 from IL-2__Homo_sapiens__AAA98792
auguaccgcaugcagcuccucuccugcaucgcccucucccucgcccucgucaccaacuccgcccccaccuccuccuccaccaagaagacccagcuccagcucgagcaccuccuccucgaccuccagaugauccucaacggcaucaacaacuacaagaaccccaagcucacccgcaugcucaccuucaaguucuacaugcccaagaaggccaccgagcucaagcaccuccagugccucgaggaggagcucaagccccucgaggagguccucaaccucgcccaguccaagaacuuccaccuccgcccccgcgaccucaucuccaacaucaacgucaucguccucgagcucaagggcuccgagaccaccuucaugugcgaguacgccgacgagaccgccaccaucgucgaguuccucaaccgcuggaucaccuucugccaguccaucaucuccacccucaccuga

SEQ ID NO: 4477 - RNA, 462 nt, Artificial Sequence
  derived and/or modified sequence opt3 from IL-2__Homo_sapiens__AAA98792
auguacagaaugcagcugcucagcugcaucgcccuuucccuggcuuuggugaccaacucugcacccacaucaaguagcacuaagaaaacgcaauuacagcuggagcaccuacuccuggaccuucagaugauucugaauggcauaaacaauuauaagaacccuaaauugaccaggaugcucacauucaaguuuuacaugccgaaaaaggccacugaacugaagcaucugcagugucucgaggaagaguuaaaaccacuggaagagguccuuaauuuggcgcaauccaagaacuuccaccuacggccccgcgaucugaucucuaauauuaacguuaucgugcucgagcugaaagggucggaaaccacauuuaugugcgaguaugcugacgaaaccgccacuauuguagaguuccuuaaucgauggaucacauuuugucagucaauaaucagcacccugacguga

SEQ ID NO: 4478 - RNA, 462 nt, Artificial Sequence
  derived and/or modified sequence opt4 from IL-2__Homo_sapiens__AAA98792
auguacagaaugcagcugcugagcugcaucgcccugagccuggcccuggugaccaacagcgcccccaccagcagcagcaccaagaagacccagcugcagcuggagcaccugcugcuggaccugcagaugauccugaacggcaucaacaacuacaagaaccccaagcugaccagaaugcugaccuucaaguucuacaugcccaagaaggccaccgagcugaagcaccugcagugccuggaggaggagcugaagccccuggaggaggugcugaaccuggcccagagcaagaacuuccaccugagacccagagaccugaucagcaacaucaacgugaucgugcuggagcugaagggcagcgagaccaccuucaugugcgaguacgccgacgagaccgccaccaucguggaguuccugaacagauggaucaccuucugccagagcaucaucagcacccugaccuga

SEQ ID NO: 4479 - RNA, 462 nt, Artificial Sequence
  derived and/or modified sequence opt5 from IL-2__Homo_sapiens__AAA98792
auguacagaaugcagcugcucagcugcaucgcccugucccuugcucuggugaccaacucugcccccacaagcuccucuacgaagaaaacccaacuccagcuggagcaccuucugcucgaccugcagaugauucugaauggcaucaacaauuauaagaacccuaaacucacacggaugcugaccuucaaguuuuacaugccgaaaaaggcgacagaacuuaagcaucugcagugucucgaggaggaacugaaaccccuugaagagguccugaaucucgcucaaagcaagaacuuccaccuccgcccuagagaucugauuuccaauaucaacguuauugugcuggagcugaaagggucugaaaccacauuuaugugcgaguaugccgacgaaaccgccacgaucguggaguuccuuaaucgguggaucaccuuuugucagagcauuaucuccacacugaccuga

SEQ ID NO: 4480 - RNA, 462 nt, Artificial Sequence
  derived and/or modified sequence opt6 from IL-2__Homo_sapiens__AAA98792
auguacagaaugcaacuacuaucaugcauagcacuaucacuagcacuaguaacaaacucagcaccaacaucaucaucaaccaaaaaaacacaacuacaacucgaacaccuccuccucgaccuacaaaugauacuaaacggaauaaacaacuacaaaaacccaaaacuaacaagaaugcuaacauucaaauucuacaugccaaaaaaagcaacagaacuaaaacaccuacaaugccuagaagaagaacucaaaccacuagaagaaguacuaaaccucgcacaaucaaaaaacuuccaccuacgaccaagagaccuaauaucaaacauaaacgucauaguacuagaacuaaaaggaucagaaacaacauucaugugcgaauaugcagacgaaacagcaacaauaguagaauuccuaaacagauggauaacauucugccaaucaauaauaucaacacuaacauaa

SEQ ID NO: 4481 - protein, 153 aa, Artificial Sequence; identical to SEQ ID NO: 4473
  IL-2__Homo_sapiens__Q0GK43

SEQ ID NO: 4482 - RNA, 462 nt, Artificial Sequence; identical to SEQ ID NO: 4474
  IL-2__Homo_sapiens__ABI20697

SEQ ID NO: 4483 - RNA, 462 nt, Artificial Sequence; identical to SEQ ID NO: 4475
  derived and/or modified sequence opt1 from IL-2__Homo_sapiens__ABI20697

SEQ ID NO: 4484 - RNA, 462 nt, Artificial Sequence; identical to SEQ ID NO: 4476
  derived and/or modified sequence opt2 from IL-2__Homo_sapiens__ABI20697

SEQ ID NO: 4485 - RNA, 462 nt, Artificial Sequence; identical to SEQ ID NO: 4477
  derived and/or modified sequence opt3 from IL-2__Homo_sapiens__ABI20697

SEQ ID NO: 4486 - RNA, 462 nt, Artificial Sequence; identical to SEQ ID NO: 4478
  derived and/or modified sequence opt4 from IL-2__Homo_sapiens__ABI20697

SEQ ID NO: 4487 - RNA, 462 nt, Artificial Sequence; identical to SEQ ID NO: 4479
  derived and/or modified sequence opt5 from IL-2__Homo_sapiens__ABI20697

SEQ ID NO: 4488 - RNA, 462 nt, Artificial Sequence
  derived and/or modified sequence opt6 from IL-2__Homo_sapiens__ABI20697
auguacagaaugcaacuccuaucaugcauagcacucucacuagcacucguaacaaacucagcaccaacaucaucaucaacaaaaaaaacacaacuccaacuagaacaccuacuacuagaccuacaaaugauacuaaacggaauaaacaacuacaaaaacccaaaacuaacaagaaugcuaaccuucaaauucuacaugccaaaaaaagcaacagaacuaaaacaccuccaaugccuagaagaagaacucaaaccacuagaagaaguacuaaaccuagcacaaucaaaaaacuuccaccuaagaccaagagaccuaauaucaaacauaaacgucauaguacucgaacuaaaaggaucagaaacaacauucaugugcgaauacgccgacgaaacagcaacaauaguagaauuccuaaacagauggauaacauucugccaaucaauaauaucaacacuaacauaa

SEQ ID NO: 4489 - protein, 156 aa, Artificial Sequence
  IL-2__Homo_sapiens__Q13169
MYRMQLLSCIALILALVTNSAPTSSSTKKTKKTQLQLEHLLLDLQMILNGINNYKNPKLTRMLTFKFYMPKKATELKQLQCLEEELKPLEEVLNLAQSKNFHLRPRDLISNINVIVLELKGSETTFMCEYADETATIVEFLNRWITFCQSIISTLT

SEQ ID NO: 4490 - RNA, 471 nt, Artificial Sequence
  IL-2__Homo_sapiens__AAA70092
auguacaggaugcaacuccugucuugcauugcacuaauucuugcacuugucacaaacagugcaccuacuucaaguucgacaaagaaaacaaagaaaacacagcuacaacuggagcauuuacugcuggauuuacagaugauuuugaauggaauuaauaauuacaagaaucccaaacucaccaggaugcucacauuuaaguuuuacaugcccaagaaggccacagaacugaaacagcuucagugucuagaagaagaacucaaaccucuggaggaagugcugaauuuagcucaaagcaaaaacuuucacuuaagacccagggacuuaaucagcaauaucaacguaauaguucuggaacuaaagggaucugaaacaacauucaugugugaauaugcagaugagacagcaaccauuguagaauuucugaacagauggauuaccuuuugucaaagcaucaucucaacacuaacuuga

SEQ ID NO: 4491 - RNA, 471 nt, Artificial Sequence
  derived and/or modified sequence opt1 from IL-2__Homo_sapiens__AAA70092
auguaccgcaugcagcugcucagcugcaucgcccugauccuggcccucgugaccaacuccgcgcccaccagcuccagcacgaagaagaccaagaagacccagcugcagcuggagcaccuccugcuggaccuccagaugauccugaacggcaucaacaacuacaagaacccgaagcugacccggaugcucacguucaaguucuacaugcccaagaaggccaccgagcugaagcagcugcagugccucgaggaggagcugaagccccuggaggagguccucaaccuggcccaguccaagaacuuccaccuccgcccccgggaccugaucagcaacaucaacgugaucgugcuggagcugaagggguccgagaccaccuucaugugcgaguacgccgacgagacggccaccaucgucgaguuccucaaccgcuggaucaccuucugccagagcaucaucuccacccugacguga

SEQ ID NO: 4492 - RNA, 471 nt, Artificial Sequence
  derived and/or modified sequence opt2 from IL-2__Homo_sapiens__AAA70092
auguaccgcaugcagcuccucuccugcaucgcccucauccucgcccucgucaccaacuccgcccccaccuccuccuccaccaagaagaccaagaagacccagcuccagcucgagcaccuccuccucgaccuccagaugauccucaacggcaucaacaacuacaagaaccccaagcucacccgcaugcucaccuucaaguucuacaugcccaagaaggccaccgagcucaagcagcuccagugccucgaggaggagcucaagccccucgaggagguccucaaccucgcccaguccaagaacuuccaccuccgcccccgcgaccucaucuccaacaucaacgucaucguccucgagcucaagggcuccgagaccaccuucaugugcgaguacgccgacgagaccgccaccaucgucgaguuccucaaccgcuggaucaccuucugccaguccaucaucuccacccucaccuga

SEQ ID NO: 4493 - RNA, 471 nt, Artificial Sequence
  derived and/or modified sequence opt3 from IL-2__Homo_sapiens__AAA70092
auguacagaaugcagcugcucagcugcaucgcccuuauucuggcuuuggugaccaacuccgcacccacaucuucaaguacuaagaaaacgaagaaaacccaauuacagcuggagcaccuacuccuggaccuucagaugauacugaauggcaucaacaauuauaagaacccuaaauugacaaggaugcucacuuucaaguuuuacaugccaaagaaagccaccgaacugaagcagcugcaaugucucgaggaagaguuaaaaccgcuggaagagguccuuaauuuggcgcagagcaagaacuuccaucugcggccccgcgaucuaauuuccaauaucaacguuauugugcucgagcugaaagggucugaaacaaccuuuaugugcgaguaugcugacgaaacugccacaaucguagaguuccuuaaucgauggauaaccuuuugucagucgaucauuucaacgcugacuuga

SEQ ID NO: 4494 - RNA, 471 nt, Artificial Sequence
  derived and/or modified sequence opt4 from IL-2__Homo_sapiens__AAA70092
auguacagaaugcagcugcugagcugcaucgcccugauccuggcccuggugaccaacagcgcccccaccagcagcagcaccaagaagaccaagaagacccagcugcagcuggagcaccugcugcuggaccugcagaugauccugaacggcaucaacaacuacaagaaccccaagcugaccagaaugcugaccuucaaguucuacaugcccaagaaggccaccgagcugaagcagcugcagugccuggaggaggagcugaagccccuggaggaggugcugaaccuggcccagagcaagaacuuccaccugagacccagagaccugaucagcaacaucaacgugaucgugcuggagcugaagggcagcgagaccaccuucaugugcgaguacgccgacgagaccgccaccaucguggaguuccugaacagauggaucaccuucugccagagcaucaucagcacccugaccuga

SEQ ID NO: 4495 - RNA, 471 nt, Artificial Sequence
  derived and/or modified sequence opt5 from IL-2__Homo_sapiens__AAA70092
auguacagaaugcagcugcucagcugcaucgcccugauucuugcucuggugaccaacuccgcccccacaucuagcuccacgaagaaaaccaagaaaacacaacuccagcuggagcaccuucugcucgaccugcagaugauccugaauggcauuaacaauuauaagaacccuaaacucacccggaugcugacauucaaguuuuacaugccgaagaaagcgaccgaacuuaagcagcugcaaugucucgaggaggaacugaaaccccuugaagagguccugaaucucgcucagucuaagaacuuccaucugcgcccuagagaucugaucagcaauauuaacguuaucgugcucgagcugaaaggguccgaaacaaccuuuaugugcgaguaugccgacgaaacggccaccaucguggaguuccuuaaucgguggauuacauuuugucagucuaucauuagcacccugacauga

SEQ ID NO: 4496 - RNA, 471 nt, Artificial Sequence
  derived and/or modified sequence opt6 from IL-2__Homo_sapiens__AAA70092
auguacagaaugcaacuacuaucaugcauagcacuaauacuagcacuaguaaccaacucagcaccaacaucaucaucaacaaaaaaaaccaaaaaaacacaacuacaacuagaacaccuacuacuagaccuacaaaugauacucaacggaauaaacaacuacaaaaaccccaaacuaacaagaaugcuaacauucaaauucuacaugccaaaaaaagcaacagaacuaaaacaacuacaaugcuuagaagaagaacuaaaaccacuagaagaaguacuaaaccuagcccaaucaaaaaacuuccaccuaagaccaagagaccucauaucaaacauaaacguaauaguacuagaacuaaaaggaucagaaacaacauucaugugcgaauacgcagacgaaaccgcaacaauaguagaauuccuaaacagauggauaacauucugccaaucaauaauaucaacauuaacauaa

SEQ ID NO: 4497 - protein, 153 aa, Artificial Sequence [sequence omitted]

SEQ ID NO: 4498 - RNA, 462 nt, Artificial Sequence
  IL-2__Homo_sapiens__AAH66256
auguacaggaugcaacuccugucuugcauugcacuaagucuugcacuugucacaaacagugcacuuacuucaaguucuacaaagaaaacacagcuacaacuggagcauuuacugcuggauuuacagaugauuuugaauggaauuaauaauuacaagaaucccaaacucaccaggaugcucacauuuaaguuuuacaugcccaagaaggccacagaacugaaacaucuucagugucuagaagaagaacucaaaccucuggaggaagugcuaaauuuagcucaaagcaaaaacuuucacuuaagacccagggacuuaaucagcaauaucaacguaauaguucuggaacuaaagggaucugaaacaacauucaugugugaauaugcugaugagacagcaaccauuguagaauuucugaacagauggauuaccuuuugucaaagcaucaucucaacacugacuuga

SEQ ID NO: 4499 - RNA, 462 nt, Artificial Sequence
  derived and/or modified sequence opt1 from IL-2__Homo_sapiens__AAH66256
auguaccgcaugcagcugcucagcugcaucgcccugucccuggcccucgugaccaacagcgcgcugaccuccagcuccacgaagaagacccagcugcagcucgagcaccuccugcuggaccugcagaugauccugaacggcaucaacaacuacaagaaccccaagcucacccggaugcugaccuucaaguucuacaugccgaagaaggccacggagcugaagcaccuccagugccuggaggaggagcugaagccccucgaggagguccugaaccuggcccagagcaagaacuuccaccuccgcccccgggaccugaucuccaacaucaacgugaucgugcuggagcucaaggggagcgagaccaccuucaugugcgaguacgccgacgagaccgccacgaucgucgaguuccugaaccgcuggaucaccuucugccaguccaucaucagcacccugaccuga

SEQ ID NO: 4500 - RNA, 462 nt, Artificial Sequence
  derived and/or modified sequence opt2 from IL-2__Homo_sapiens__AAH66256
auguaccgcaugcagcuccucuccugcaucgcccucucccucgcccucgucaccaacuccgcccucaccuccuccuccaccaagaagacccagcuccagcucgagcaccuccuccucgaccuccagaugauccucaacggcaucaacaacuacaagaaccccaagcucacccgcaugcucaccuucaaguucuacaugcccaagaaggccaccgagcucaagcaccuccagugccucgaggaggagcucaagccccucgaggagguccucaaccucgcccaguccaagaacuuccaccuccgcccccgcgaccucaucuccaacaucaacgucaucguccucgagcucaagggcuccgagaccaccuucaugugcgaguacgccgacgagaccgccaccaucgucgaguuccucaaccgcuggaucaccuucugccaguccaucaucuccacccucaccuga

SEQ ID NO: 4501 - RNA, 462 nt, Artificial Sequence
  derived and/or modified sequence opt3 from IL-2__Homo_sapiens__AAH66256
auguacagaaugcagcugcucagcugcaucgcccuuucccuggcuuuggugaccaacucugcauuaacaucaaguagcacuaagaaaacgcaacugcagcuagagcaccuccugcuugaccugcagaugauuuugaauggcauaaacaauuauaagaaccccaaacucaccaggaugcugacauucaaguuuuacaugccuaaaaaggccacugaacugaagcaucuccaguguuuagaggaggaacugaaaccacuugaagaggucuugaaucuggcgcaauccaagaacuuccaccuacggccgcgcgaucucaucucuaauauuaacguuaucgugcuggagcuuaaagggucggaaaccacauuuaugugcgaguaugcugacgaaaccgccacuauuguagaguuccugaaucgauggaucacauuuugucagucaauaaucagcaccuugacguga

SEQ ID NO: 4502 - RNA, 462 nt, Artificial Sequence
  derived and/or modified sequence opt4 from IL-2__Homo_sapiens__AAH66256
auguacagaaugcagcugcugagcugcaucgcccugagccuggcccuggugaccaacagcgcccugaccagcagcagcaccaagaagacccagcugcagcuggagcaccugcugcuggaccugcagaugauccugaacggcaucaacaacuacaagaaccccaagcugaccagaaugcugaccuucaaguucuacaugcccaagaaggccaccgagcugaagcaccugcagugccuggaggaggagcugaagccccuggaggaggugcugaaccuggcccagagcaagaacuuccaccugagacccagagaccugaucagcaacaucaacgugaucgugcuggagcugaagggcagcgagaccaccuucaugugcgaguacgccgacgagaccgccaccaucguggaguuccugaacagauggaucaccuucugccagagcaucaucagcacccugaccuga

SEQ ID NO: 4503 - RNA, 462 nt, Artificial Sequence
  derived and/or modified sequence opt5 from IL-2__Homo_sapiens__AAH66256
auguacagaaugcagcugcucagcugcaucgcccugucccuugcucuggugaccaacucugcccucacaagcuccucuacgaagaaaacccaacugcagcuugagcaccuccugcuggaccugcagaugauucucaauggcaucaacaauuauaagaaccccaaacugacacggaugcuuaccuucaaguuuuacaugccuaaaaaggcgacagaacugaagcaccuccagugucuggaggaggaacuuaaaccgcuggaagagguccucaaucuggcucaaagcaagaacuuccaucugcgccccagagaucucauuuccaauaucaacguuauugugcuggagcuuaaagggucugaaaccacauuuaugugcgaguaugccgacgaaaccgccacgaucguggaguuccugaaucgguggaucaccuuuugucagagcauuaucuccacacucaccuga

SEQ ID NO: 4504 - RNA, 462 nt, Artificial Sequence
  derived and/or modified sequence opt6 from IL-2__Homo_sapiens__AAH66256
auguaccgaaugcaacuacuaucaugcauagcacuaucccuagccuuaguaacaaacucagcacuaacaucauccuccacaaaaaaaacacaacuacaacuagaacaccuacuccuagaccuacaaaugauacuaaacggaauaaacaacuacaaaaacccaaaacucacaagaaugcuaacauucaaauucuacaugccaaaaaaagcaacagaacuaaaacaccuacaaugccuagaagaagaacuaaaaccacuagaagaaguacuaaaccuagcacaaucaaaaaacuuccaccuaagaccaagagaccuaauaucaaacauaaacguaauaguacuagaacuaaaaggaucagaaacaacauucaugugcgaauacgcagacgaaacagcaacaauaguagaauuccuaaaccgauggauaacauucugccaaucaauaauaucaacacuaacauaa

SEQ ID NO: 4505 - protein, 153 aa, Artificial Sequence [sequence omitted]

SEQ ID NO: 4506 - RNA, 462 nt, Artificial Sequence
  IL-2__Homo_sapiens__AAH66254
auguacaggaugcaacuccugucuugcauugcacuaagucuugcacuugucgcaaacagugcaccuacuucaaguucuacaaagaaaacacagcuacaacuggagcauuuacugcuggauuuacagaugauuuugaauggaauuaauaauuacaagaaucccaaacucaccaggaugcucacauuuaaguuuuacaugcccaagaaggccacagaacugaaacaucuucagugucuagaagaagaacucaaaccucuggaggaagugcuaaauuuagcucaaagcaaaaacuuucacuuaagacccagggacuuaaucagcaauaucaacguaauaguucuggaacuaaagggaucugaaacaacauucaugugugaauaugcugaugagacagcaaccauuguagaauuucugaacagauggauuaccuuuugucaaagcaucaucucaacacugacuuga

SEQ ID NO: 4507 - RNA, 462 nt, Artificial Sequence
  derived and/or modified sequence opt1 from IL-2__Homo_sapiens__AAH66254
auguaccgcaugcagcugcucagcugcaucgcccugucccuggcccucguggcgaacagcgcccccaccuccagcuccaccaagaagacgcagcugcagcuggagcaccuccugcuggaccuccagaugauccugaacggcaucaacaacuacaagaacccgaagcugacccggaugcucaccuucaaguucuacaugcccaagaaggccaccgagcugaagcaccuccagugccuggaggaggagcugaagccccuggaggagguccucaaccuggcccagagcaagaacuuccaccuccgcccccgggaccugaucuccaacaucaacgugaucgugcuggagcugaaggggagcgagacgaccuucaugugcgaguacgccgacgagaccgcgaccaucgucgaguuccucaaccgcuggaucacguucugccaguccaucaucagcacccugaccuga

SEQ ID NO: 4508 - RNA, 462 nt, Artificial Sequence
  derived and/or modified sequence opt2 from IL-2__Homo_sapiens__AAH66254
auguaccgcaugcagcuccucuccugcaucgcccucucccucgcccucgucgccaacuccgcccccaccuccuccuccaccaagaagacccagcuccagcucgagcaccuccuccucgaccuccagaugauccucaacggcaucaacaacuacaagaaccccaagcucacccgcaugcucaccuucaaguucuacaugcccaagaaggccaccgagcucaagcaccuccagugccucgaggaggagcucaagccccucgaggagguccucaaccucgcccaguccaagaacuuccaccuccgcccccgcgaccucaucuccaacaucaacgucaucguccucgagcucaagggcuccgagaccaccuucaugugcgaguacgccgacgagaccgccaccaucgucgaguuccucaaccgcuggaucaccuucugccaguccaucaucuccacccucaccuga

SEQ ID NO: 4509 - RNA, 462 nt, Artificial Sequence
  derived and/or modified sequence opt3 from IL-2__Homo_sapiens__AAH66254
auguacagaaugcagcugcucagcugcaucgcccuuucccuggcuuugguggcaaacucugcccccaccucaaguagcacaaagaaaacucaauuacagcuggagcaccuacuccuggaccuucagaugauucugaauggcauaaacaauuauaagaacccuaaauugacgaggaugcucaccuucaaguuuuacaugccgaaaaaggcgacagaacugaagcaucugcagugucucgaggaagaguuaaaaccacuggaagagguccuuaauuuggcucaauccaagaacuuccaccuacggccccgcgaucugaucucuaauauuaacguuaucgugcucgagcugaaagggucggaaacuaccuuuaugugcgaguaugccgacgaaacagcaaccauuguagaguuccuuaaucgauggaucacuuuuugucagucaauaaucagcacacugaccuga

SEQ ID NO: 4510 - RNA, 462 nt, Artificial Sequence
  derived and/or modified sequence opt4 from IL-2__Homo_sapiens__AAH66254
auguacagaaugcagcugcugagcugcaucgcccugagccuggcccugguggccaacagcgcccccaccagcagcagcaccaagaagacccagcugcagcuggagcaccugcugcuggaccugcagaugauccugaacggcaucaacaacuacaagaaccccaagcugaccagaaugcugaccuucaaguucuacaugcccaagaaggccaccgagcugaagcaccugcagugccuggaggaggagcugaagccccuggaggaggugcugaaccuggcccagagcaagaacuuccaccugagacccagagaccugaucagcaacaucaacgugaucgugcuggagcugaagggcagcgagaccaccuucaugugcgaguacgccgacgagaccgccaccaucguggaguuccugaacagauggaucaccuucugccagagcaucaucagcacccugaccuga

SEQ ID NO: 4511 - RNA, 462 nt, Artificial Sequence
  derived and/or modified sequence opt5 from IL-2__Homo_sapiens__AAH66254
auguacagaaugcagcugcucagcugcaucgcccugucccuugcucugguggccaacucugcgcccaccagcuccucuacaaagaaaacgcaacuccagcuggagcaccuucugcucgaccugcagaugauucugaauggcaucaacaauuauaagaacccuaaacucacccggaugcugacauucaaguuuuacaugccgaaaaaggcuaccgaacuuaagcaucugcagugucucgaggaggaacugaaaccccuugaagagguccugaaucucgcccaaagcaagaacuuccaccuccgcccuagagaucugauuuccaauaucaacguuauugugcuggagcugaaagggucugaaacaaccuuuaugugcgaguaugccgacgaaacagcuaccaucguggaguuccuuaaucgguggaucacguuuugucagagcauuaucuccacccugacauga

SEQ ID NO: 4512 - RNA, 462 nt, Artificial Sequence
  derived and/or modified sequence opt6 from IL-2__Homo_sapiens__AAH66254
auguacagaaugcaacuacuaucaugcauagcacucucacuagcacuaguagcaaacucagcaccaacaucaucaucaacaaaaaaaacacaacuacaacuagaacaccuacuacuagaccuacaaaugauccuaaacggaauaaacaacuacaaaaacccaaaacuaacaagaaugcuaacauucaaauucuacaugcccaaaaaagcaacagaacuaaaacaccuacaaugccuagaagaagaacuaaaaccacuagaagaaguacuaaaccuagcacaauccaaaaacuuccaccuaagaccaagagaccuaauaucaaacauaaacguaauaguacuagaacuaaaaggaucagaaacaacauucaugugcgaauacgcagacgaaacagccacaauaguagaauuccuaaacagauggauaacauucugccaaucaauaauaucaacacuaaccuaa

SEQ ID NO: 4513 - protein, 164 aa, Artificial Sequence
  IL-31__Homo_sapiens__Q6EBC2
MASHSGPSTSVLFLFCCLGGWLASHTLPVRLLRPSDDVQKIVEELQSLSKMLLKDVEEEKGVLVSQNYTLPCLSPDAQPPNNIHSPAIRAYLKTIRQLDNKSVIDEIIEHLDKLIFQDAPETNISVPTDTHECKRFILTISQQFSECMDLALKSLTSGAQQATT

SEQ ID NO: 4514 - RNA, 495 nt, Artificial Sequence
  IL-31__Homo_sapiens__AAI32999
auggccucucacucaggccccucgacgucugugcucuuucuguucugcugccugggaggcuggcuggccucccacacguugcccguccguuuacuacgaccaagugaugauguacagaaaauagucgaggaauuacagucccucucgaagaugcuuuugaaagauguggaggaagagaagggcgugcucgugucccagaauuacacgcugccgugucucagcccugacgcccagccgccaaacaacauccacagcccagccauccgggcauaucucaagacaaucagacagcuagacaacaaaucuguuauugaugagaucauagagcaccucgacaaacucauauuucaagaugcaccagaaacaaacauuucugugccaacagacacccaugaauguaaacgcuucauccugacuauuucucaacaguuuucagagugcauggaccucgcacuaaaaucauugaccucuggagcccaacaggccaccacuuaa

SEQ ID NO: 4515 - RNA, 495 nt, Artificial Sequence
  derived and/or modified sequence opt1 from IL-31__Homo_sapiens__AAI32999
auggccagccacuccggccccagcaccuccgugcuguuccucuucugcugccucgggggcuggcuggccagccacacccugccgguccgccugcugcggcccuccgacgacgugcagaagaucguggaggagcuccagagccuguccaagaugcugcucaaggacgucgaggaggagaagggggugcuggugagccagaacuacacgcugcccugccucucccccgacgcgcagccgcccaacaacauccacagccccgccauccgcgccuaccugaagaccauccggcagcuggacaacaaguccgucaucgacgagaucaucgagcaccucgacaagcugaucuuccaggacgcccccgagaccaacaucagcgugccgaccgacacgcacgagugcaagcgcuucauccugaccaucucccagcaguucagcgagugcauggaccucgcccugaagucccugaccagcggcgcgcagcaggccaccacguga

SEQ ID NO: 4516 - RNA, 495 nt, Artificial Sequence
  derived and/or modified sequence opt2 from IL-31__Homo_sapiens__AAI32999
auggccucccacuccggccccuccaccuccguccucuuccucuucugcugccucggcggcuggcucgccucccacacccuccccguccgccuccuccgccccuccgacgacguccagaagaucgucgaggagcuccagucccucuccaagaugcuccucaaggacgucgaggaggagaagggcguccucgucucccagaacuacacccuccccugccucucccccgacgcccagccccccaacaacauccacucccccgccauccgcgccuaccucaagaccauccgccagcucgacaacaaguccgucaucgacgagaucaucgagcaccucgacaagcucaucuuccaggacgcccccgagaccaacaucuccguccccaccgacacccacgagugcaagcgcuucauccucaccaucucccagcaguucuccgagugcauggaccucgcccucaagucccucaccuccggcgcccagcaggccaccaccuga

SEQ ID NO: 4517 - RNA, 495 nt, Artificial Sequence
  derived and/or modified sequence opt3 from IL-31__Homo_sapiens__AAI32999
auggccagccacuccggccccucuaccucagugcuguuccucuuuugcugucuugggggauggcuggcuagucauacauugccugucagauuacugaggccaagcgacgauguucagaagaucguggaggaacuacaaucccucucuaaaaugcugcuuaaggacguagaggaagagaaaggugugcuggucucgcagaacuacacuuugccgugccucucacccgaugcacagccuccaaauaacauucacagccccgccauacgggcguaucugaagacgauccgccagcuggacaauaaaagugugauugaugaaaucauugagcaucucgacaaguuaaucuuccaagaugcuccugagaccaacauauccguuccaacagacacucacgaauguaagcgauuuauccugaccauuucucagcaguucagcgagugcauggaucuugccuugaaaucccugacaucaggcgcacagcaagccaccacuuga

SEQ ID NO: 4518 - RNA, 495 nt, Artificial Sequence
  derived and/or modified sequence opt4 from IL-31__Homo_sapiens__AAI32999
auggccagccacagcggccccagcaccagcgugcuguuccuguucugcugccugggcggcuggcuggccagccacacccugcccgugagacugcugagacccagcgacgacgugcagaagaucguggaggagcugcagagccugagcaagaugcugcugaaggacguggaggaggagaagggcgugcuggugagccagaacuacacccugcccugccugagccccgacgcccagccccccaacaacauccacagccccgccaucagagccuaccugaagaccaucagacagcuggacaacaagagcgugaucgacgagaucaucgagcaccuggacaagcugaucuuccaggacgcccccgagaccaacaucagcgugcccaccgacacccacgagugcaagagauucauccugaccaucagccagcaguucagcgagugcauggaccuggcccugaagagccugaccagcggcgcccagcaggccaccaccuga

SEQ ID NO: 4519 - RNA, 495 nt, Artificial Sequence
  derived and/or modified sequence opt5 from IL-31__Homo_sapiens__AAI32999
auggccagccacuccggccccucuaccagcgugcuguuccucuuuugcugucuugggggauggcuggcuucccauacacugccugucagacuccugcggccgucugacgauguucagaagaucguggaggaacuucaaagccuguccaaaaugcuccugaaggacguggaggaagagaaaggcguccuggugucucagaacuacacgcuccccugccugagcccugaugcccagcccccuaauaacauucacucccccgcgauccgcgcuuaucuuaagaccauuagacagcuggacaauaaaagcguuaucgaugaaauuaucgagcaucucgacaagcugaucuuccaagaugccccugagacaaacauuucugugccgaccgacacacacgaauguaagcgguuuauccuuaccauuucccagcaguucagcgagugcauggaucuggcccucaaaucucugacauccggggcucagcaagccaccacguga

SEQ ID NO: 4520 - RNA, 495 nt, Artificial Sequence
  derived and/or modified sequence opt6 from IL-31__Homo_sapiens__AAI32999
auggcaucacacucaggaccaucaaccucaguauuauuccuauucugcugcuuaggaggauggcucgcaucacacacacuaccaguaagacuacuaagaccauccgacgacguacaaaaaauaguagaagaacuacaaucacuaucaaaaaugcuacucaaagacguagaagaagaaaaaggaguacuaguaucacaaaacuacacacuaccaugccuaucaccagacgcacaaccaccaaacaacauacacuccccagcaauaagagcauacuuaaaaacaauaagacaacuagacaacaaaucaguaauagacgaaauaauagaacaccuagacaaacuaauauuccaagacgcaccagaaacaaacauaucuguaccaacagacacacacgaaugcaaaagauucauacuaacaauaucacaacaauucucagaauguauggacuuagcacuaaaauccuuaacaucaggagcacaacaagcaacaacauaa

SEQ ID NO: 4521 - protein, 234 aa, Artificial Sequence
  IL-32__Homo_sapiens__P24001
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 4522 - RNA, 705 nt, Artificial Sequence
  IL-32__Homo_sapiens__AAH09401
augugcuucccgaagguccucucugaugacaugaagaagcugaaggcccgaaugguaaugcuccucccuacuucugcucagggguugggggccugggucucagcgugugacacugaggacacugugggacaccugggacccuggagggacaaggauccggcccuuuggugccaacucugccucucuucacagcaccaggccauagaaagauuuuaugauaaaaugcaaaaugcagaaucaggacguggacaggugaugucgagccuggcagagcuggaggacgacuucaaagagggcuaccuggagacaguggcggcuuauuaugaggagcagcacccagagcucacuccucuacuugaaaaagaaagagauggauuacggugccgaggcaacagauccccugucccggauguugaggaucccgcaaccgaggagccuggggagagcuuuugugacaaggucaugagaugguuccaggccaugcugcagcggcugcagaccugguggcacgggguucuggccugggugaaggagaaggugguggcccugguccaugcagugcaggcccucuggaaacaguuccagaguuucugcugcucucugucagagcucuucauguccucuuuccaguccuacggagccccacggggggacaaggaggagcugacaccccagaagugcucugaaccccaauccucaaaauga

SEQ ID NO: 4523 - RNA, 705 nt, Artificial Sequence
  derived and/or modified sequence opt1 from IL-32__Homo_sapiens__AAH09401
augugcuuccccaaggugcugagcgacgacaugaagaagcucaaggcccgcauggucaugcugcugccgaccuccgcccagggccucggggcgugggugagcgccugcgacaccgaggacaccgugggccaccuggggcccuggcgggacaaggaccccgcccuguggugccagcucugccuguccagccagcaccaggccaucgagcgcuucuacgacaagaugcagaacgccgaguccggccgggggcaggucaugagcucccuggcggagcucgaggacgacuucaaggagggcuaccuggagaccguggccgccuacuacgaggagcagcaccccgagcugaccccgcuccuggagaaggagcgcgacggccugcggugccgcgggaaccggagccccgugcccgacgucgaggaccccgccaccgaggagccgggcgaguccuucugcgacaaggugaugcgcugguuccaggcgaugcuccagcggcugcagacgugguggcacggggugcuggccugggucaaggagaaggugguggcccucguccacgccgugcaggcccuguggaagcaguuccagagcuucugcugcucccugagcgagcuguucauguccagcuuccaguccuacggcgcgccccgcggggacaaggaggagcucacgccccagaagugcagcgagccccaguccagcaaguga

SEQ ID NO: 4524 - RNA, 705 nt, Artificial Sequence
  derived and/or modified sequence opt2 from IL-32__Homo_sapiens__AAH09401
augugcuuccccaagguccucuccgacgacaugaagaagcucaaggcccgcauggucaugcuccuccccaccuccgcccagggccucggcgccugggucuccgccugcgacaccgaggacaccgucggccaccucggccccuggcgcgacaaggaccccgcccucuggugccagcucugccucuccucccagcaccaggccaucgagcgcuucuacgacaagaugcagaacgccgaguccggccgcggccaggucauguccucccucgccgagcucgaggacgacuucaaggagggcuaccucgagaccgucgccgccuacuacgaggagcagcaccccgagcucaccccccuccucgagaaggagcgcgacggccuccgcugccgcggcaaccgcucccccguccccgacgucgaggaccccgccaccgaggagcccggcgaguccuucugcgacaaggucaugcgcugguuccaggccaugcuccagcgccuccagaccugguggcacggcguccucgccugggucaaggagaaggucgucgcccucguccacgccguccaggcccucuggaagcaguuccaguccuucugcugcucccucuccgagcucuucauguccuccuuccaguccuacggcgccccccgcggcgacaaggaggagcucaccccccagaagugcuccgagccccaguccuccaaguga

SEQ ID NO: 4525 - RNA, 705 nt, Artificial Sequence
  derived and/or modified sequence opt3 from IL-32__Homo_sapiens__AAH09401
augugcuuccccaaggugcugagcgacgauaugaaaaagcucaaagccagaauggucaugcuucugccuaccuccgcucagggcuugggggcauggguuucugccugugacacagaggauacugugggacacuuagguccauggagggacaaggauccggcgcuguggugccaacuaugucucucaagucagcaucaggcuaucgaacgguuuuacgacaaaaugcagaacgccgagagcggccgcgggcaaguaauguccucucuggcagaacuugaggaugacuucaaggaaggauaucuggagacgguggccgcuuacuaugaggaacagcaccccgaguugaccccucuccuggaaaaggagcgagauggccugcguugcagagguaauaggucgccaguccccgacguggaggauccugcaacagaggaaccaggggaaucauuuugugacaaaguuaugcggugguuccaggccaugcuccagcgcuuacaaacuugguggcauggagugcuggcuugggucaaggagaaagugguagcccuuguucacgcggugcaggcauuguggaagcaguuucagagcuucugcuguagucuguccgaacuauuuaugucuagcuuccaauccuacggcgcccccagaggcgauaaagaggagcucaccccucagaagugcucagaaccacagaguagcaaguga

SEQ ID NO: 4526 - RNA, 705 nt, Artificial Sequence
  derived and/or modified sequence opt4 from IL-32__Homo_sapiens__AAH09401
augugcuuccccaaggugcugagcgacgacaugaagaagcugaaggccagaauggugaugcugcugcccaccagcgcccagggccugggcgccugggugagcgccugcgacaccgaggacaccgugggccaccugggccccuggagagacaaggaccccgcccuguggugccagcugugccugagcagccagcaccaggccaucgagagauucuacgacaagaugcagaacgccgagagcggcagaggccaggugaugagcagccuggccgagcuggaggacgacuucaaggagggcuaccuggagaccguggccgccuacuacgaggagcagcaccccgagcugaccccccugcuggagaaggagagagacggccugagaugcagaggcaacagaagccccgugcccgacguggaggaccccgccaccgaggagcccggcgagagcuucugcgacaaggugaugagaugguuccaggccaugcugcagagacugcagaccugguggcacggcgugcuggccugggugaaggagaaggugguggcccuggugcacgccgugcaggcccuguggaagcaguuccagagcuucugcugcagccugagcgagcuguucaugagcagcuuccagagcuacggcgcccccagaggcgacaaggaggagcugaccccccagaagugcagcgagccccagagcagcaaguga

SEQ ID NO: 4527 - RNA, 705 nt, Artificial Sequence
  derived and/or modified sequence opt5 from IL-32__Homo_sapiens__AAH09401
augugcuuccccaaggugcugagcgacgauaugaaaaagcucaaagccagaauggucaugcugcuuccuaccuccgcccagggccugggggccuggguuucugcgugugacacagaggauacggugggacaccucggcccguggcgggacaaggaucccgcucuguggugccaacuuugucugagcucccagcaucaggccaucgaacgcuuuuacgacaaaaugcagaacgccgagucugggagaggacaagugaugagcucccucgcugaacuggaggaugacuucaaggaaggcuaucuggagaccgucgccgcuuacuaugaggaacagcacccugagcucacaccccugcuugaaaaggagcgggaugggcugcgcugcagaggaaaucggucuccugugcccgacguugaggauccugccaccgaagaaccgggcgagagcuuuugugacaaagugaugcgcugguuccaggcgaugcuccagagacugcaaacaugguggcauggcguccuugccugggugaaggagaaaguuguggcucugguccacgccgugcaggcucucuggaagcaguuucaguccuucugcuguagccugucugaacuguuuauguccagcuuccaaucuuacggggcuccccggggagauaaagaggagcucaccccucagaagugcuccgaaccccagagcucuaaguga

SEQ ID NO: 4528 - RNA, 705 nt, Artificial Sequence
  derived and/or modified sequence opt6 from IL-32__Homo_sapiens__AAH09401
auguguuucccaaaaguauuaucagacgauaugaaaaaauuaaaagcuagaaugguaaugcuauuaccaacaucagcacaaggauuaggagcauggguaucagcaugugauacagaagauacaguaggacaucuaggaccauggagagauaaagauccagcauuauggugccaauuaugucuaucaucacaacaccaagccauagaaagauucuaugauaaaaugcaaaacgcagaaaguggaaggggacaaguaaugagcucacuagcagaauuagaagaugacuucaaagaaggauaucuagaaacaguagccgcauacuaugaagaacaacauccagaacuaacaccauuacuagaaaaagaaagagauggauuaagaugucgaggaaauagaagcccaguaccagacguagaagauccagcaacagaagaaccaggagaaagcuuuugcgauaaaguuaugcgaugguuucaagcaauguuacaaagacuacaaaccugguggcauggcguucucgcauggguaaaagaaaaaguaguagcacuaguacacgcaguacaagcacuauggaaacaauuucaaucauucuguugcucauuaagcgaauuauucaugagcaguuuccaaagcuauggagcaccaagaggagauaaagaagaauuaacaccacaaaaaugcucagaaccacaaucaagcaaauaa

SEQ ID NO: 4529 - protein, 270 aa, Artificial Sequence
  IL-33__Homo_sapiens__O95760
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 4530 - RNA, 813 nt, Artificial Sequence
  IL-33__Homo_sapiens__AAH47085
augaagccuaaaaugaaguauucaaccaacaaaauuuccacagcaaaguggaagaacacagcaagcaaagccuuguguuucaagcugggaaaaucccaacagaaggccaaagaaguuugccccauguacuuuaugaagcuccgcucuggccuuaugauaaaaaaggaggccuguuacuuuaggagagaaaccaccaaaaggccuucacugaaaacagguagaaagcacaaaagacaucugguacucgcugccugucaacagcagucuacuguggagugcuuugccuuugguauaucagggguccagaaauauacuagagcacuucaugauucaaguaucacaggaauuucaccuauuacagaguaucuugcuucucuaagcacauacaaugaucaauccauuacuuuugcuuuggaggaugaaaguuaugagauauauguugaagacuugaaaaaagaugaaaagaaagauaagguguuacugaguuacuaugagucucaacaccccucaaaugaaucaggugacgguguugaugguaagauguuaaugguaacccugaguccuacaaaagacuucugguugcaugccaacaacaaggaacacucuguggagcuccauaagugugaaaaaccacugccagaccaggccuucuuuguccuucauaauaugcacuccaacuguguuucauuugaaugcaagacugauccuggaguguuuauagguguaaaggauaaucaucuugcucugauuaaaguagacucuucugagaauuuguguacugaaaauaucuuguuuaagcucucugaaacuuag

SEQ ID NO: 4531 - RNA, 813 nt, Artificial Sequence
  derived and/or modified sequence opt1 from IL-33__Homo_sapiens__AAH47085
augaagcccaagaugaaguacagcaccaacaagaucuccaccgccaaguggaagaacacggccagcaaggcgcugugcuucaagcucggcaagucccagcagaaggccaaggaggugugcccgauguacuucaugaagcugcgcagcgggcugaugaucaagaaggaggccugcuacuuccggcgcgagaccaccaagcggcccucccucaagaccggccgcaagcacaagcggcaccugguccuggccgccugccagcagcagagcacgguggagugcuucgcguucgggaucuccggcgugcagaaguacacccgcgcccuccacgacagcuccaucaccgggaucagccccaucaccgaguaccuggccucccugagcacguacaacgaccaguccaucaccuucgcccucgaggacgagagcuacgagaucuacgucgaggaccugaagaaggacgagaagaaggacaaggugcugcucuccuacuacgagagccagcaccccuccaacgagagcggcgacggcguggacgggaagaugcugauggucacccuguccccgaccaaggacuucuggcuccacgcgaacaacaaggagcacagcguggagcugcacaagugcgagaagccccugcccgaccaggccuucuucgugcuccacaacaugcacagcaacugcgucuccuucgagugcaagacggaccccggcguguucaucggggugaaggacaaccaccuggcccugaucaaggucgacagcuccgagaaccucugcaccgagaacauccuguucaagcugagcgagaccuga

SEQ ID NO: 4532 - RNA, 813 nt, Artificial Sequence
  derived and/or modified sequence opt2 from IL-33__Homo_sapiens__AAH47085
augaagcccaagaugaaguacuccaccaacaagaucuccaccgccaaguggaagaacaccgccuccaaggcccucugcuucaagcucggcaagucccagcagaaggccaaggaggucugccccauguacuucaugaagcuccgcuccggccucaugaucaagaaggaggccugcuacuuccgccgcgagaccaccaagcgccccucccucaagaccggccgcaagcacaagcgccaccucguccucgccgccugccagcagcaguccaccgucgagugcuucgccuucggcaucuccggcguccagaaguacacccgcgcccuccacgacuccuccaucaccggcaucucccccaucaccgaguaccucgccucccucuccaccuacaacgaccaguccaucaccuucgcccucgaggacgaguccuacgagaucuacgucgaggaccucaagaaggacgagaagaaggacaagguccuccucuccuacuacgagucccagcaccccuccaacgaguccggcgacggcgucgacggcaagaugcucauggucacccucucccccaccaaggacuucuggcuccacgccaacaacaaggagcacuccgucgagcuccacaagugcgagaagccccuccccgaccaggccuucuucguccuccacaacaugcacuccaacugcgucuccuucgagugcaagaccgaccccggcgucuucaucggcgucaaggacaaccaccucgcccucaucaaggucgacuccuccgagaaccucugcaccgagaacauccucuucaagcucuccgagaccuga

SEQ ID NO: 4533 - RNA, 813 nt, Artificial Sequence
  derived and/or modified sequence opt3 from IL-33__Homo_sapiens__AAH47085
augaagcccaaaaugaaguacagcaccaacaaaaucuccacagccaaguggaaaaauacugcuucuaaggcacugugcuucaagcucggcaaaucacagcaaaaggccaaagagguguguccuauguauuuuaugaaguugagaagugggcugaugauuaaaaaggaagcgugcuacuucaggcgggagacgaccaagcgcccaagccuuaaaacaggacgaaagcacaaacgucauuuaguccuggcugccugucagcagcaguccacuguugaaugcuuugcauucgguauaucuggcgugcaaaaguauaccagagcccuacacgacucgucaaucacagggauuagcccgaucaccgaguaccucgcuagucuguccacuuauaacgaucagucuauuacauuugcacuugaagacgagagcuacgagaucuauguagaagaucugaaaaaggacgagaaaaaggauaagguguugcucuccuacuacgaaucacagcaucccaguaaugagagcggagacggcgucgaugguaaaaugcugauggugacccugucuccuacgaaggacuucuggcuccacgccaacaauaaagagcauuccguugaauuacacaagugugagaaaccacugcccgaucaggccuuuuucgugcuucacaacaugcauucaaauugcgucagcuuugaauguaagacugacccugggguguucauaggaguaaaggauaaccacuuggcucugaucaaaguugacaguucugagaaucuaugcaccgaaaacauucucuuuaagcuguccgagacauga

SEQ ID NO: 4534 - RNA, 813 nt, Artificial Sequence
  derived and/or modified sequence opt4 from IL-33__Homo_sapiens__AAH47085
augaagcccaagaugaaguacagcaccaacaagaucagcaccgccaaguggaagaacaccgccagcaaggcccugugcuucaagcugggcaagagccagcagaaggccaaggaggugugccccauguacuucaugaagcugagaagcggccugaugaucaagaaggaggccugcuacuucagaagagagaccaccaagagacccagccugaagaccggcagaaagcacaagagacaccuggugcuggccgccugccagcagcagagcaccguggagugcuucgccuucggcaucagcggcgugcagaaguacaccagagcccugcacgacagcagcaucaccggcaucagccccaucaccgaguaccuggccagccugagcaccuacaacgaccagagcaucaccuucgcccuggaggacgagagcuacgagaucuacguggaggaccugaagaaggacgagaagaaggacaaggugcugcugagcuacuacgagagccagcaccccagcaacgagagcggcgacggcguggacggcaagaugcugauggugacccugagccccaccaaggacuucuggcugcacgccaacaacaaggagcacagcguggagcugcacaagugcgagaagccccugcccgaccaggccuucuucgugcugcacaacaugcacagcaacugcgugagcuucgagugcaagaccgaccccggcguguucaucggcgugaaggacaaccaccuggcccugaucaagguggacagcagcgagaaccugugcaccgagaacauccuguucaagcugagcgagaccuga

SEQ ID NO: 4535 - RNA, 813 nt, Artificial Sequence
  derived and/or modified sequence opt5 from IL-33__Homo_sapiens__AAH47085
augaagcccaaaaugaaguacagcaccaacaaaaucuccacagccaaguggaaaaauacggcuucuaaggcccugugcuucaagcucggcaaaagccagcaaaaggcgaaagagguguguccuauguauuuuaugaagcugagauccgggcuuaugauuaaaaaggaggcuugcuacuuccggcgcgaaaccacaaagagaccgucucugaaaaccggacggaagcacaaacgccaucucguccuggccgccugucagcagcagagcacaguugaaugcuuugcuuucggcaucuccggggugcaaaaguauaccagagcccuucacgacucuagcauuacaggaaucucccccauuaccgaguaccuggcuagccucucuacguauaacgaucaguccaucaccuuugcccuggaagacgagagcuacgagaucuauguggaagaucugaaaaaggacgagaaaaaggauaagguccuccugucuuacuacgaaucccagcauccuagcaaugagucuggcgacgggguggauggaaaaaugcuuaugguuacacugucccccaccaaggacuucuggcuccacgcgaacaauaaagagcauagcguggaacugcacaagugugagaaaccucuucccgaucaggccuuuuucguccugcacaacaugcauuccaauugcgugucuuuugaauguaagacagacccuggcguuuucauuggcgugaaggauaaccaccucgcucugaucaaagucgacagcuccgagaaucugugcaccgaaaacauucucuuuaagcugagcgagacguga

SEQ ID NO: 4536 - RNA, 813 nt, Artificial Sequence
  derived and/or modified sequence opt6 from IL-33__Homo_sapiens__AAH47085
augaaaccaaaaaugaaauacucaacaaacaaaauaucaacagcaaaauggaaaaacacagcaucaaaagcacuaugcuucaaauuaggaaaaucacaacaaaaagcaaaagaagucugcccaauguauuucaugaaacuaagaucaggacuaaugauaaaaaaagaagcuugcuauuucagaagagaaacaacaaaaagaccaucacuaaaaacaggaagaaaacacaaacgacaccuaguacuagcagccugccaacaacaauccacaguagaaugcuucgcauucggaauaucaggcguacaaaaauacacaagagcacuccacgacucauccauaacaggaauaucaccaaucacagaauaccuagcaucccuaucaacauacaacgaucaaucuauaacauucgcacucgaagacgaaucauacgaaauauacguagaagaccuaaaaaaagacgaaaaaaaagacaaaguauuauuaagcuacuacgaaagccaacacccaucaaacgaaucaggagacggaguagacggaaaaaugcuaaugguaacauuaucaccaacaaaagauuucugguuacaugcaaacaacaaagaacacucagucgaauuacacaaaugcgaaaaaccacuaccagaccaagcauucuucguauuacacaacaugcacucaaacugcguaucauucgaaugcaaaacagacccaggaguauucauaggaguaaaagauaaccacuuagcauuaauaaaaguagacucaucagaaaaccuaugcacagaaaacauacuauucaaauuaucagaaacauaa

SEQ ID NO: 4537 - protein, 218 aa, Artificial Sequence
  IL-37__Homo_sapiens__Q9NZH6
MSFVGENSGVKMGSEDWEKDEPQCCLEDPAGSPLEPGPSLPTMNFVHTSPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 4538 - RNA, 657 nt, Artificial Sequence
  IL-37__Homo_sapiens__AAF69252
auguccuuugugggggagaacucaggagugaaaaugggcucugaggacugggaaaaagaugaaccccagugcugcuuagaagacccggcuggaagcccccuggaaccaggcccaagccuccccaccaugaauuuuguucacacaaguccaaaggugaagaacuuaaacccgaagaaauucagcauucaugaccaggaucacaaaguacugguccuggacucugggaaucucauagcaguuccagauaaaaacuacauacgcccagagaucuucuuugcauuagccucauccuugagcucagccucugcggagaaaggaaguccgauucuccugggggucucuaaaggggaguuuugucucuacugugacaaggauaaaggacaaagucauccaucccuucagcugaagaaggagaaacugaugaagcuggcugcccaaaaggaaucagcacgccggcccuucaucuuuuauagggcucaggugggcuccuggaacaugcuggagucggcggcucaccccggaugguucaucugcaccuccugcaauuguaaugagccuguuggggugacagauaaauuugagaacaggaaacacauugaauuuucauuucaaccaguuugcaaagcugaaaugagccccagugaggucagcgauuag

SEQ ID NO: 4539 - RNA, 657 nt, Artificial Sequence
  derived and/or modified sequence opt1 from IL-37__Homo_sapiens__AAF69252
augagcuucgugggcgagaacuccggggucaagaugggcagcgaggacugggagaaggacgagccccagugcugccuggaggacccggccgggagcccccucgagcccggccccucccugccgaccaugaacuucgugcacaccucccccaaggugaagaaccugaaccccaagaaguucagcauccacgaccaggaccacaagguccucgugcuggacuccgggaaccugaucgccgugcccgacaagaacuacauccgcccggagaucuucuucgcgcucgccagcucccugagcuccgccagcgccgagaagggcucccccauccugcucggcgucagcaagggggaguucugccuguacugcgacaaggacaagggccagucccaccccagccugcagcucaagaaggagaagcugaugaagcuggccgcgcagaaggaguccgcccggcgccccuucaucuucuaccgggcccagguggggagcuggaacaugcucgaguccgccgcgcacccgggcugguucaucugcacgagcugcaacugcaacgagcccgugggggucaccgacaaguucgagaaccgcaagcacaucgaguucagcuuccagcccgugugcaaggccgagaugucccccagcgagguguccgacuga

SEQ ID NO: 4540 - RNA, 657 nt, Artificial Sequence
  derived and/or modified sequence opt2 from IL-37__Homo_sapiens__AAF69252
auguccuucgucggcgagaacuccggcgucaagaugggcuccgaggacugggagaaggacgagccccagugcugccucgaggaccccgccggcuccccccucgagcccggccccucccuccccaccaugaacuucguccacaccucccccaaggucaagaaccucaaccccaagaaguucuccauccacgaccaggaccacaagguccucguccucgacuccggcaaccucaucgccguccccgacaagaacuacauccgccccgagaucuucuucgcccucgccuccucccucuccuccgccuccgccgagaagggcucccccauccuccucggcgucuccaagggcgaguucugccucuacugcgacaaggacaagggccagucccaccccucccuccagcucaagaaggagaagcucaugaagcucgccgcccagaaggaguccgcccgccgccccuucaucuucuaccgcgcccaggucggcuccuggaacaugcucgaguccgccgcccaccccggcugguucaucugcaccuccugcaacugcaacgagcccgucggcgucaccgacaaguucgagaaccgcaagcacaucgaguucuccuuccagcccgucugcaaggccgagaugucccccuccgaggucuccgacuga

SEQ ID NO: 4541 - RNA, 657 nt, Artificial Sequence
  derived and/or modified sequence opt3 from IL-37__Homo_sapiens__AAF69252
augagcuucgugggcgagaacuccggggucaagaugggaucugaagacugggagaaagaugaaccccagugcugucuggaggacccugccgguucaccacucgaaccgggccccagucuuccuaccaugaauuuuguucacacaagcccaaaggugaaaaaccugaaucccaagaaauucuccauccaugaucaagaccacaagguauugguguuagauucugggaaccugauugcugucccugacaagaauuacauaagaccagagaucuuuuucgcacuagccucgucacucagcagugcguccgcugagaaaggaucucccauucugcuuggcgugagcaagggugaauuuugccuguauugugauaaagacaaggggcagucccauccuucauugcagcucaaaaaggagaagcugaugaaacuggccgcacagaaggaaagugccaggcggccauucaucuuuuaccgcgcucaaguuggaagcuggaacaugcucgagucugcagcccacccgggcugguucauuugcacuuccuguaauugcaacgagcccgugggcgucacggauaaauuugaaaaucgaaagcauaucgaguucucauuucagccuguguguaaagcugaaaugagcccaagugagguaucugacuga

SEQ ID NO: 4542 - RNA, 657 nt, Artificial Sequence
  derived and/or modified sequence opt4 from IL-37__Homo_sapiens__AAF69252
augagcuucgugggcgagaacagcggcgugaagaugggcagcgaggacugggagaaggacgagccccagugcugccuggaggaccccgccggcagcccccuggagcccggccccagccugcccaccaugaacuucgugcacaccagccccaaggugaagaaccugaaccccaagaaguucagcauccacgaccaggaccacaaggugcuggugcuggacagcggcaaccugaucgccgugcccgacaagaacuacaucagacccgagaucuucuucgcccuggccagcagccugagcagcgccagcgccgagaagggcagccccauccugcugggcgugagcaagggcgaguucugccuguacugcgacaaggacaagggccagagccaccccagccugcagcugaagaaggagaagcugaugaagcuggccgcccagaaggagagcgccagaagacccuucaucuucuacagagcccaggugggcagcuggaacaugcuggagagcgccgcccaccccggcugguucaucugcaccagcugcaacugcaacgagcccgugggcgugaccgacaaguucgagaacagaaagcacaucgaguucagcuuccagcccgugugcaaggccgagaugagccccagcgaggugagcgacuga

SEQ ID NO: 4543 - RNA, 657 nt, Artificial Sequence
  derived and/or modified sequence opt5 from IL-37__Homo_sapiens__AAF69252
augagcuucgugggcgagaacuccggggucaagaugggaucugaagacugggagaaagaugaaccccagugcugucuggaggacccugccggcagcccgcucgaacccgggccuucccugcccaccaugaauuuuguucacacaucuccuaaggugaaaaaccuuaaucccaagaaauucagcauccaugaucaagaccacaaggugcugguccucgauuccggaaaccugauugcugugccugacaagaauuacaucagaccggagaucuuuuucgcccuugcgucuagccuguccagcgcuucugccgagaaaggcucccccauucuccuggggguuagcaagggagaauuuugccuguauugugauaaagacaagggccagucucauccuucccuccagcugaaaaaggagaaacuuaugaagcuggccgcucagaaggaaagcgcccggcgccccuucaucuuuuacagagcucaagugggcucuuggaacaugcucgaguccgccgcgcacccugggugguucauuugcacgagcuguaauugcaacgagcccgucggagugaccgauaaauuugaaaaucggaagcauaucgaguucuccuuucagccgguuuguaaagccgaaaugucuccuagcgagguguccgacuga

SEQ ID NO: 4544 - RNA, 657 nt, Artificial Sequence
  derived and/or modified sequence opt6 from IL-37__Homo_sapiens__AAF69252
augucauucguaggagaaaauucaggaguaaaaaugggaucagaagacugggaaaaagacgaaccacaaugcugccuagaagacccugcaggcucaccacuagaaccaggaccaucauuaccaacaaugaacuucguacacacauccccaaaaguaaaaaaccuaaacccaaaaaaauucucaauacacgaucaagaccacaaaguacuaguacuagacucaggaaaccuaauagcaguaccagauaaaaacuacauaagaccagaaauauucuucgcacuagcaucaucacuaucaagcgcaucagcagaaaaaggaucaccaauacuacuaggaguaucaaaaggagaauucugcuuauacugcgacaaagacaaaggacaaucacacccaucacuacaacuaaaaaaagaaaaauuaaugaaacuagcagcacaaaaagaaucagcaagaagaccauucauauucuauagagcacaaguaggaucauggaacauguuagaaucagcagcccacccaggaugguucauauguacaucaugcaacugcaacgaaccaguaggaguaacagacaaauucgaaaacagaaaacacauagaauucucauuccaaccaguaugcaaagcagaaaugucaccaagugaaguaucagacuaa

SEQ ID NO: 4545 - protein, 152 aa, Artificial Sequence
  IL-3__Homo_sapiens__P08700
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 4546 - RNA, 459 nt, Artificial Sequence
  IL-3__Homo_sapiens__AAA35725
augagccgccugcccguccugcuccugcuccaacuccugguccgccccggacuccaagcucccaugacccagacaacgcccuugaagacaagcuggguuaacugcucuaacaugaucgaugaaauuauaacacacuuaaagcagccaccuuugccuuugcuggacuucaacaaccucaauggggaagaccaagacauucugauggaaaauaaccuucgaaggccaaaccuggaggcauucaacagggcugucaagaguuuacagaacgcaucagcaauugagagcauucuuaaaaaucuccugccaugucugccccuggccacggccgcacccacgcgacauccaauccauaucaaggacggugacuggaaugaauuccggaggaaacugacguucuaucugaaaacccuugagaaugcgcaggcucaacagacgacuuugagccucgcgaucuuuuga

SEQ ID NO: 4547 - RNA, 459 nt, Artificial Sequence
  derived and/or modified sequence opt1 from IL-3__Homo_sapiens__AAA35725
augagccgccugcccgugcuccugcugcuccagcugcugguccggccgggccuccaggcccccaugacccagaccacgccccugaagaccuccugggugaacugcagcaacaugaucgacgagaucaucacccaccugaagcagcccccgcucccccugcuggacuucaacaaccucaacggggaggaccaggacauccugauggagaacaaccugcgccggcccaaccucgaggccuucaaccgcgcggugaagucccugcagaacgccagcgccaucgaguccauccugaagaaccuccugcccugccugccgcucgccaccgccgcgcccacgcggcaccccauccacaucaaggacggcgacuggaacgaguuccgccggaagcugaccuucuaccugaagacccucgagaacgcccaggcccagcagaccacgcugagccuggccaucuucuga

SEQ ID NO: 4548 - RNA, 459 nt, Artificial Sequence
  derived and/or modified sequence opt2 from IL-3__Homo_sapiens__AAA35725
augucccgccuccccguccuccuccuccuccagcuccucguccgccccggccuccaggcccccaugacccagaccaccccccucaagaccuccugggucaacugcuccaacaugaucgacgagaucaucacccaccucaagcagcccccccucccccuccucgacuucaacaaccucaacggcgaggaccaggacauccucauggagaacaaccuccgccgccccaaccucgaggccuucaaccgcgccgucaagucccuccagaacgccuccgccaucgaguccauccucaagaaccuccuccccugccucccccucgccaccgccgcccccacccgccaccccauccacaucaaggacggcgacuggaacgaguuccgccgcaagcucaccuucuaccucaagacccucgagaacgcccaggcccagcagaccacccucucccucgccaucuucuga

SEQ ID NO: 4549 - RNA, 459 nt, Artificial Sequence
  derived and/or modified sequence opt3 from IL-3__Homo_sapiens__AAA35725
augagcagacugcccgugcuccuucuguugcaguuacuggucaggccuggccuacaagccccaaugacccagacaacuccgcucaagacguccuggguuaacugcucuaauaugaucgacgagauuauaacccaccugaaacagcccccucuuccacuguuggauuucaacaaucucaacggggaagaccaggauauccugauggagaauaaccugcggcgccccaaucucgaggcuuuuaaccgagcagugaagucauuacaaaaugccagugcgauugaaagcauccugaaaaaccuuuugccuugucugccacuagcuacagccgcacccacucgucauccuauucacaucaaggacggagauuggaaugaguucagaaggaaacucaccuuuuaccugaagacacuugaaaacgcccaggcucagcagaccacucuguccuuggcaauauucuga

SEQ ID NO: 4550 - RNA, 459 nt, Artificial Sequence
  derived and/or modified sequence opt4 from IL-3__Homo_sapiens__AAA35725
augagcagacugcccgugcugcugcugcugcagcugcuggugagacccggccugcaggcccccaugacccagaccaccccccugaagaccagcugggugaacugcagcaacaugaucgacgagaucaucacccaccugaagcagcccccccugccccugcuggacuucaacaaccugaacggcgaggaccaggacauccugauggagaacaaccugagaagacccaaccuggaggccuucaacagagccgugaagagccugcagaacgccagcgccaucgagagcauccugaagaaccugcugcccugccugccccuggccaccgccgcccccaccagacaccccauccacaucaaggacggcgacuggaacgaguucagaagaaagcugaccuucuaccugaagacccuggagaacgcccaggcccagcagaccacccugagccuggccaucuucuga

SEQ ID NO: 4551 - RNA, 459 nt, Artificial Sequence
  derived and/or modified sequence opt5 from IL-3__Homo_sapiens__AAA35725
augagcagacugcccgugcuccugcuucugcagcuccuggugcggccuggccuucaagccccgaugacccagacaacgccccugaagaccuccuggguuaacugcucuaauaugaucgacgagauuaucacacaccucaaacagccuccccugccucugcucgauuucaacaaucugaacggggaagaccaggauauucuuauggagaauaaccugcgcagacccaaucucgaggcuuuuaaccgggccgucaagagccugcaaaaugcguccgcuaucgaaucuauucuuaaaaaccugcucccuugucugccgcuggccaccgccgcucccacacgccauccuauccacaucaaggacggagauuggaaugaguucagacggaaacucaccuuuuaccugaagacacuugaaaacgcccaggcucagcagaccacgcugagccucgccauuuucuga

SEQ ID NO: 4552 - RNA, 459 nt, Artificial Sequence
  derived and/or modified sequence opt6 from IL-3__Homo_sapiens__AAA35725
augucaagacuacccguacuacuacuacuacaacuacuaguaagaccaggacuacaagcaccaaugacacaaacaacaccacuaaaaacauccuggguaaacugcucaaacaugauagacgaaauaaucacacaccuaaaacaaccaccacuaccacuacuagacuucaacaaccuaaacggagaagaccaagacauacucauggaaaacaaccuaagaagaccaaaccuagaagcauucaacagagccguaaaaucacuacaaaacgcaucagcaauagaaucaauacuaaaaaaccuacuaccaugccucccacuagcaacagcagcaccaacaagacacccaauacacauaaaagacggagacuggaacgaauucagaagaaaacuaacauucuaccuaaaaacacuagaaaacgcacaagcacaacaaacaacacucucacuagcaauauucuaa

SEQ ID NO: 4553 - protein, 152 aa, Artificial Sequence [sequence omitted]

SEQ ID NO: 4554 - RNA, 459 nt, Artificial Sequence
  IL-3__Homo_sapiens__AAH66275
augagccgccugcccguccugcuccugcuccaacuccugguccgccccggacuccaagcucccaugacccagacaacguccuugaagacaagcuggguuaacugcucuaacaugaucgaugaaauuauaacacacuuaaagcagccaccuuugccuuugcuggacuucaacagccucaauggggaagaccaagacauucugauggaaaauaaccuucgaaggccaaaccuggaggcauucaacagggcugucaagaguuuacagaacgcaucagcaauugagagcauucuuaaaaaucuccugccaugucugccccuggccacggccgcacccacgcgacauccaauccauaucaaggacggugacuggaaugaauuccggaggaaacugacguucuaucugaaaacccuugagaaugcgcaggcucaacagacgacuuugagccucgcgaucuuuuga

SEQ ID NO: 4555 - RNA, 459 nt, Artificial Sequence
  derived and/or modified sequence opt1 from IL-3__Homo_sapiens__AAH66275
augagccgccugcccgugcuccugcugcuccagcugcugguccggccgggccuccaggcccccaugacccagaccacgucccugaagaccagcugggugaacugcuccaacaugaucgacgagaucaucacccaccugaagcagccgccccucccccugcuggacuucaacagccucaacggggaggaccaggacauccugauggagaacaaccugcgccggcccaaccucgaggccuucaaccgcgcggugaagucccugcagaacgccagcgccaucgaguccauccugaagaaccuccugcccugccugccccucgccaccgccgcgccgacgcggcaccccauccacaucaaggacggcgacuggaacgaguuccgccggaagcugaccuucuaccugaagacccucgagaacgcccaggcccagcagaccacgcugagccuggccaucuucuga

SEQ ID NO: 4556 - RNA, 459 nt, Artificial Sequence
  derived and/or modified sequence opt2 from IL-3__Homo_sapiens__AAH66275
augucccgccuccccguccuccuccuccuccagcuccucguccgccccggccuccaggcccccaugacccagaccaccucccucaagaccuccugggucaacugcuccaacaugaucgacgagaucaucacccaccucaagcagcccccccucccccuccucgacuucaacucccucaacggcgaggaccaggacauccucauggagaacaaccuccgccgccccaaccucgaggccuucaaccgcgccgucaagucccuccagaacgccuccgccaucgaguccauccucaagaaccuccuccccugccucccccucgccaccgccgcccccacccgccaccccauccacaucaaggacggcgacuggaacgaguuccgccgcaagcucaccuucuaccucaagacccucgagaacgcccaggcccagcagaccacccucucccucgccaucuucuga

SEQ ID NO: 4557 - RNA, 459 nt, Artificial Sequence
  derived and/or modified sequence opt3 from IL-3__Homo_sapiens__AAH66275
augagcagacugcccgugcuccuucuguugcaguuacuggugaggccuggccuacaagccccaaugacccagacaacuucccucaagacgucuuggguuaacugcucaaauaugaucgacgagauuauaacccaccugaaacagccgccccuuccucuguuggauuucaacagucucaauggggaagaccaggauauccugauggagaacaaucugcggcgcccaaaccucgaggcuuuuaaucgagcagucaagagcuuacaaaacgccuccgcgauugaaucuauccugaaaaaucuuuugcccugucugccucuagcuacagccgcaccaacucgucaucccauucacaucaaggacggagauuggaacgaguucagaaggaaacucaccuuuuaccugaagacacuugaaaaugcccaggcucagcagaccacucugucguuggcaauauucuga

SEQ ID NO: 4558 - RNA, 459 nt, Artificial Sequence
  derived and/or modified sequence opt4 from IL-3__Homo_sapiens__AAH66275
augagcagacugcccgugcugcugcugcugcagcugcuggugagacccggccugcaggcccccaugacccagaccaccagccugaagaccagcugggugaacugcagcaacaugaucgacgagaucaucacccaccugaagcagcccccccugccccugcuggacuucaacagccugaacggcgaggaccaggacauccugauggagaacaaccugagaagacccaaccuggaggccuucaacagagccgugaagagccugcagaacgccagcgccaucgagagcauccugaagaaccugcugcccugccugccccuggccaccgccgcccccaccagacaccccauccacaucaaggacggcgacuggaacgaguucagaagaaagcugaccuucuaccugaagacccuggagaacgcccaggcccagcagaccacccugagccuggccaucuucuga

SEQ ID NO: 4559 - RNA, 459 nt, Artificial Sequence
  derived and/or modified sequence opt5 from IL-3__Homo_sapiens__AAH66275
augagcagacugcccgugcuccugcuucugcagcuccugguccggccuggccuucaagccccgaugacccagacaacgucccugaagaccucuuggguuaacugcagcaauaugaucgacgagauuaucacacaccucaaacagcccccucugccccugcucgauuucaacucccugaauggggaagaccaggauauucuuauggagaacaaucugcgcagaccuaaccucgaggcuuuuaaucgggccgugaagucucugcaaaacgcgagcgcuaucgaauccauucuuaaaaaucugcuccccugucugccucuggccaccgccgcuccgacacgccaucccauccacaucaaggacggagauuggaacgaguucagacggaaacucaccuuuuaccugaagacacuugaaaaugcccaggcucagcagaccacgcugucucucgccauuuucuga

SEQ ID NO: 4560 - RNA, 459 nt, Artificial Sequence
  derived and/or modified sequence opt6 from IL-3__Homo_sapiens__AAH66275
augucaagacuaccaguacuacuacuccuacaauuacuaguaagaccaggacuacaagcaccaaugacacaaaccacaucccuaaaaacaucauggguaaacugcucaaacaugaucgacgaaauaauaacacacuuaaaacaaccaccacuaccacuacuagacuucaacucacuaaacggagaagaccaagacauacucauggaaaacaaccuaagaagaccaaaccuagaagcauucaacagagcaguaaaaucacuacaaaacgcaucagcaauagaauccauacuaaaaaaccuacucccaugccuaccacuagcaacagcagcaccaacaagacacccaauacacauaaaagacggagacuggaacgaauucagacgaaaacuaacauucuaccuaaaaacacuagaaaacgcacaagcacaacaaacaacacuaucacuagcaauauucuaa

SEQ ID NO: 4561 - protein, 152 aa, Artificial Sequence [sequence omitted]

SEQ ID NO: 4562 - RNA, 459 nt, Artificial Sequence
  IL-3__Homo_sapiens__AAH66274
augagccgccugcccguccugcuccugcuccaacuccugguccgccccggacuccaagcucccaugacccagacaacguccuugaagacaagcuggguuaacugcucuaacaugaucgaugaaauuauaacacgcuuaaagcagccaccuuugccuuugcuggacuucaacaaccucaauggggaagaccaagacauucugauggaaaauaaccuucgaaggccaaaccuggaggcauucaacagggcugucaagaguuuacagaacgcaucagcaauugagagcauucuuaaaaaucuccugccaugucugccccuggccacggccgcacccacgcgacauccaauccauaucaaggacggugacuggaaugaauuccggaggaaacugacguucuaucugaaaacccuugagaaugcgcaggcucaacagacgacuuugagccucgcgaucuuuuga

SEQ ID NO: 4563 - RNA, 459 nt, Artificial Sequence
  derived and/or modified sequence opt1 from IL-3__Homo_sapiens__AAH66274
augagccgccugcccgugcuccugcugcuccagcugcuggugcggccgggccuccaggcccccaugacccagaccacgucccugaagaccagcugggugaacugcuccaacaugaucgacgagaucaucacccgccugaagcagccgccccucccccugcuggacuucaacaaccucaacggggaggaccaggacauccugauggagaacaaccugcggcgccccaaccucgaggccuucaaccgggcggucaagagccugcagaacgccuccgccaucgagagcauccugaagaaccuccugcccugccugccccucgccaccgccgcgccgacgcgccaccccauccacaucaaggacggcgacuggaacgaguuccggcgcaagcugaccuucuaccugaagacccucgagaacgcccaggcccagcagaccacgcugucccuggccaucuucuga

SEQ ID NO: 4564 - RNA, 459 nt, Artificial Sequence
  derived and/or modified sequence opt2 from IL-3__Homo_sapiens__AAH66274
augucccgccuccccguccuccuccuccuccagcuccucguccgccccggccuccaggcccccaugacccagaccaccucccucaagaccuccugggucaacugcuccaacaugaucgacgagaucaucacccgccucaagcagcccccccucccccuccucgacuucaacaaccucaacggcgaggaccaggacauccucauggagaacaaccuccgccgccccaaccucgaggccuucaaccgcgccgucaagucccuccagaacgccuccgccaucgaguccauccucaagaaccuccuccccugccucccccucgccaccgccgcccccacccgccaccccauccacaucaaggacggcgacuggaacgaguuccgccgcaagcucaccuucuaccucaagacccucgagaacgcccaggcccagcagaccacccucucccucgccaucuucuga

SEQ ID NO: 4565 - RNA, 459 nt, Artificial Sequence
  derived and/or modified sequence opt3 from IL-3__Homo_sapiens__AAH66274
augagcagacugcccgugcuccuucuguugcaguuacuggucaggccuggccuacaagccccaaugacccagacaacuucccucaagacgucuuggguuaacugcucaaauaugaucgacgagauuauaacccggcugaaacagccgccccuuccucuguuggauuucaacaaucucaacggggaagaccaggauauccugauggagaauaaccugcgccgaccaaaucucgaggcuuuuaaccgugcagugaagaguuuacaaaaugccagcgcgauugaauccauccugaaaaaccuuuugcccugucugccucuagcuacagccgcaccaacuagacaccccauucauaucaaggacggagauuggaaugaguucaggcggaaacucaccuuuuaccugaagacacuugaaaacgcccaggcucagcagaccacucugucuuuggcaauauucuga

SEQ ID NO: 4566 - RNA, 459 nt, Artificial Sequence
  derived and/or modified sequence opt4 from IL-3__Homo_sapiens__AAH66274
augagcagacugcccgugcugcugcugcugcagcugcuggugagacccggccugcaggcccccaugacccagaccaccagccugaagaccagcugggugaacugcagcaacaugaucgacgagaucaucaccagacugaagcagcccccccugccccugcuggacuucaacaaccugaacggcgaggaccaggacauccugauggagaacaaccugagaagacccaaccuggaggccuucaacagagccgugaagagccugcagaacgccagcgccaucgagagcauccugaagaaccugcugcccugccugccccuggccaccgccgcccccaccagacaccccauccacaucaaggacggcgacuggaacgaguucagaagaaagcugaccuucuaccugaagacccuggagaacgcccaggcccagcagaccacccugagccuggccaucuucuga

SEQ ID NO: 4567 - RNA, 459 nt, Artificial Sequence
  derived and/or modified sequence opt5 from IL-3__Homo_sapiens__AAH66274
augagcagacugcccgugcuccugcuucugcagcuccugguccggccuggccuucaagccccgaugacccagacaacgucccugaagaccucuuggguuaacugcagcaauaugaucgacgagauuaucacacgccucaaacagcccccucugccccugcucgauuucaacaaucugaacggggaagaccaggauauucuuauggagaauaaccugagacggccuaaucucgaggcuuuuaaccgcgccgugaagucccugcaaaaugcgucugcuaucgaaagcauucuuaaaaaccugcuccccugucugccucuggccaccgccgcuccgacaagacaccccauccauaucaaggacggagauuggaaugaguuccggcgcaaacucaccuuuuaccugaagacacuugaaaacgcccaggcucagcagaccacgcugucccucgccauuuucuga

SEQ ID NO: 4568 - RNA, 459 nt, Artificial Sequence
  derived and/or modified sequence opt6 from IL-3__Homo_sapiens__AAH66274
augucaagacuaccaguacuacuacuacuacaacuacuaguaagaccaggacuacaagcaccaaugacccaaacaacaucacuaaaaacauccuggguaaacugcucaaacaugauagacgaaauaauaacaagacuaaaacaaccaccacuaccacuacuagacuucaacaaccuaaacggagaagaccaagacauacuaauggaaaacaaccuaagaagaccaaaccuagaagcauucaaccgagcaguaaaaucacuacaaaacgcaucagcaauagaauccauacuaaaaaaccuacuaccaugccuaccacuagcaacagcagcaccaacaagacacccaauacacauaaaagacggagacuggaacgaauucagaagaaaacuaacauucuaccuaaaaacacuagaaaacgcacaagcacaacaaacaacacucucacuagcaauauucuaa

SEQ ID NO: 4569 - protein, 137 aa, Artificial Sequence
  IL-4__Homo_sapiens__P05112-2
MGLTSQLLPPLFFLLACAGNFVHGHKCDITLQEIIKTLNSLTEQKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 4570 - RNA, 414 nt, Artificial Sequence
  IL-4__Homo_sapiens__CCDS4159.1
augggucucaccucccaacugcuucccccucuguucuuccugcuagcaugugccggcaacuuuguccacggacacaagugcgauaucaccuuacaggagaucaucaaaacuuugaacagccucacagagcagaagaacacaacugagaaggaaaccuucugcagggcugcgacugugcuccggcaguucuacagccaccaugagaaggacacucgcugccugggugcgacugcacagcaguuccacaggcacaagcagcugauccgauuccugaaacggcucgacaggaaccucuggggccuggcgggcuugaauuccuguccugugaaggaagccaaccagaguacguuggaaaacuucuuggaaaggcuaaagacgaucaugagagagaaauauucaaaguguucgagcuga

SEQ ID NO: 4571 - RNA, 414 nt, Artificial Sequence
  derived and/or modified sequence opt1 from IL-4__Homo_sapiens__CCDS4159.1
augggccugaccagccagcuccugcccccgcuguucuuccuccuggccugcgccgggaacuucgugcacggccacaagugcgacaucacccugcaggagaucaucaagacgcucaacucccugaccgagcagaagaacaccaccgagaaggagacguucugccgcgcggccaccguccugcggcaguucuacagccaccacgagaaggacacccgcugccucggggccaccgcccagcaguuccaccggcacaagcagcugauccgcuuccugaagcggcucgaccgcaaccuguggggccuggccgggcucaacuccugccccgugaaggaggcgaaccagagcacgcuggagaacuuccuggagcggcucaagaccaucaugcgcgagaaguacuccaagugcagcuccuga

SEQ ID NO: 4572 - RNA, 414 nt, Artificial Sequence
  derived and/or modified sequence opt2 from IL-4__Homo_sapiens__CCDS4159.1
augggccucaccucccagcuccuccccccccucuucuuccuccucgccugcgccggcaacuucguccacggccacaagugcgacaucacccuccaggagaucaucaagacccucaacucccucaccgagcagaagaacaccaccgagaaggagaccuucugccgcgccgccaccguccuccgccaguucuacucccaccacgagaaggacacccgcugccucggcgccaccgcccagcaguuccaccgccacaagcagcucauccgcuuccucaagcgccucgaccgcaaccucuggggccucgccggccucaacuccugccccgucaaggaggccaaccaguccacccucgagaacuuccucgagcgccucaagaccaucaugcgcgagaaguacuccaagugcuccuccuga

SEQ ID NO: 4573 - RNA, 414 nt, Artificial Sequence
  derived and/or modified sequence opt3 from IL-4__Homo_sapiens__CCDS4159.1
augggccugaccagccagcuccuucccccucuguucuuuuuguuagccugcgcugggaacuucgugcacggacauaagugugacaucacacugcaagagauuauaaaaacucuaaauucccucacggaacagaagaacaccacagagaaagaaacuuuuugcagagcagccaccguccugaggcaguucuacucucaccaugagaaggauacacggugucuuggugcgaccgcucagcaauuucaccgccauaaacagcugauccgauucuugaagcgucucgacagaaaucuguggggccuggccgggcucaacucaugcccaguuaaggaagcaaaucagaguacuuuagagaacuuucuggagaggcuuaaaacaauuaugcgggaaaaguauagcaaauguuccucuuga

SEQ ID NO: 4574 - RNA, 414 nt, Artificial Sequence
  derived and/or modified sequence opt4 from IL-4__Homo_sapiens__CCDS4159.1
augggccugaccagccagcugcugcccccccuguucuuccugcuggccugcgccggcaacuucgugcacggccacaagugcgacaucacccugcaggagaucaucaagacccugaacagccugaccgagcagaagaacaccaccgagaaggagaccuucugcagagccgccaccgugcugagacaguucuacagccaccacgagaaggacaccagaugccugggcgccaccgcccagcaguuccacagacacaagcagcugaucagauuccugaagagacuggacagaaaccuguggggccuggccggccugaacagcugccccgugaaggaggccaaccagagcacccuggagaacuuccuggagagacugaagaccaucaugagagagaaguacagcaagugcagcagcuga

SEQ ID NO: 4575 - RNA, 414 nt, Artificial Sequence
  derived and/or modified sequence opt5 from IL-4__Homo_sapiens__CCDS4159.1
augggccugaccagccagcuccugcccccucuuuucuuucugcucgccugcgcugggaacuucgugcacggacauaagugugacaucacacugcaagagauuaucaaaacgcuuaauucccugaccgaacagaagaacacaaccgagaaagaaacauuuugcagagccgcgaccguccuccggcaguucuacucucaccaugagaaggauacacgcugucugggcgcuaccgcccagcaauuucacagacauaaacagcugauucgguuccucaagcgccuggacagaaaucuuugggggcuggccggacucaacagcugcccgguuaaggaagcuaaucaguccacgcuggagaacuuucuugagcggcugaaaaccaucaugcgcgaaaaguauucuaaauguagcuccuga

SEQ ID NO: 4576 - RNA, 414 nt, Artificial Sequence
  derived and/or modified sequence opt6 from IL-4__Homo_sapiens__CCDS4159.1
augggacuaacaagccaacuacuaccaccacuauucuuccuacucgcaugcgcaggaaacuucguacacggacacaaaugcgacauaacacuacaagaaauaauaaaaacacuaaacucacuaacagaacaaaaaaacacaacagaaaaagaaacauucugcagagcagcaacaguauuaagacaauucuacagccaccacgaaaaagacacaagaugccuaggagcaacagcacaacaauuccacagacacaaacaacuaauacgauuccucaaaagacuagacagaaaccuauggggacuagcaggacuaaacucaugcccaguaaaagaagcaaaccaaagcacacuagaaaacuuucuagaaagacuaaaaacaauaaugagagaaaaauacagcaaaugcucaagcuaa

SEQ ID NO: 4577 - protein, 153 aa, Artificial Sequence [sequence omitted]

SEQ ID NO: 4578 - RNA, 462 nt, Artificial Sequence
  IL-4__Homo_sapiens__CCDS4158.1
augggucucaccucccaacugcuucccccucuguucuuccugcuagcaugugccggcaacuuuguccacggacacaagugcgauaucaccuuacaggagaucaucaaaacuuugaacagccucacagagcagaagacucugugcaccgaguugaccguaacagacaucuuugcugccuccaagaacacaacugagaaggaaaccuucugcagggcugcgacugugcuccggcaguucuacagccaccaugagaaggacacucgcugccugggugcgacugcacagcaguuccacaggcacaagcagcugauccgauuccugaaacggcucgacaggaaccucuggggccuggcgggcuugaauuccuguccugugaaggaagccaaccagaguacguuggaaaacuucuuggaaaggcuaaagacgaucaugagagagaaauauucaaaguguucgagcuga

SEQ ID NO: 4579 - RNA, 462 nt, Artificial Sequence
  derived and/or modified sequence opt1 from IL-4__Homo_sapiens__CCDS4158.1
augggccugaccagccagcuccugcccccgcuguucuuccuccuggccugcgccgggaacuucgugcacggccacaagugcgacaucacccugcaggagaucaucaagacgcucaacucccugaccgagcagaagacccugugcaccgagcucacggucaccgacaucuucgcggccagcaagaacaccaccgagaaggagacguucugccgcgccgccaccgugcugcggcaguucuacucccaccacgagaaggacacccgcugccugggggccaccgcgcagcaguuccaccggcacaagcagcucauccgcuuccugaagcggcuggaccgcaaccucuggggccuggccgggcugaacagcugccccgugaaggaggccaaccaguccacgcucgagaacuuccuggagcggcugaagaccaucaugcgcgagaaguacagcaagugcuccagcuga

SEQ ID NO: 4580 - RNA, 462 nt, Artificial Sequence
  derived and/or modified sequence opt2 from IL-4__Homo_sapiens__CCDS4158.1
augggccucaccucccagcuccuccccccccucuucuuccuccucgccugcgccggcaacuucguccacggccacaagugcgacaucacccuccaggagaucaucaagacccucaacucccucaccgagcagaagacccucugcaccgagcucaccgucaccgacaucuucgccgccuccaagaacaccaccgagaaggagaccuucugccgcgccgccaccguccuccgccaguucuacucccaccacgagaaggacacccgcugccucggcgccaccgcccagcaguuccaccgccacaagcagcucauccgcuuccucaagcgccucgaccgcaaccucuggggccucgccggccucaacuccugccccgucaaggaggccaaccaguccacccucgagaacuuccucgagcgccucaagaccaucaugcgcgagaaguacuccaagugcuccuccuga

SEQ ID NO: 4581 - RNA, 462 nt, Artificial Sequence
  derived and/or modified sequence opt3 from IL-4__Homo_sapiens__CCDS4158.1
augggccugaccagccagcuccuucccccucuguucuuuuuguuagccugcgcugggaacuucgugcacggacauaagugcgacaucacacugcaagagauuauaaaaacucuaaauucccucacggaacagaagacccugugcacagagcuuacugucaccgauaucuuugcagccucuaaaaacacaaccgaaaaggagacuuucuguagagcggcuacaguucugaggcaguuuuacucacaccaugaaaaagacacccggugcuugggugccacggcacagcaauuccaccgccauaagcagcucauucgauuucugaagcgucuggauagaaaucucuggggcuuagccgggcugaacaguuguccagugaaagaggcuaaucagagcacucuugagaacuucuuggaaaggcugaagaccaucaugcgggagaaauauuccaaguguucuucguga

SEQ ID NO: 4582 - RNA, 462 nt, Artificial Sequence
  derived and/or modified sequence opt4 from IL-4__Homo_sapiens__CCDS4158.1
augggccugaccagccagcugcugcccccccuguucuuccugcuggccugcgccggcaacuucgugcacggccacaagugcgacaucacccugcaggagaucaucaagacccugaacagccugaccgagcagaagacccugugcaccgagcugaccgugaccgacaucuucgccgccagcaagaacaccaccgagaaggagaccuucugcagagccgccaccgugcugagacaguucuacagccaccacgagaaggacaccagaugccugggcgccaccgcccagcaguuccacagacacaagcagcugaucagauuccugaagagacuggacagaaaccuguggggccuggccggccugaacagcugccccgugaaggaggccaaccagagcacccuggagaacuuccuggagagacugaagaccaucaugagagagaaguacagcaagugcagcagcuga

SEQ ID NO: 4583 - RNA, 462 nt, Artificial Sequence
  derived and/or modified sequence opt5 from IL-4__Homo_sapiens__CCDS4158.1
augggccugaccagccagcuccugcccccucuuuucuuucugcucgccugcgcugggaacuucgugcacggacauaagugugacaucacacugcaagagauuaucaaaacgcuuaauucccugaccgaacagaagacacucugcaccgagcugacagucaccgauauuuuugccgcgucuaaaaacacaaccgaaaaggagacguucuguagagcugccaccguucugcggcaguuuuacagccaccaugaaaaagacacacgcugccucggcgccaccgcucagcaauuccacagacauaagcagcugauccgguuucuuaagcgccuggauagaaaucucugggggcuggccggacuuaacuccuguccggugaaagaggcuaaucagucuacacuggagaacuuccucgaacggcugaagaccauuaugcgcgagaaauauagcaagugcuccucuuga

SEQ ID NO: 4584 - RNA, 462 nt, Artificial Sequence
  derived and/or modified sequence opt6 from IL-4__Homo_sapiens__CCDS4158.1
augggacuaacaucacaacuacuaccaccacuauucuuccuacuagcaugcgcaggaaacuucguccacggacacaaaugcgacauaacacuacaagaaauaauaaaaacacuaaacucacuaacagaacaaaaaacacuaugcacagaacuaacaguaacagacauauucgcagcaucaaaaaacacaacagaaaaagaaacauucugcagagcagcaacaguauuacgacaauucuacucacaccacgaaaaagacacaagaugccuaggagcaacagcacaacaauuccaccgacacaaacaacuaauaagauuccuaaaaagacuagacagaaaccuauggggacuagcaggauuaaacucaugcccaguaaaagaagcaaaccaaagcacacuagaaaacuuccuagaaagacuaaaaacaauaaugagagaaaaauacucaaaaugcucaucauaa

SEQ ID NO: 4585 - protein, 134 aa, Artificial Sequence
  IL-5__Homo_sapiens__P05113
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 4586 - RNA, 405 nt, Artificial Sequence
  IL-5__Homo_sapiens__AAA74469
augaggaugcuucugcauuugaguuugcuagcucuuggagcugccuacguguaugccauccccacagaaauucccacaagugcauuggugaaagagaccuuggcacugcuuucuacucaucgaacucugcugauagccaaugagacucugaggauuccuguuccuguacauaaaaaucaccaacugugcacugaagaaaucuuucagggaauaggcacacuggagagucaaacugugcaaggggguacuguggaaagacuauucaaaaacuuguccuuaauaaagaaauacauugacggccaaaaaaaaaaguguggagaagaaagacggagaguaaaccaauuccuagacuaccugcaagaguuucuugguguaaugaacaccgaguggauaauagaaaguuga

SEQ ID NO: 4587 - RNA, 405 nt, Artificial Sequence
  derived and/or modified sequence opt1 from IL-5__Homo_sapiens__AAA74469
augcgcaugcugcuccaccugagccugcucgcccugggcgccgcguacguguacgccauccccaccgagaucccgaccuccgcccuggucaaggagacgcucgcccugcugagcacccaccggacccuccugaucgccaacgagacccugcgcauccccgugcccgugcacaagaaccaccagcucugcacggaggagaucuuccaggggaucggcacccuggagucccagaccguccagggcgggaccguggagcggcuguucaagaaccucagccugaucaagaaguacaucgacgggcagaagaagaagugcggcgaggagcgccggcgcgugaaccaguuccuggacuaccuccaggaguuccugggcgucaugaacacggaguggaucaucgaguccuga

SEQ ID NO: 4588 - RNA, 405 nt, Artificial Sequence
  derived and/or modified sequence opt2 from IL-5__Homo_sapiens__AAA74469
augcgcaugcuccuccaccucucccuccucgcccucggcgccgccuacgucuacgccauccccaccgagauccccaccuccgcccucgucaaggagacccucgcccuccucuccacccaccgcacccuccucaucgccaacgagacccuccgcauccccguccccguccacaagaaccaccagcucugcaccgaggagaucuuccagggcaucggcacccucgagucccagaccguccagggcggcaccgucgagcgccucuucaagaaccucucccucaucaagaaguacaucgacggccagaagaagaagugcggcgaggagcgccgccgcgucaaccaguuccucgacuaccuccaggaguuccucggcgucaugaacaccgaguggaucaucgaguccuga

SEQ ID NO: 4589 - RNA, 405 nt, Artificial Sequence
  derived and/or modified sequence opt3 from IL-5__Homo_sapiens__AAA74469
augagaaugcugcuccaccuuagccuguuggccuuaggcgcugcauacguguaugccauccccaccgagauuccuacauccgcgcuggucaaggaaacucuagcucuccugucuacgcauaggacccuucugauagccaacgagacauugcggaucccaguuccggugcacaaaaaucaucagcucugcacugaagagauuuuccaagggaucggaacccuggaaucacagacaguacaggguggcaccguggagcgccuguuuaagaaccucaguuuaauuaaaaaguacaucgacgggcagaaaaagaaguguggagaggaacgacguagagucaaucaauuccuggauuaucuucaggaguuuuugggcgugaugaacacugaauggauaaucgagagcuga

SEQ ID NO: 4590 - RNA, 405 nt, Artificial Sequence
  derived and/or modified sequence opt4 from IL-5__Homo_sapiens__AAA74469
augagaaugcugcugcaccugagccugcuggcccugggcgccgccuacguguacgccauccccaccgagauccccaccagcgcccuggugaaggagacccuggcccugcugagcacccacagaacccugcugaucgccaacgagacccugagaauccccgugcccgugcacaagaaccaccagcugugcaccgaggagaucuuccagggcaucggcacccuggagagccagaccgugcagggcggcaccguggagagacuguucaagaaccugagccugaucaagaaguacaucgacggccagaagaagaagugcggcgaggagagaagaagagugaaccaguuccuggacuaccugcaggaguuccugggcgugaugaacaccgaguggaucaucgagagcuga

SEQ ID NO: 4591 - RNA, 405 nt, Artificial Sequence
  derived and/or modified sequence opt5 from IL-5__Homo_sapiens__AAA74469
augagaaugcugcuccaccugagccuucuggcccucggcgcugccuacguguaugcgauccccaccgagauuccuacauccgcucuggucaaggaaacgcuugcccugcucucuacccaucggacacugcugaucgccaacgagacccuccgcauuccgguucccgugcacaaaaaucaucagcugugcacagaagagaucuuccaagggauuggaacccuugaaagccagacagugcagggcgggaccgucgagagacuguuuaagaaccucucccugaucaaaaaguacaucgacggacagaaaaagaaguguggcgaggaacggcgcagagugaaucaauuccuugauuaucugcaggaguuucucgggguuaugaacacggaauggauuaucgagucuuga

SEQ ID NO: 4592 - RNA, 405 nt, Artificial Sequence
  derived and/or modified sequence opt6 from IL-5__Homo_sapiens__AAA74469
augagaaugcuacuacaccuaucacuacuagcacuaggagcagcauacguauacgcaauaccaacagaaauaccaacaucagcacuagucaaagaaacacuagcacuacuaucaacacacagaacacuauuaauagcaaacgaaacccuaagaauaccaguaccaguacacaaaaaccaccaacuaugcacagaagaaauauuccaaggaauaggaacacuagaaucacaaacaguacaaggaggaacaguagaaagacuauucaaaaaccuaucauuaauaaaaaaauacauagacggacaaaaaaaaaaaugcggagaagaaagacgaagaguaaaccaauuccuagacuacuuacaagaauuccuaggaguaaugaacacagaauggauaauagaaucauaa

SEQ ID NO: 4593 - protein, 212 aa, Artificial Sequence
  IL-6__Homo_sapiens__P05231
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 4594 - RNA, 639 nt, Artificial Sequence
  IL-6__Homo_sapiens__AAA52728
augaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcuguccagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucuucggcaaauguag

SEQ ID NO: 4595 - RNA, 639 nt, Artificial Sequence
  derived and/or modified sequence opt1 from IL-6__Homo_sapiens__AAA52728
augaacagcuucuccaccagcgccuucggccccguggccuucucccuggggcuccugcugguccucccggcggccuuccccgcccccgugcccccgggcgaggacagcaaggacguggccgcgccccaccgccagccccugaccuccagcgagcggaucgacaagcagauccgcuacauccuggacgggaucuccgcccuccggaaggagacgugcaacaagagcaacaugugcgaguccagcaaggaggcccuggccgagaacaaccugaaccuccccaagauggccgagaaggacggcugcuuccaguccggguucaacgaggagaccugccuggucaagaucaucaccggccugcucgaguucgagguguaccuggaguaccugcagaaccgcuucgagagcuccgaggagcaggcgcgggccgugcagaugagcaccaagguccucauccaguuccugcagaagaaggccaagaaccuggacgccaucacgaccccggaccccaccaccaacgccucccuccugacgaagcugcaggcgcagaaccaguggcuccaggacaugaccacccaccugauccugcgcagcuucaaggaguuccuccaguccagccugcgggcccugcgccagauguga

SEQ ID NO: 4596 - RNA, 639 nt, Artificial Sequence
  derived and/or modified sequence opt2 from IL-6__Homo_sapiens__AAA52728
augaacuccuucuccaccuccgccuucggccccgucgccuucucccucggccuccuccucguccuccccgccgccuuccccgcccccgucccccccggcgaggacuccaaggacgucgccgccccccaccgccagccccucaccuccuccgagcgcaucgacaagcagauccgcuacauccucgacggcaucuccgcccuccgcaaggagaccugcaacaaguccaacaugugcgaguccuccaaggaggcccucgccgagaacaaccucaaccuccccaagauggccgagaaggacggcugcuuccaguccggcuucaacgaggagaccugccucgucaagaucaucaccggccuccucgaguucgaggucuaccucgaguaccuccagaaccgcuucgaguccuccgaggagcaggcccgcgccguccagauguccaccaagguccucauccaguuccuccagaagaaggccaagaaccucgacgccaucaccacccccgaccccaccaccaacgccucccuccucaccaagcuccaggcccagaaccaguggcuccaggacaugaccacccaccucauccuccgcuccuucaaggaguuccuccaguccucccuccgcgcccuccgccagauguga

SEQ ID NO: 4597 - RNA, 639 nt, Artificial Sequence
  derived and/or modified sequence opt3 from IL-6__Homo_sapiens__AAA52728
augaacagcuucuccaccucugccuuuggccccguggcuuucucacuggggcuccuucuggucuugccugcagccuuuccagcgccgguucccccuggagaggacaguaaggauguggcugccccacacagacagcccuuaacaagcuccgaaaggaucgacaaacaaauucgguacauacuggaugguaucucugcacuacgcaaggagacuugcaauaaaucgaacaugugugaaucaagcaaggaggcccucgcugaaaauaaccugaaucuuccuaaaauggcagagaaggacggcugcuuccagaguggguuuaacgaggaaacgugucugguaaagauuaucaccggauugcucgaguucgaaguguaucuggaguaccugcagaaucgauuugaguccucugaagaacaggcccgugcuguccaaaugagcacaaaagugcucauucaguucuuacagaagaaagccaagaaccuggaugcgaucacuaccccagaccccacaaccaaugcaucccuuuugacuaaacugcaggcccaaaaccaguggcuacaggauaugacaacccaucucauacugagaucauuuaaggaguuccuucagaguagccugagggcuuugcggcaaauguga

SEQ ID NO: 4598 - RNA, 639 nt, Artificial Sequence
  derived and/or modified sequence opt4 from IL-6__Homo_sapiens__AAA52728
augaacagcuucagcaccagcgccuucggccccguggccuucagccugggccugcugcuggugcugcccgccgccuuccccgcccccgugccccccggcgaggacagcaaggacguggccgccccccacagacagccccugaccagcagcgagagaaucgacaagcagaucagauacauccuggacggcaucagcgcccugagaaaggagaccugcaacaagagcaacaugugcgagagcagcaaggaggcccuggccgagaacaaccugaaccugcccaagauggccgagaaggacggcugcuuccagagcggcuucaacgaggagaccugccuggugaagaucaucaccggccugcuggaguucgagguguaccuggaguaccugcagaacagauucgagagcagcgaggagcaggccagagccgugcagaugagcaccaaggugcugauccaguuccugcagaagaaggccaagaaccuggacgccaucaccacccccgaccccaccaccaacgccagccugcugaccaagcugcaggcccagaaccaguggcugcaggacaugaccacccaccugauccugagaagcuucaaggaguuccugcagagcagccugagagcccugagacagauguga

SEQ ID NO: 4599 - RNA, 639 nt, Artificial Sequence
  derived and/or modified sequence opt5 from IL-6__Homo_sapiens__AAA52728
augaacagcuucuccaccucugccuuuggccccguggcuuucagccuggggcuccugcuuguccugccugccgcguuuccggcucccguuccucccggagaggacuccaaggauguggccgccccucacagacagccccucacaucuagcgaacggaucgacaaacaaauucgcuacauccuggauggcauuuccgcucuuagaaaggagacgugcaauaaaucuaacaugugugaaagcuccaaggaggcccuggcugaaaauaaccucaaucugccuaaaauggccgagaaggacgggugcuuccagagcggauuuaacgaggaaaccugucuggugaagaucauuacaggccuccuggaguucgaagucuaucuugaguaccugcagaaucgguuugagucuuccgaagaacaggcgcgcgccgugcaaaugagcaccaaaguucucauccaguuccugcagaagaaagcuaagaaccuugaugccaucacaaccccggaccccacaaccaaugcuucucugcucacgaaacugcaggcccaaaaccaguggcugcaggauaugaccacacaucucauucugagauccuuuaaggaguuccuucagagcucucugcgggcgcuccgccaaauguga

SEQ ID NO: 4600 - RNA, 639 nt, Artificial Sequence
  derived and/or modified sequence opt6 from IL-6__Homo_sapiens__AAA52728
augaacuccuucucaacaucagcauucggaccaguagcauucucccucggacuauuacuaguauuacccgcagcauucccagcaccaguacccccaggagaagauucaaaagauguagcagcaccacaucgacaaccacuaacaucauccgaaagaauagacaaacaaauaagauacauccuagauggaaucuccgcucuaagaaaagaaaccugcaauaaauccaacaugugcgaaucaucaaaagaagcauuagcagaaaacaaccuaaaucuaccaaaaauggcagaaaaagacggaugcuuccaaucaggauucaacgaagaaacaugccuaguaaaaauaauaacaggauuauuagaauucgaaguauaccuagaauaccuacaaaacagauucgaaucuucagaagaacaagcaagagcaguacaaauguccaccaaaguacuaauacaauucuuacaaaaaaaagcaaaaaacuuagacgcaauaacaaccccagaccccacaacaaacgcaucacuacucacaaaauuacaagcccaaaaccaauggcuacaagacaugacaacacacuuaauacuaagaucauucaaagaauuccuacaauccucacuaagagcacuaagacaaauguaa

SEQ ID NO: 4601 - protein, 177 aa, Artificial Sequence [sequence omitted]

SEQ ID NO: 4602 - RNA, 534 nt, Artificial Sequence
  IL-7__Homo_sapiens__BAF84227
auguuccauguuucuuuuagguauaucuuuggacuuccuccccugauccuuguucuguugccaguagcaucaucugauugugauauugaagguaaagauagcaaacaauaugagaguguucuaauggucagcaucgaucaauuauuggacagcaugaaagaaauugguagcaauugccugaauaaugaauuuaacuuuuuuaaaagacauaucugugaugcuaauaaggaagguauguuuuuauuccgugcugcucgcaaguugaggcaauuucuuaaaaugaauagcacuggugauuuugaucuccacuuauuaaaaguuucagaaggcacaacaauacuguugaacugcacuggccagguuaaaggaagaaaaccagcugcccugggugaagcccaaccaacaaagaguuuggaagaaaauaaaucuuuaaaggaacagaaaaaacugaaugacuuguguuuccuaaagagacuauuacaagagauaaaaacuuguuggaauaaaauuuugaugggcacuaaagaacacuga

SEQ ID NO: 4603 - RNA, 534 nt, Artificial Sequence
  derived and/or modified sequence opt1 from IL-7__Homo_sapiens__BAF84227
auguuccacgugagcuuccgcuacaucuucggccugcccccgcucauccugguccugcuccccguggccuccagcgacugcgacaucgaggggaaggacuccaagcaguacgagagcgugcugauggucuccaucgaccagcugcucgacagcaugaaggagaucggcuccaacugccugaacaacgaguucaacuucuucaagcggcacaucugcgacgccaacaaggaggggauguuccuguuccgcgcggcccggaagcuccgccaguuccugaagaugaacagcaccggcgacuucgaccugcaccuccugaagguguccgaggggaccacgauccugcucaacugcaccggccaggugaagggccggaagcccgccgcccugggggaggcccagcccaccaagagccuggaggagaacaagucccucaaggagcagaagaagcugaacgaccugugcuuccucaagcgccugcugcaggagaucaagaccugcuggaacaagauccucaugggcacgaaggagcacuga

SEQ ID NO: 4604 - RNA, 534 nt, Artificial Sequence
  derived and/or modified sequence opt2 from IL-7__Homo_sapiens__BAF84227
auguuccacgucuccuuccgcuacaucuucggccuccccccccucauccucguccuccuccccgucgccuccuccgacugcgacaucgagggcaaggacuccaagcaguacgaguccguccucauggucuccaucgaccagcuccucgacuccaugaaggagaucggcuccaacugccucaacaacgaguucaacuucuucaagcgccacaucugcgacgccaacaaggagggcauguuccucuuccgcgccgcccgcaagcuccgccaguuccucaagaugaacuccaccggcgacuucgaccuccaccuccucaaggucuccgagggcaccaccauccuccucaacugcaccggccaggucaagggccgcaagcccgccgcccucggcgaggcccagcccaccaagucccucgaggagaacaagucccucaaggagcagaagaagcucaacgaccucugcuuccucaagcgccuccuccaggagaucaagaccugcuggaacaagauccucaugggcaccaaggagcacuga

SEQ ID NO: 4605 - RNA, 534 nt, Artificial Sequence
  derived and/or modified sequence opt3 from IL-7__Homo_sapiens__BAF84227
auguuccacgugagcuuuagauacaucuucggccugcccccucucauucuuguccuguugccaguugccuccucugacugcgauauagaggggaaggacucaaaacaguaugaaaguguguuaaugguaagcaucgaucaacugcuagacuccaugaaggagauuggaucuaacugucucaauaacgaauuuaauuucuuuaaaaggcauaucugcgaugcuaacaaggaggguauguuccuguuucgggcagcccgcaaacuucgacaguuccugaagaugaacucgaccggcgacuuugauuugcaccuccugaaggugucagaagggacaacuauucugcucaauuguacgggacaggucaaaggccguaagccggcggcuuuaggugaggcccagcccaccaaaagccuggaggaaaauaagagucuuaaagagcaaaagaaguugaacgaccugugcuuccuaaaaagacuccugcaggaaaucaagacauguuggaauaaaauacuuauggggacuaaggagcauuga

SEQ ID NO: 4606 - RNA, 534 nt, Artificial Sequence
  derived and/or modified sequence opt4 from IL-7__Homo_sapiens__BAF84227
auguuccacgugagcuucagauacaucuucggccugcccccccugauccuggugcugcugcccguggccagcagcgacugcgacaucgagggcaaggacagcaagcaguacgagagcgugcugauggugagcaucgaccagcugcuggacagcaugaaggagaucggcagcaacugccugaacaacgaguucaacuucuucaagagacacaucugcgacgccaacaaggagggcauguuccuguucagagccgccagaaagcugagacaguuccugaagaugaacagcaccggcgacuucgaccugcaccugcugaaggugagcgagggcaccaccauccugcugaacugcaccggccaggugaagggcagaaagcccgccgcccugggcgaggcccagcccaccaagagccuggaggagaacaagagccugaaggagcagaagaagcugaacgaccugugcuuccugaagagacugcugcaggagaucaagaccugcuggaacaagauccugaugggcaccaaggagcacuga

SEQ ID NO: 4607 - RNA, 534 nt, Artificial Sequence
  derived and/or modified sequence opt5 from IL-7__Homo_sapiens__BAF84227
auguuccacgugagcuuuagauacaucuucggccugcccccucucauucugguccuucugccgguugccuccucugacugcgauaucgaggggaaggacagcaaacaguaugaauccgugcucauggugucuauugaucaacugcuugacagcaugaaggagaucggauccaacugucugaauaacgaauuuaauuucuuuaaacggcauauuugcgaugcuaacaaggagggcauguuccucuuucgcgccgcgagaaaacugcggcaguuccugaagaugaacucuaccggggacuuugaucuccaucugcuuaaggucagcgaaggaacaacgauccugcucaauuguaccggccaggugaaagggcgcaagcccgcugcccugggagaggcccagccuacaaaaucccuugaggaaaauaagagccugaaagagcaaaagaagcucaacgaccugugcuuccugaaaagacuccugcaggaaaucaagaccuguuggaauaaaauucuuaugggcacaaaggagcacuga

SEQ ID NO: 4608 - RNA, 534 nt, Artificial Sequence
  derived and/or modified sequence opt6 from IL-7__Homo_sapiens__BAF84227
auguuccacguaucauuuagauacauauucggacuacccccacuaauacuaguacuacuaccaguagcaucaucagacugcgacauagaaggaaaagacuccaaacaauacgaaagcguacuaaugguaucaauagaucaacuacuagacucaaugaaagaaauaggaucaaacugccuaaacaacgaauucaacuucuucaaaagacacaucugcgacgcaaacaaagaaggaauguuccuauucagagcagcaagaaaacuacgacaauuccuaaaaaugaacucaacaggagacuucgaccuacaccuacuaaaaguaucagaaggaacaacaauacuauuaaacugcacaggacaaguaaaaggaagaaaaccagcagcacuaggagaagcacaaccaacaaaaucacuagaagaaaacaaaagccucaaagaacaaaaaaaacuaaacgaccuaugcuuccuaaaaagacuauuacaagaaauaaaaacaugcuggaacaaaauacuaaugggaacaaaagaacacuaa

SEQ ID NO: 4609 - protein, 177 aa, Artificial Sequence
  IL-7__Homo_sapiens__P13232
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 4610 - RNA, 534 nt, Artificial Sequence
  IL-7__Homo_sapiens__AAA59156
auguuccauguuucuuuuagguauaucuuuggacuuccuccccugauccuuguucuguugccaguagcaucaucugauugugauauugaagguaaagauggcaaacaauaugagaguguucuaauggucagcaucgaucaauuauuggacagcaugaaagaaauugguagcaauugccugaauaaugaauuuaacuuuuuuaaaagacauaucugugaugcuaauaaggaagguauguuuuuauuccgugcugcucgcaaguugaggcaauuucuuaaaaugaauagcacuggugauuuugaucuccacuuauuaaaaguuucagaaggcacaacaauacuguugaacugcacuggccagguuaaaggaagaaaaccagcugcccugggugaagcccaaccaacaaagaguuuggaagaaaauaaaucuuuaaaggaacagaaaaaacugaaugacuuguguuuccuaaagagacuauuacaagagauaaaaacuuguuggaauaaaauuuugaugggcacuaaagaacacuga

SEQ ID NO: 4611 - RNA, 534 nt, Artificial Sequence
  derived and/or modified sequence opt1 from IL-7__Homo_sapiens__AAA59156
auguuccacgugagcuuccgcuacaucuucggccugcccccgcucauccugguccugcuccccguggccuccagcgacugcgacaucgaggggaaggacggcaagcaguacgaguccgugcugauggucagcaucgaccagcugcucgacuccaugaaggagaucgggagcaacugccugaacaacgaguucaacuucuucaagcggcacaucugcgacgccaacaaggagggcauguuccuguuccgcgcggcccggaagcuccgccaguuccugaagaugaacuccaccggggacuucgaccugcaccuccugaaggugagcgagggcaccacgauccugcucaacugcaccggccaggugaaggggcggaagcccgccgcccugggcgaggcccagcccaccaagucccuggaggagaacaagagccucaaggagcagaagaagcugaacgaccugugcuuccucaagcgccugcugcaggagaucaagaccugcuggaacaagauccucauggggacgaaggagcacuga

SEQ ID NO: 4612 - RNA, 534 nt, Artificial Sequence
  derived and/or modified sequence opt2 from IL-7__Homo_sapiens__AAA59156
auguuccacgucuccuuccgcuacaucuucggccuccccccccucauccucguccuccuccccgucgccuccuccgacugcgacaucgagggcaaggacggcaagcaguacgaguccguccucauggucuccaucgaccagcuccucgacuccaugaaggagaucggcuccaacugccucaacaacgaguucaacuucuucaagcgccacaucugcgacgccaacaaggagggcauguuccucuuccgcgccgcccgcaagcuccgccaguuccucaagaugaacuccaccggcgacuucgaccuccaccuccucaaggucuccgagggcaccaccauccuccucaacugcaccggccaggucaagggccgcaagcccgccgcccucggcgaggcccagcccaccaagucccucgaggagaacaagucccucaaggagcagaagaagcucaacgaccucugcuuccucaagcgccuccuccaggagaucaagaccugcuggaacaagauccucaugggcaccaaggagcacuga

SEQ ID NO: 4613 - RNA, 534 nt, Artificial Sequence
  derived and/or modified sequence opt3 from IL-7__Homo_sapiens__AAA59156
auguuccacgugagcuuuagauacaucuucggccugcccccucucauucuuguccuguugccaguugccuccucugacugcgauauagaggggaaggacggaaaacaguaugaaucaguguuaaugguaaguaucgaucaacugcuagacagcaugaaggagauugguuccaacugucucaauaacgaauuuaauuucuuuaaaaggcauaucugcgaugcuaacaaggagggcauguuccuguuucgggcagcccgcaaacuucgacaguuccugaagaugaacucuaccggggacuuugauuugcaccuccugaaggugucggaaggaacaacuauucugcucaauuguacgggccaggucaaaggucguaagccggcggcuuuaggggaggcccagcccaccaaaucacuggaggaaaauaagagccuuaaagagcaaaagaaguugaacgaccugugcuuccuaaaaagacuccugcaggaaaucaagacauguuggaauaaaauacuuaugggaacuaaggagcauuga

SEQ ID NO: 4614 - RNA, 534 nt, Artificial Sequence
  derived and/or modified sequence opt4 from IL-7__Homo_sapiens__AAA59156
auguuccacgugagcuucagauacaucuucggccugcccccccugauccuggugcugcugcccguggccagcagcgacugcgacaucgagggcaaggacggcaagcaguacgagagcgugcugauggugagcaucgaccagcugcuggacagcaugaaggagaucggcagcaacugccugaacaacgaguucaacuucuucaagagacacaucugcgacgccaacaaggagggcauguuccuguucagagccgccagaaagcugagacaguuccugaagaugaacagcaccggcgacuucgaccugcaccugcugaaggugagcgagggcaccaccauccugcugaacugcaccggccaggugaagggcagaaagcccgccgcccugggcgaggcccagcccaccaagagccuggaggagaacaagagccugaaggagcagaagaagcugaacgaccugugcuuccugaagagacugcugcaggagaucaagaccugcuggaacaagauccugaugggcaccaaggagcacuga

SEQ ID NO: 4615 - RNA, 534 nt, Artificial Sequence
  derived and/or modified sequence opt5 from IL-7__Homo_sapiens__AAA59156
auguuccacgugagcuuuagauacaucuucggccugcccccucucauucugguccuucugccgguugccuccucugacugcgauaucgaggggaaggacggaaaacaguaugaaagcgugcucaugguguccauugaucaacugcuugacucuaugaaggagaucggcagcaacugucugaauaacgaauuuaauuucuuuaaacggcauauuugcgaugcuaacaaggaggggauguuccucuuucgcgccgcgagaaaacugcggcaguuccugaagaugaacuccaccggagacuuugaucuccaucugcuuaaggucucugaaggcacaacgauccugcucaauuguaccggacaggugaaagggcgcaagcccgcugcccugggcgaggcccagccuacaaaaagccuugaggaaaauaagucccugaaagagcaaaagaagcucaacgaccugugcuuccugaaaagacuccugcaggaaaucaagaccuguuggaauaaaauucuuaugggcacaaaggagcacuga

SEQ ID NO: 4616 - RNA, 534 nt, Artificial Sequence
  derived and/or modified sequence opt6 from IL-7__Homo_sapiens__AAA59156
auguuccacguaucauucagauacauauucggacuaccaccacuaauacuaguacuacuaccaguagcaucaucagacugcgacauagaaggaaaagacggcaaacaauacgaaucaguacuaauggucucaauagaucaauuacuagacucaaugaaagaaauaggaucaaacugccuaaacaacgaauucaacuucuucaaaagacacauaugcgacgcaaacaaagaaggaauguuccuauucagagcagcaagaaaacuaagacaauuccuaaaaaugaacucaacaggagacuucgaccuacacuuacuaaaaguaucagaaggaacaacaauacuacuaaacugcacaggacaaguaaaaggaagaaaaccagcagcacucggagaagcacaaccaacaaaaucauuagaagaaaacaaaucacuaaaagaacaaaaaaaacuaaacgauuuaugcuucuuaaaaagacuacuacaagaaauaaaaacaugcuggaacaaaauacuaaugggaacaaaagaacacuaa

SEQ ID NO: 4617 - protein, 144 aa, Artificial Sequence
  IL-9__Homo_sapiens__P15248
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 4618 - RNA, 435 nt, Artificial Sequence
  IL-9__Homo_sapiens__AAA35887
augcuucuggccaugguccuuaccucugcccugcuccugugcuccguggcaggccagggguguccaaccuuggcggggauccuggacaucaacuuccucaucaacaagaugcaggaagauccagcuuccaagugccacugcagugcuaaugugaccaguugucucuguuugggcauucccucugacaacugcaccagaccaugcuucagugagagacugucucagaugaccaauaccaccaugcaaacaagauacccacugauuuucagucgggugaaaaaaucaguugaaguacuaaagaacaacaaguguccauauuuuuccugugaacagccaugcaaccaaaccacggcaggcaacgcgcugacauuucugaagagucuucuggaaauuuuccagaaagaaaagaugagagggaugagaggcaagauauga

SEQ ID NO: 4619 - RNA, 435 nt, Artificial Sequence
  derived and/or modified sequence opt1 from IL-9__Homo_sapiens__AAA35887
augcugcucgccauggugcugaccagcgcccugcuccugugcuccgucgcgggccaggggugccccacccuggccggcauccucgacaucaacuuccugaucaacaagaugcaggaggacccggccagcaagugccacugcuccgccaacgugacgagcugccugugccucgggauccccuccgacaacugcacccgccccugcuucagcgagcggcugucccagaugaccaacaccacgaugcagacccgcuacccccugaucuucagccgggugaagaaguccgucgaggugcucaagaacaacaagugcccguacuucagcugcgagcagcccugcaaccagaccaccgccggcaacgcgcugacguuccugaagucccuccuggagaucuuccagaaggagaagaugcgcgggaugcggggcaagaucuga

SEQ ID NO: 4620 - RNA, 435 nt, Artificial Sequence
  derived and/or modified sequence opt2 from IL-9__Homo_sapiens__AAA35887
augcuccucgccaugguccucaccuccgcccuccuccucugcuccgucgccggccagggcugccccacccucgccggcauccucgacaucaacuuccucaucaacaagaugcaggaggaccccgccuccaagugccacugcuccgccaacgucaccuccugccucugccucggcauccccuccgacaacugcacccgccccugcuucuccgagcgccucucccagaugaccaacaccaccaugcagacccgcuacccccucaucuucucccgcgucaagaaguccgucgagguccucaagaacaacaagugccccuacuucuccugcgagcagcccugcaaccagaccaccgccggcaacgcccucaccuuccucaagucccuccucgagaucuuccagaaggagaagaugcgcggcaugcgcggcaagaucuga

SEQ ID NO: 4621 - RNA, 435 nt, Artificial Sequence
  derived and/or modified sequence opt3 from IL-9__Homo_sapiens__AAA35887
augcugcucgccauggugcuuaccagcgcucuguuguuaugcuccgucgcaggccaggggugucccacacuggccggaauccuagacauuaacuuccucauaaauaagaugcaagaagauccugcgucuaaaugccacuguucagcuaacguuacgaguugccugugucuugguaucccaagcgacaauugcacuagaccguguuuuuccgaaaggcugucucagaugaccaacacaacuaugcagacccgguaccccuugauuuucucgcgcgugaagaaaucaguagaggugcucaagaauaacaaaugcccuuauuuuagcugugaacagccaugcaaucaaacaaccgccggcaacgcacugacuuuccugaagagucucuuagagaucuuucagaaggagaaaaugcgagggaugcguggaaagauuuga

SEQ ID NO: 4622 - RNA, 435 nt, Artificial Sequence
  derived and/or modified sequence opt4 from IL-9__Homo_sapiens__AAA35887
augcugcuggccauggugcugaccagcgcccugcugcugugcagcguggccggccagggcugccccacccuggccggcauccuggacaucaacuuccugaucaacaagaugcaggaggaccccgccagcaagugccacugcagcgccaacgugaccagcugccugugccugggcauccccagcgacaacugcaccagacccugcuucagcgagagacugagccagaugaccaacaccaccaugcagaccagauacccccugaucuucagcagagugaagaagagcguggaggugcugaagaacaacaagugccccuacuucagcugcgagcagcccugcaaccagaccaccgccggcaacgcccugaccuuccugaagagccugcuggagaucuuccagaaggagaagaugagaggcaugagaggcaagaucuga

SEQ ID NO: 4623 - RNA, 435 nt, Artificial Sequence
  derived and/or modified sequence opt5 from IL-9__Homo_sapiens__AAA35887
augcugcucgccauggugcugaccagcgcucugcugcucugcuccgucgccggccaggggugucccacacuggcgggaauccuugacauuaacuuccugaucaauaagaugcaagaagauccugcuucuaaaugccacuguagcgccaacguuacguccugccucugucugggcauuccgucugacaauugcaccagacccuguuuuagcgaacggcugucccagaugacaaacaccacaaugcagacccgcuacccucucaucuucucuagagugaagaaaagcguggagguccugaagaauaacaaaugccccuauuuuuccugugaacagccuugcaaucaaacaaccgccgggaacgcucuuacguuccuuaagagccuccuggagauuuuucagaaggagaaaaugcggggaaugcgcggcaagaucuga

SEQ ID NO: 4624 - RNA, 435 nt, Artificial Sequence
  derived and/or modified sequence opt6 from IL-9__Homo_sapiens__AAA35887
augcuacuagcaaugguacuaacaucagcacuacuacuaugcucaguagcaggacaaggaugcccaacauuagcaggaauauuagacauaaacuuccuaauaaacaaaaugcaagaagacccagcaucaaaaugccacugcucagcaaacguaacaucaugccuaugccuaggaauaccaucagacaacugcacaagaccaugcuucuccgaaagacuaucacaaaugacaaacacaacaaugcaaacacgauacccacuaauauucucaagaguaaaaaaaucaguagaaguacuaaaaaacaacaaaugcccauacuucucaugcgaacaaccaugcaaccaaacaacagcaggaaacgcacuaacauuccuaaaaucacuacuagaaaucuuccaaaaagaaaaaaugagaggaaugagaggaaaaauauaa

SEQ ID NO: 4625 - protein, 202 aa, Artificial Sequence
  LIF__Homo_sapiens__P15018
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 4626 - RNA, 609 nt, Artificial Sequence
  LIF__Homo_sapiens__AAA51699
augaaggucuuggcggcaggaguugugccccugcuguugguucugcacuggaaacauggggcggggagcccccuccccaucaccccugucaacgccaccugugccauacgccacccaugucacaacaaccucaugaaccagaucaggagccaacuggcacagcucaauggcagugccaaugcccucuuuauucucuauuacacagcccagggggagccguuccccaacaaccuggacaagcuauguggccccaacgugacggacuucccgcccuuccacgccaacggcacggagaaggccaagcugguggagcuguaccgcauagucguguaccuuggcaccucccugggcaacaucacccgggaccagaagauccucaaccccagugcccucagccuccacagcaagcucaacgccaccgccgacauccugcgaggccuccuuagcaacgugcugugccgccugugcagcaaguaccacgugggccauguggacgugaccuacggcccugacaccucggguaaggaugucuuccagaagaagaagcugggcugucaacuccuggggaaguauaagcagaucaucgccguguuggcccaggccuucuag

SEQ ID NO: 4627 - RNA, 609 nt, Artificial Sequence
  derived and/or modified sequence opt1 from LIF__Homo_sapiens__AAA51699
augaaggugcuggccgccggcgucgugccccuccugcuggugcuccacuggaagcacggggcgggcagcccgcugcccaucacccccgucaacgcgaccugcgccauccgccaccccugccacaacaaccugaugaaccagauccggucccagcucgcccagcugaacgggagcgccaacgcccuguucauccucuacuacacggcccagggcgagccguuccccaacaaccuggacaagcugugcgggcccaacgugaccgacuucccgcccuuccacgccaacggcaccgagaaggccaagcucguggagcuguaccgcaucgucguguaccugggcaccucccucgggaacaucacgcgggaccagaagauccugaaccccagcgcgcugucccuccacagcaagcugaacgccaccgccgacauccugcgcggccuccuguccaacgugcugugccggcucugcagcaaguaccacgucgggcacguggacgugaccuacggccccgacaccuccgggaaggacgucuuccagaagaagaagcugggcugccagcugcucggcaaguacaagcagaucaucgccgugcuggcccaggcguucuga

SEQ ID NO: 4628 - RNA, 609 nt, Artificial Sequence
  derived and/or modified sequence opt2 from LIF__Homo_sapiens__AAA51699
augaagguccucgccgccggcgucgucccccuccuccucguccuccacuggaagcacggcgccggcuccccccuccccaucacccccgucaacgccaccugcgccauccgccaccccugccacaacaaccucaugaaccagauccgcucccagcucgcccagcucaacggcuccgccaacgcccucuucauccucuacuacaccgcccagggcgagcccuuccccaacaaccucgacaagcucugcggccccaacgucaccgacuucccccccuuccacgccaacggcaccgagaaggccaagcucgucgagcucuaccgcaucgucgucuaccucggcaccucccucggcaacaucacccgcgaccagaagauccucaaccccuccgcccucucccuccacuccaagcucaacgccaccgccgacauccuccgcggccuccucuccaacguccucugccgccucugcuccaaguaccacgucggccacgucgacgucaccuacggccccgacaccuccggcaaggacgucuuccagaagaagaagcucggcugccagcuccucggcaaguacaagcagaucaucgccguccucgcccaggccuucuga

SEQ ID NO: 4629 - RNA, 609 nt, Artificial Sequence
  derived and/or modified sequence opt3 from LIF__Homo_sapiens__AAA51699
augaaggugcuggccgcuggcgucguuccccuccuucugguguugcacuggaaacauggggcaggaagcccuuuaccaaucaccccgguaaacgccacaugcgcgauuagacaccccugucauaauaaccugaugaaucagauaaggucccaacuagcucagcucaacgguucugccaaugcacuguucauccuuuacuauacugcccagggcgagccuuuuccaaacaaucuggacaaguugugcgggcccaacgugacggauuucccuccauuucacgcuaauggaaccgaaaaagcaaagcucgucgagcuguaccggauugugguuuaucugggcacaucacucgguaacaucacucgcgaccagaaaauuuuaaaucccagugcccugagccuucauuccaaguugaacgcuaccgccgauauccugcgagggcuacucucuaaugugcugugucgucuuugcucgaaguaccacgucggacacguggacguaacauauggcccugauaccucaggcaaagacguuuuccaaaagaaaaagcuggggugucaguugcucggaaaauacaagcagauaaucgcggugcuggcacaggccuuuuga

SEQ ID NO: 4630 - RNA, 609 nt, Artificial Sequence
  derived and/or modified sequence opt4 from LIF__Homo_sapiens__AAA51699
augaaggugcuggccgccggcguggugccccugcugcuggugcugcacuggaagcacggcgccggcagcccccugcccaucacccccgugaacgccaccugcgccaucagacaccccugccacaacaaccugaugaaccagaucagaagccagcuggcccagcugaacggcagcgccaacgcccuguucauccuguacuacaccgcccagggcgagcccuuccccaacaaccuggacaagcugugcggccccaacgugaccgacuucccccccuuccacgccaacggcaccgagaaggccaagcugguggagcuguacagaaucgugguguaccugggcaccagccugggcaacaucaccagagaccagaagauccugaaccccagcgcccugagccugcacagcaagcugaacgccaccgccgacauccugagaggccugcugagcaacgugcugugcagacugugcagcaaguaccacgugggccacguggacgugaccuacggccccgacaccagcggcaaggacguguuccagaagaagaagcugggcugccagcugcugggcaaguacaagcagaucaucgccgugcuggcccaggccuucuga

SEQ ID NO: 4631 - RNA, 609 nt, Artificial Sequence
  derived and/or modified sequence opt5 from LIF__Homo_sapiens__AAA51699
augaaggugcuggccgcuggcgucguuccccuccugcuugugcugcacuggaaacauggggccggaagcccucucccgaucacccccgugaacgcgacaugcgcuauuagacacccuugucauaauaaccugaugaaucagauccggucccaacuugcccagcugaacggcucugccaaugcucucuucauucuguacuauacggcccagggggagcccuuuccuaacaaucuggacaagcucugcggacccaacgucaccgauuucccuccguuucacgcuaauggcacagaaaaagccaagcugguggagcuuuaccgcaucguuguguaucuggggaccagccucggaaacauuacaagagaccagaaaauccugaaucccuccgcgcuuucucugcauagcaagcucaacgccaccgcugauauccugcggggccugcucuccaauguccugugucgccuuugcucuaaguaccacgugggccacguugacgugacauaugggccugauaccagcggaaaagacgucuuccaaaagaaaaagcugggcugucagcuccuggggaaauacaagcagauuaucgccgugcuugcucaggccuuuuga

SEQ ID NO: 4632 - RNA, 609 nt, Artificial Sequence
  derived and/or modified sequence opt6 from LIF__Homo_sapiens__AAA51699
augaaaguacuagcagccggagucguaccacuacuauuaguacuacacuggaaacacggagcaggaucaccucuaccaauaacaccaguaaacgcaacuugcgcaauaagacacccaugccacaacaaccuaaugaaccaaauaagaucacaacuagcacaacuaaacggaucagcaaacgcacuauucauauuauacuacacagcacaaggagaaccauucccaaacaaccuagacaaacuaugcggaccaaacguaacagacuucccaccauuucacgcaaacggaacagaaaaagcaaaauuaguagaacuauacagaauaguaguauaccuaggaacaucacuaggaaacauaacaagagaccaaaaaauauuaaacccaucagcacuaucacuacacucaaaacuaaacgcaacagcagacauauuaagaggacuacuauccaacguauuaugcagacuaugcucaaaauaccacguaggacauguagacguaacauacggaccagacacaucagguaaagacguauuccaaaaaaaaaaauuaggaugccaauuacuaggaaaauacaaacaaauaauagcaguacuagcacaagcauuuuaa

SEQ ID NO: 4633 - protein, 240 aa, Artificial Sequence
  LIGHT__Homo_sapiens__O43557
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 4634 - RNA, 723 nt, Artificial Sequence
  LIGHT__Homo_sapiens__AAC25169
auggaggagagugucguacggcccucaguguuugugguggauggacagaccgacaucccauucacgaggcugggacgaagccaccggagacagucgugcaguguggcccgggugggucugggucucuugcuguugcugaugggggcugggcuggccguccaaggcugguuccuccugcagcugcacuggcgucuaggagagauggucacccgccugccugacggaccugcaggcuccugggagcagcugauacaagagcgaaggucucacgaggucaacccagcagcgcaucucacaggggccaacuccagcuugaccggcagcggggggccgcuguuaugggagacucagcugggccuggccuuccugaggggccucagcuaccacgauggggcccuuguggucaccaaagcuggcuacuacuacaucuacuccaaggugcagcugggcggugugggcugcccgcugggccuggccagcaccaucacccacggccucuacaagcgcacaccccgcuaccccgaggagcuggagcuguuggucagccagcagucacccugcggacgggccaccagcagcucccgggucuggugggacagcagcuuccuggguggugugguacaccuggaggcuggggagaagguggucguccgugugcuggaugaacgccugguucgacugcgugaugguacccggucuuacuucggggcuuucaugguguga

SEQ ID NO: 4635 - RNA, 723 nt, Artificial Sequence
  derived and/or modified sequence opt1 from LIGHT__Homo_sapiens__AAC25169
auggaggagagcgugguccgccccuccguguucguggucgacggccagaccgacaucccguucacccggcuggggcgcagccaccggcgccaguccugcagcguggcccgggugggccucgggcugcugcuccugcugaugggcgccgggcucgcgguccagggcugguuccugcugcagcuccacuggcgccugggcgagauggugacgcggcugcccgacgggcccgccggcuccugggagcagcucauccaggagcgccggagccacgaggugaaccccgccgcccaccugaccggggccaacuccagccugaccggcuccgggggcccgcuccugugggagacccagcugggccucgcguuccugcgcgggcugagcuaccacgacggcgcccucgucgugacgaaggccggguacuacuacaucuacuccaaggugcagcugggcggcgucgggugcccccugggccucgccagcaccaucacccacgggcuguacaagcggacgccccgcuaccccgaggagcuggagcuccuggugucccagcagagcccgugcggccgggcgaccuccagcucccgcguguggugggacagcuccuuccucgggggcgucgugcaccuggaggccggcgagaagguggucgugcgggugcuggacgagcgccugguccggcuccgcgacgggacccggagcuacuucggcgccuucaugguguga

SEQ ID NO: 4636 - RNA, 723 nt, Artificial Sequence
  derived and/or modified sequence opt2 from LIGHT__Homo_sapiens__AAC25169
auggaggaguccgucguccgccccuccgucuucgucgucgacggccagaccgacauccccuucacccgccucggccgcucccaccgccgccaguccugcuccgucgcccgcgucggccucggccuccuccuccuccucaugggcgccggccucgccguccagggcugguuccuccuccagcuccacuggcgccucggcgagauggucacccgccuccccgacggccccgccggcuccugggagcagcucauccaggagcgccgcucccacgaggucaaccccgccgcccaccucaccggcgccaacuccucccucaccggcuccggcggcccccuccucugggagacccagcucggccucgccuuccuccgcggccucuccuaccacgacggcgcccucgucgucaccaaggccggcuacuacuacaucuacuccaagguccagcucggcggcgucggcugcccccucggccucgccuccaccaucacccacggccucuacaagcgcaccccccgcuaccccgaggagcucgagcuccucgucucccagcagucccccugcggccgcgccaccuccuccucccgcgucuggugggacuccuccuuccucggcggcgucguccaccucgaggccggcgagaaggucgucguccgcguccucgacgagcgccucguccgccuccgcgacggcacccgcuccuacuucggcgccuucauggucuga

SEQ ID NO: 4637 - RNA, 723 nt, Artificial Sequence
  derived and/or modified sequence opt3 from LIGHT__Homo_sapiens__AAC25169
auggaggaaagcguggucagacccuccguuuucgugguagacggccagaccgauaucccuuuuacaaggcuggggcggucucaccgccgacaaucaugcaguguggcccgugucggacucggucuucuguuguuacugaugggcgcugggcuagcagugcagggaugguuccuccugcagcuucauuggagacugggcgagaugguuacuagguugccagacgguccggccgggagcugggaacagcucauucaagagcggcgcucccacgaagugaaccccgcggcucaucugacgggagccaauucuucgcugaccggcucaggcgggccucucuuaugggagacacagcugggacuugcauuuuugagaggucugagcuaccacgauggcgcccuagucgugacuaaggcuggguauuacuauauauacaguaaaguacagcucggaggcguugguuguccacuggggcuugcauccaccaucacacauggacuguauaagaggacuccccgguacccugaggaauuggagcuccuggugucucagcaaagcccaugcggccgcgccaccuccucaagucgagucuggugggacagcucuuucuuaggcgggguggugcaccuggaagcuggagagaaagucguugugagaguacucgaugagaggcuugugcggcugcgugacgguacacgcuccuauuuuggcgccuucauggucuga

SEQ ID NO: 4638 - RNA, 723 nt, Artificial Sequence
  derived and/or modified sequence opt4 from LIGHT__Homo_sapiens__AAC25169
auggaggagagcguggugagacccagcguguucgugguggacggccagaccgacauccccuucaccagacugggcagaagccacagaagacagagcugcagcguggccagagugggccugggccugcugcugcugcugaugggcgccggccuggccgugcagggcugguuccugcugcagcugcacuggagacugggcgagauggugaccagacugcccgacggccccgccggcagcugggagcagcugauccaggagagaagaagccacgaggugaaccccgccgcccaccugaccggcgccaacagcagccugaccggcagcggcggcccccugcugugggagacccagcugggccuggccuuccugagaggccugagcuaccacgacggcgcccugguggugaccaaggccggcuacuacuacaucuacagcaaggugcagcugggcggcgugggcugcccccugggccuggccagcaccaucacccacggccuguacaagagaacccccagauaccccgaggagcuggagcugcuggugagccagcagagccccugcggcagagccaccagcagcagcagaguguggugggacagcagcuuccugggcggcguggugcaccuggaggccggcgagaaggugguggugagagugcuggacgagagacuggugagacugagagacggcaccagaagcuacuucggcgccuucaugguguga

SEQ ID NO: 4639 - RNA, 723 nt, Artificial Sequence
  derived and/or modified sequence opt5 from LIGHT__Homo_sapiens__AAC25169
auggaggaaagcguggucagacccuccguuuucgugguggacggccagaccgauaucccuuuuacacggcuggggcgcucucacagacggcaaagcugcuccgucgcccgcgugggacucggccugcuucugcuccugaugggggcuggacuugccguucagggcugguuccugcuccagcugcauuggagacugggggagauggugacgcggcucccggacggacccgcgggcucuugggaacagcugauucaagagcgcagaagccacgaagucaacccugcugcccaucuuaccggcgccaauuccucucugacagggagcggaggcccccuccugugggagacccagcuugggcuggcuuuucuccggggacuguccuaccacgauggcgcccuggugguuacaaaggcuggguauuacuauaucuacagcaaagugcagcucggaggcgucggcuguccucuggggcuugccucuaccauuacacauggacuguauaagcgcacccccagauacccugaggaacucgagcugcuugugucccagcaaagcccgugcggccgggcgacgucuuccagccgcguguggugggacucuuccuuccucgggggagucguucaccuggaagccggcgagaaagugguggucagagugcuggaugagcggcugguucgccucagagacgggacccggagcuauuuuggagcuuucaugguguga

SEQ ID NO: 4640 - RNA, 723 nt, Artificial Sequence
  derived and/or modified sequence opt6 from LIGHT__Homo_sapiens__AAC25169
auggaagaaaguguaguaagaccaaguguuuuuguaguagauggacaaacagauauaccauuuacaagauuaggaagaucacaucgaagacaaaguuguaguguggcaagaguaggauuaggauuauuauuauuacuaaugggugcgggauuagcaguacaaggaugguuuuuauuacaauugcauuggagguuaggugaaauggugacuagauuaccggacggaccugcaggaaguugggaacaacuaauacaagaaagaagaucacacgaaguaaauccagcagcacaccuaacaggagcaaauaguucauuaacaggaaguggagguccauuguuaugggaaacacaauuagguuuagcauuuuuaagaggauuaaguuaucaugauggagcauuaguaguaacaaaagcaggauauuauuauauauauucaaaaguacaauuaggaggaguuggguguccauuaggauuagcgagcacgauaacacauggauuauacaaaaggacaccaagauauccugaagaauuagaauuacuaguaagucaacaaucaccauguggaagagcaacaaguucaaguagaguauggugggauaguucauuucuaggaggaguaguacauuuagaagcaggagaaaaaguaguuguaagaguauuagaugaaagguuaguaagacuaagagaugguacaagaucauauuuuggagcauuuaugguauaa

SEQ ID NO: 4641 - protein, 561 aa, Artificial Sequence [sequence omitted]

SEQ ID NO: 4642 - RNA, 1686 nt, Artificial Sequence
  LTalpha__Homo_sapiens__BAG62860
augcccgagauaguggauacaaaggaccuuacaauagaaaaaguagugaucaauggacaagaagucaaauaugcucuuggagaaagacaaaguuacaagggaucgccaauggaaaucucucuuccuaucgcuuugagcaaaaaucaagaaauuguuauagaaauuucuuuugagaccucuccaaaaucuucugcucuccaguggcucacuccugaacagacuucugggaaggaacacccauaucucuuuagucagugccaggccauccacugcagagcaauccuuccuugucaggacacuccuucugugaaauuaaccuauacugcagaggugucugucccuaaagaacugguggcacuuaugagugcuauucgugauggagaaacaccugacccagaagacccaagcaggaaaauauacaaauucauccaaaaaguuccaauacccugcuaccugauugcuuuaguuguuggagcuuuagaaagcaggcaaauuggcccaagaacuuugguguggucugagaaagagcagguggaaaagucugcuuaugaguuuucugagacugaaucuaugcuuaaaauagcagaagaucugggaggaccguauguauggggacaguaugaccuauugguccugccaccauccuucccuuaugguggcauggagaauccuugccuuacuuuuguaacuccuacucuacuggcaggcgacaagucacucuccaaugucauugcacaugaaauaucucauagcuggacagggaaucuagugaccaacaaaacuugggaucacuuuugguuaaaugagggacauacuguguacuuggaacgccacauuugcggacgauuguuuggugaaaaguucagacauuuuaaugcucugggaggauggggagaacuacagaauucgguaaagacauuuggggagacacauccuuucaccaaacuugugguugaucugacagauauagacccugauguagcuuauucuucaguucccuaugagaagggcuuugcuuuacuuuuuuaccuugaacaacugcuuggaggaccagagauuuuccuaggauucuuaaaagcuuauguugagaaguuuuccuauaagagcauaacuacugaugacuggaaggauuuccuguauuccuauuuuaaagauaagguugauguucucaaucaaguugauuggaaugccuggcucuacucuccuggacugccucccauaaagcccaauuaugauaugacucugacaaaugcuuguauugccuuaagucaaagauggauuacugccaaagaagaugauuuaaauucauucaaugccacagaccugaaggaucucucuucucaucaauugaaugaguuuuuagcacagacgcuccagagggcaccucuuccauuggggcacauaaagcgaaugcaagagguguacaacuucaaugccauuaacaauucugaaauacgauucagauggcugcggcucugcauucaauccaagugggaggacgcaauuccuuuggcgcuaaagauggcaacugaacaaggaagaaugaaguuuacccggcccuuauucaaggaucuugcugccuuugacaaaucccaugaucaagcuguccgaaccuaccaagagcacaaagcaagcaugcaucccgugacugcaaugcugguggggaaagacuuaaaaguggauuaa

SEQ ID NO: 4643 - RNA, 1686 nt, Artificial Sequence
  derived and/or modified sequence opt1 from LTalpha__Homo_sapiens__BAG62860
augcccgagaucguggacaccaaggaccugaccaucgagaaggucgugaucaacggccaggaggugaaguacgcccucggggagcgccagagcuacaagggcuccccgauggagaucagccugcccaucgcccuguccaagaaccaggagaucgucaucgagaucagcuucgagacgucccccaagagcuccgcgcuccaguggcugacccccgagcagaccagcgggaaggagcacccguaccuguucucccagugccaggccauccacugccgggccauccuccccugccaggacacccccagcgugaagcugacguacaccgccgagguguccguccccaaggagcugguggcccucaugagcgcgauccgcgacggcgagaccccggaccccgaggaccccucccggaagaucuacaaguucauccagaaggugcccaucccgugcuaccugaucgcccuggucgugggggcccucgagagccgccagaucggcccccggacccuggugugguccgagaaggagcaggucgagaaguccgccuacgaguucagcgagacggagagcaugcugaagaucgcggaggaccucggcgggcccuacguguggggccaguacgaccugcuggugcugcccccguccuuccccuacgggggcauggagaaccccugccugaccuucgucacccccacccugcucgccggggacaagagccugagcaacgugaucgcccacgagaucucccacagcuggacgggcaaccuggugaccaacaagaccugggaccacuucuggcucaacgagggccacaccgucuaccuggagcgccacaucugcgggcggcuguucggcgagaaguuccgccacuucaacgcccucgggggcuggggcgagcugcagaacuccgugaagacguucggggagacccacccguucaccaagcugguggucgaccucaccgacaucgaccccgacguggccuacagcuccgugcccuacgagaagggcuucgcgcugcuguucuaccucgagcagcugcucgggggccccgagaucuuccucggguuccugaaggccuacgucgagaaguucagcuacaaguccaucacgaccgacgacuggaaggacuuccuguacagcuacuucaaggacaagguggacguccucaaccagguggacuggaacgccuggcuguacuccccgggccugccgcccaucaagcccaacuacgacaugacccucaccaacgccugcaucgcccugagccagcgguggaucacggcgaaggaggacgaccugaacuccuucaacgccaccgaccucaaggaccugagcucccaccagcugaacgaguuccucgcccagacccugcagcgcgcgccccugccccugggccacaucaagcggaugcaggagguguacaacuucaacgccaucaacaacagcgagauccgcuuccgguggcuccgccugugcauccaguccaagugggaggacgccaucccccuggcccucaagauggccaccgagcaggggcggaugaaguucacgcgcccgcuguucaaggaccuggccgccuucgacaagagccacgaccaggcgguccggaccuaccaggagcacaaggccuccaugcaccccgugaccgccaugcucgugggcaaggaccugaaggucgacuga

SEQ ID NO: 4644 - RNA, 1686 nt, Artificial Sequence
  derived and/or modified sequence opt2 from LTalpha__Homo_sapiens__BAG62860
augcccgagaucgucgacaccaaggaccucaccaucgagaaggucgucaucaacggccaggaggucaaguacgcccucggcgagcgccaguccuacaagggcucccccauggagaucucccuccccaucgcccucuccaagaaccaggagaucgucaucgagaucuccuucgagaccucccccaaguccuccgcccuccaguggcucacccccgagcagaccuccggcaaggagcaccccuaccucuucucccagugccaggccauccacugccgcgccauccuccccugccaggacacccccuccgucaagcucaccuacaccgccgaggucuccguccccaaggagcucgucgcccucauguccgccauccgcgacggcgagacccccgaccccgaggaccccucccgcaagaucuacaaguucauccagaagguccccauccccugcuaccucaucgcccucgucgucggcgcccucgagucccgccagaucggcccccgcacccucgucugguccgagaaggagcaggucgagaaguccgccuacgaguucuccgagaccgaguccaugcucaagaucgccgaggaccucggcggccccuacgucuggggccaguacgaccuccucguccucccccccuccuuccccuacggcggcauggagaaccccugccucaccuucgucacccccacccuccucgccggcgacaagucccucuccaacgucaucgcccacgagaucucccacuccuggaccggcaaccucgucaccaacaagaccugggaccacuucuggcucaacgagggccacaccgucuaccucgagcgccacaucugcggccgccucuucggcgagaaguuccgccacuucaacgcccucggcggcuggggcgagcuccagaacuccgucaagaccuucggcgagacccaccccuucaccaagcucgucgucgaccucaccgacaucgaccccgacgucgccuacuccuccguccccuacgagaagggcuucgcccuccucuucuaccucgagcagcuccucggcggccccgagaucuuccucggcuuccucaaggccuacgucgagaaguucuccuacaaguccaucaccaccgacgacuggaaggacuuccucuacuccuacuucaaggacaaggucgacguccucaaccaggucgacuggaacgccuggcucuacucccccggccucccccccaucaagcccaacuacgacaugacccucaccaacgccugcaucgcccucucccagcgcuggaucaccgccaaggaggacgaccucaacuccuucaacgccaccgaccucaaggaccucuccucccaccagcucaacgaguuccucgcccagacccuccagcgcgccccccucccccucggccacaucaagcgcaugcaggaggucuacaacuucaacgccaucaacaacuccgagauccgcuuccgcuggcuccgccucugcauccaguccaagugggaggacgccaucccccucgcccucaagauggccaccgagcagggccgcaugaaguucacccgcccccucuucaaggaccucgccgccuucgacaagucccacgaccaggccguccgcaccuaccaggagcacaaggccuccaugcaccccgucaccgccaugcucgucggcaaggaccucaaggucgacuga

SEQ ID NO: 4645 - RNA, 1686 nt, Artificial Sequence
  derived and/or modified sequence opt3 from LTalpha__Homo_sapiens__BAG62860
augcccgagaucguggacaccaaggaucugacaauugaaaaagucguuauaaacggccaggaggugaaguacgcccucggggaaagacaaagcuauaaaggauccccuauggagaucucucuuccaauugcucugucaaagaaucaggaaaucguaauugagaucaguuucgagacuagcccgaaauccucugcauugcagugguuaacgcccgaacagaccucggguaaggagcacccuuaccuguuuucacaaugccaggccauacauuguagggcgauccuaccaugccaggacacacccagcgugaagcucacuuauaccgcugaagucagugugccuaaagagcugguugcccuuauguccgcaauucgggauggcgagacaccagaccccgaagauccuucucgcaagaucuacaaauucauucagaaggugccaaucccguguuaucugauagccuuggucgugggggcucucgagagccgacaaauuggaccccguacccugguaugguccgaaaaagagcagguugaaaagucagcauacgaguuuagugagacugaaagcaugcugaagaucgccgaggaccucggcgguccuuaugugugggggcaguacgauuuacugguccuuccacccucuuucccuuacggaggcauggaaaacccaugcuugacauuugugacccccacgcugcuagcuggcgacaaaucccucucaaaugugauugcccacgagaucagccauaguuggacugggaaccuggucaccaauaagacaugggaucacuucuggcuuaacgaaggacauacuguuuaucuggagagacacaucugugguagguuguuuggcgagaaauuccggcacuuuaaugcgcucgggggauggggcgaacugcagaacucugugaagaccuucggugagacacauccguuuaccaaauuaguaguggaccugacggauauugacccugaugucgcauacuccagcgugcccuaugaaaagggguucgcccuccuguuuuaccuugagcaauugcuaggaggcccagaaauauuccugggcuuccucaaggcuuauguugagaaauuuucguacaagucuaucacuacagacgacuggaaagauuuccuguauuccuacuuuaaggacaaaguggauguccuuaaucagguggacuggaacgccuggcuguacucaccuggguugcccccaauuaagcccaauuaugauaugacccucacuaacgcaugcaucgcucugagucagcgcuggauaacagccaaagaggacgauuuaaauagcuucaacgcgaccgaccugaaggaucuauccucucaccaacucaaugaauuucuggcccagacgcuucagagagcaccuuugccacugggacauauuaagaggaugcaggagguauacaacuucaacgcuaucaauaacagcgaaauccgguuucgcuggcuccgacuguguauucaaucaaaaugggaggacgccaucccgcuugcucugaagauggccaccgagcaggguagaaugaaauucacaaggcccuuguuuaaggaucucgcagccuucgacaaaagucacgaccaggcuguucggacuuaucaggaacacaaggcguccaugcauccugugaccgcaaugcuggucggcaaggauuuaaaaguggacuga

SEQ ID NO: 4646 - RNA, 1686 nt, Artificial Sequence
  derived and/or modified sequence opt4 from LTalpha__Homo_sapiens__BAG62860
augcccgagaucguggacaccaaggaccugaccaucgagaagguggugaucaacggccaggaggugaaguacgcccugggcgagagacagagcuacaagggcagccccauggagaucagccugcccaucgcccugagcaagaaccaggagaucgugaucgagaucagcuucgagaccagccccaagagcagcgcccugcaguggcugacccccgagcagaccagcggcaaggagcaccccuaccuguucagccagugccaggccauccacugcagagccauccugcccugccaggacacccccagcgugaagcugaccuacaccgccgaggugagcgugcccaaggagcugguggcccugaugagcgccaucagagacggcgagacccccgaccccgaggaccccagcagaaagaucuacaaguucauccagaaggugcccauccccugcuaccugaucgcccugguggugggcgcccuggagagcagacagaucggccccagaacccugguguggagcgagaaggagcagguggagaagagcgccuacgaguucagcgagaccgagagcaugcugaagaucgccgaggaccugggcggccccuacguguggggccaguacgaccugcuggugcugccccccagcuuccccuacggcggcauggagaaccccugccugaccuucgugacccccacccugcuggccggcgacaagagccugagcaacgugaucgcccacgagaucagccacagcuggaccggcaaccuggugaccaacaagaccugggaccacuucuggcugaacgagggccacaccguguaccuggagagacacaucugcggcagacuguucggcgagaaguucagacacuucaacgcccugggcggcuggggcgagcugcagaacagcgugaagaccuucggcgagacccaccccuucaccaagcuggugguggaccugaccgacaucgaccccgacguggccuacagcagcgugcccuacgagaagggcuucgcccugcuguucuaccuggagcagcugcugggcggccccgagaucuuccugggcuuccugaaggccuacguggagaaguucagcuacaagagcaucaccaccgacgacuggaaggacuuccuguacagcuacuucaaggacaagguggacgugcugaaccagguggacuggaacgccuggcuguacagccccggccugccccccaucaagcccaacuacgacaugacccugaccaacgccugcaucgcccugagccagagauggaucaccgccaaggaggacgaccugaacagcuucaacgccaccgaccugaaggaccugagcagccaccagcugaacgaguuccuggcccagacccugcagagagccccccugccccugggccacaucaagagaaugcaggagguguacaacuucaacgccaucaacaacagcgagaucagauucagauggcugagacugugcauccagagcaagugggaggacgccaucccccuggcccugaagauggccaccgagcagggcagaaugaaguucaccagaccccuguucaaggaccuggccgccuucgacaagagccacgaccaggccgugagaaccuaccaggagcacaaggccagcaugcaccccgugaccgccaugcuggugggcaaggaccugaagguggacuga

SEQ ID NO: 4647 - RNA, 1686 nt, Artificial Sequence
  derived and/or modified sequence opt5 from LTalpha__Homo_sapiens__BAG62860
augcccgagaucguggacaccaaggaucugacaauugaaaaagucguuaucaacggccaggaggugaaguacgcccucggggaaagacaaagcuauaaaggauccccuauggagauuucucugccgaucgcucuuagcaagaaucaggaaauugugaucgagaucuccuucgagacgucucccaaaagcuccgcccugcaguggcucaccccugaacagacaucuggcaaggagcaccccuaccuguuuagccaaugccaggcgauucauugucgggcuauccuuccuugccaggacacccccuccgucaagcugacauauaccgccgaagugagcguuccuaaagagcucguggcccugaugucugcuauucgcgauggggagacaccggaccccgaagauccuuccagaaagaucuacaaauucauucagaagguccccaucccuuguuaucugauugcccucgugguuggagcucuggagagccggcaaaucggcccccgcacccuuguguggucugaaaaagagcaggucgaaaaguccgccuacgaguuuagcgagacggaaucuaugcugaagaucgcggaggaccucgggggaccguauguguggggccaguacgaucugcuugugcugccucccuccuucccuuacggcgggauggaaaaccccugccucaccuuugucacacccacccugcuggccggagacaaaagccucuccaauguuauugcucacgagaucucucauagcuggacaggcaaccuggugaccaauaagacgugggaucacuucuggcuuaacgaagggcauacaguguaucuggagagacacauuuguggacggcucuuuggcgagaaauuccgccacuuuaaugcccuugggggauggggcgaacugcagaacuccgucaagaccuucggcgagacacauccuuuuaccaaacuggugguugaccucaccgauaucgacccggauguggcuuacagcucuguccccuaugaaaagggguucgcccugcuguuuuaccucgagcaacugcuuggaggcccugaaauuuuccugggguuccucaaagcguauguggagaaguuuuccuacaagagcaucacaacggacgacuggaaagauuuccuguauucuuacuuuaaggacaaaguugaugugcuuaaucaggucgacuggaacgccuggcuguacagccccggacucccucccaucaagccgaauuaugauaugacccugacaaacgcuugcauugcccugucccagagauggaucaccgcuaaagaggacgaucucaauucuuucaacgccacagaccugaaggaucuuagcucccaccaacugaaugaauuucucgcccagacccugcagcgggcuccucugccccuuggccauauuaagcgcaugcaggagguguacaacuucaacgcgaucaauaacagcgaaauuagauuucgguggcuccgccuguguauccaaucuaaaugggaggacgccaucccucuggcucucaagauggccacggagcaggggagaaugaaauucacacggccccuguuuaaggaucuugccgcuuucgacaaaucccacgaccaggccguccgcaccuaucaggaacacaaggcgagcaugcauccugugaccgcuaugcugguuggaaaggaucucaaaguggacuga

SEQ ID NO: 4648 - RNA, 1686 nt, Artificial Sequence
  derived and/or modified sequence opt6 from LTalpha__Homo_sapiens__BAG62860
augccagaaauaguagacacaaaagaccucacaauagaaaaaguugucauaaauggacaagaagucaaauaugcacucggagaaagacaaucauacaaaggaucaccaauggaaauaucauuaccaauagcauuaaguaaaaaccaagaaaucguaauagaaauaaguuucgaaacaucuccaaaaucauccgccuuacaauggcugaccccggaacaaacaucaggaaaagaacauccauaccuauuuucacaaugucaagcaauacacugcagagcuauacuaccaugccaagacacaccaucaguaaaacuaacauauaccgcagaagucucagucccaaaagaauuaguugcacuaauguccgcaauaagagacggugaaacaccugauccagaagacccaucucgaaaaauauacaaauucauacaaaaaguaccaaucccaugcuauuuaauagcacucguaguaggagcacucgaaagccgacagauaggcccacgaacacuaguauggucagaaaaagaacaaguagaaaaaucagcauacgaauuuucagaaacagaaucaaugcuaaaaauagcagaagaccucgggggaccauacguguggggacaauacgaccuucuaguacuaccaccaaguuucccauacggaggaauggaaaaucccugucucaccuuuguaacaccaaccuuauuagcaggagauaaaucacugagcaauguaauagcgcaugaaauaucacacucauggacaggaaaucucguaacaaauaaaacaugggaucauuuuuggcuaaacgaaggucacacaguuuaucuugaacgacauauuugcggacgucuauucggagaaaaauuuagacacuucaaugcauuaggaggauggggagaacuucaaaacucgguaaaaaccuuuggagaaacacacccauucaccaaacuaguagucgauuuaacagauauagauccagacguagcauauucaaguguaccauacgaaaaaggauucgcacuccuauucuaccucgagcaacuccucgguggcccugaaauauuucuaggauucuuaaaagcauauguagaaaaauuuagcuacaaaucgauaacaacagaugauuggaaagauuuccuuuauuccuacuucaaagacaaaguagacguauuaaaccaagucgauuggaacgcauggcuauacuccccagguuuaccaccuauaaaaccaaacuacgauaugacucucacaaacgcuugcauagcacucucacaaagauggaucacugcaaaagaagacgaccuaaauuccuucaacgcaacagacuuaaaagaccucagcucacaccaauuaaacgaauuccucgcacaaacgcuccaaagagcacccuuaccauugggucacauaaaacgaaugcaagaaguauacaacuucaacgcuauaaacaacuccgaaaucagauuccgauggcuaagauuauguauccaaucaaaaugggaagacgcaauaccacuagccuuaaaaauggcaacugaacaaggacgaaugaaauucacuagacccuuauucaaagacuuagcagcauucgacaaaucacaugaccaggcaguaagaacauaccaagaacacaaagcuucuaugcaccccguaacugcaauguuaguaggaaaagaucucaaagucgacuaa

SEQ ID NO: 4649 - protein, 205 aa, Artificial Sequence
  LTalpha__Homo_sapiens__P01374
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 4650 - RNA, 618 nt, Artificial Sequence
  LTalpha__Homo_sapiens__AAA61199
augacaccaccugaacgucucuuccucccaaggguguguggcaccacccuacaccuccuccuucuggggcugcugcugguucugcugccuggggcccaggggcucccugguguuggccucacaccuucagcugcccagacugcccgucagcaccccaagaugcaucuugcccacagcacccucaaaccugcugcucaccucauuggagaccccagcaagcagaacucacugcucuggagagcaaacacggaccgugccuuccuccaggaugguuucuccuugagcaacaauucucuccugguccccaccaguggcaucuacuucgucuacucccagguggucuucucugggaaagccuacucucccaaggccaccuccuccccacucuaccuggcccaugagguccagcucuucuccucccaguaccccuuccaugugccucuccucagcucccagaagaugguguauccagggcugcaggaacccuggcugcacucgauguaccacggggcugcguuccagcucacccagggagaccagcuauccacccacacagauggcaucccccaccuaguccucagcccuaguacugucuucuuuggagccuucgcucuguag

SEQ ID NO: 4651 - RNA, 618 nt, Artificial Sequence
  derived and/or modified sequence opt1 from LTalpha__Homo_sapiens__AAA61199
augacgcccccggagcgccuguuccucccccgggugugcggcaccacccugcaccuccuccugcuggggcuccugcugguccuccugcccggcgcccaggggcugcccggcguggggcucaccccgagcgccgcgcagaccgcccgccagcaccccaagaugcaccuggcccacuccacccugaagcccgccgcccaccucaucggcgaccccagcaagcagaacucccugcuguggcgggcgaacacggaccgcgccuuccuccaggacggcuucagccuguccaacaacagccugcucgugccgaccuccgggaucuacuucgucuacagccaggugguguucuccggcaaggccuacagccccaaggccaccuccagcccccuguaccuggcgcacgagguccagcuguucuccagccaguaccccuuccacgugccgcugcuguccagccagaagaugguguaccccgggcuccaggagcccuggcugcacuccauguaccacggcgccgccuuccagcugacccagggggaccagcucagcacgcacaccgacggcaucccccaccugguccuguccccgagcaccguguucuucggcgccuucgcccucuga

SEQ ID NO: 4652 - RNA, 618 nt, Artificial Sequence
  derived and/or modified sequence opt2 from LTalpha__Homo_sapiens__AAA61199
augaccccccccgagcgccucuuccucccccgcgucugcggcaccacccuccaccuccuccuccucggccuccuccucguccuccuccccggcgcccagggccuccccggcgucggccucacccccuccgccgcccagaccgcccgccagcaccccaagaugcaccucgcccacuccacccucaagcccgccgcccaccucaucggcgaccccuccaagcagaacucccuccucuggcgcgccaacaccgaccgcgccuuccuccaggacggcuucucccucuccaacaacucccuccucguccccaccuccggcaucuacuucgucuacucccaggucgucuucuccggcaaggccuacucccccaaggccaccuccuccccccucuaccucgcccacgagguccagcucuucuccucccaguaccccuuccacgucccccuccucuccucccagaagauggucuaccccggccuccaggagcccuggcuccacuccauguaccacggcgccgccuuccagcucacccagggcgaccagcucuccacccacaccgacggcaucccccaccucguccucucccccuccaccgucuucuucggcgccuucgcccucuga

SEQ ID NO: 4653 - RNA, 618 nt, Artificial Sequence
  derived and/or modified sequence opt3 from LTalpha__Homo_sapiens__AAA61199
augacacccccugagagacuguuccucccaagggugugcggcaccacucuucaccuguuguuacuggggcuacuccugguccuucugccgggagcccaggguuugcccggcguugggcucacgccuagcgcugcacaaaccgcccggcagcauccaaagaugcaccuggcgcauuccacacugaaacccgcugcccaccucaucggagacccuucuaagcagaacucauuacuguggcgcgcaaauacugaucgagccuuucuucaggacggcuucaguuugagcaacaauucccugcuagugccaaccucugguauuuacuuuguauauucgcaaguggucuucucagggaaggcuuacagccccaaagcaacaaguuccccucucuaucuggcccaugaagugcagcuguuuucuagccaguacccauuccacguuccgcuuuuguccucacagaaaaugguguaucccggacuccaagagccuuggcugcacaguauguaccauggcgcugccuuucaguuaacccagggcgaucagcugagcacucacacagacgggauaccacaucucguccuuucucccuccaccguguucuuuggagcguucgcacuguga

SEQ ID NO: 4654 - RNA, 618 nt, Artificial Sequence
  derived and/or modified sequence opt4 from LTalpha__Homo_sapiens__AAA61199
augaccccccccgagagacuguuccugcccagagugugcggcaccacccugcaccugcugcugcugggccugcugcuggugcugcugcccggcgcccagggccugcccggcgugggccugacccccagcgccgcccagaccgccagacagcaccccaagaugcaccuggcccacagcacccugaagcccgccgcccaccugaucggcgaccccagcaagcagaacagccugcuguggagagccaacaccgacagagccuuccugcaggacggcuucagccugagcaacaacagccugcuggugcccaccagcggcaucuacuucguguacagccaggugguguucagcggcaaggccuacagccccaaggccaccagcagcccccuguaccuggcccacgaggugcagcuguucagcagccaguaccccuuccacgugccccugcugagcagccagaagaugguguaccccggccugcaggagcccuggcugcacagcauguaccacggcgccgccuuccagcugacccagggcgaccagcugagcacccacaccgacggcaucccccaccuggugcugagccccagcaccguguucuucggcgccuucgcccuguga

SEQ ID NO: 4655 - RNA, 618 nt, Artificial Sequence
  derived and/or modified sequence opt5 from LTalpha__Homo_sapiens__AAA61199
augacacccccugagagacuguuccucccgcgggugugcggcaccacgcugcaccuucugcuccuggggcuucugcucguccugcugcccggagcccagggccucccugggguuggacugacccccagcgcugcccaaacagcgcgccagcauccuaagaugcaccuugcucauuccacccugaaacccgccgcccaccucaucggcgacccuucuaagcagaacagccugcuuuggagagcuaauacagaucgggccuuucugcaggacggguucucccucucuaacaauagccugcuggugccgaccuccggaauuuacuuuguguauucucaagucguguucagcggcaaggcuuacucccccaaagccacaagcucuccucucuaucuggcgcaugaaguucagcuguuuuccagccaguaccccuuccacgugccucuucucucuucccagaaaauggucuaucccggccugcaagagccguggcuucacagcauguaccauggggccgcuuuucagcugacccagggagaucagcucucuacgcacaccgacggcaucccucaucuggugcugucccccagcacaguuuucuuuggggccuucgcucucuga

SEQ ID NO: 4656 - RNA, 618 nt, Artificial Sequence
  derived and/or modified sequence opt6 from LTalpha__Homo_sapiens__AAA61199
augacaccaccagaaagacuauuccuaccacgcgucugcggaacaacauuacaccucuuacuacuaggacuacuauuaguauuacuaccaggagcacaaggccuaccaggaguaggacuaacaccaucagcugcacaaacagcacgccaacacccaaaaaugcacuuagcacacucaacuuuaaaaccagcagcacaucuaauaggagacccaucaaaacaaaacucacuauuauggagagcaaacacagacagagcauuccuacaagacggauucuccuuaucaaacaacucacuccuaguaccaacaucaggaauauacuucguauacucacaaguaguauuuucaggaaaagcauacucacccaaagcaacaucaucaccccuauaccuagcacacgaaguacaacuauucucaucucaauacccauuccacguacccuuacuaucuucacaaaaaaugguauacccaggccuacaagaaccaugguuacacucaauguaccacggagcagcauuccaacuaacacaaggcgaccaauuaucaacacacacagacggaauaccacaccuaguacuaucaccaucaacagucuucuucggagcauucgcacuauaa

SEQ ID NO: 4657 - protein, 611 aa, Artificial Sequence
  LTalpha__Homo_sapiens__P09960
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 4658 - RNA, 1836 nt, Artificial Sequence
  LTalpha__Homo_sapiens__AAA36176
augcccgagauaguggauaccuguucguuggccucuccggcuuccgucugccggaccaagcaccugcaccugcgcugcagcgucgacuuuacucgccggacgcugaccgggacugcugcucucacgguccagucucaggaggacaaucugcgcagccugguuuuggauacaaaggaccuuacaauagaaaaaguagugaucaauggacaagaagucaaauaugcucuuggagaaagacaaaguuacaagggaucgccaauggaaaucucucuuccuaucgcuuugagcaaaaaucaagaaauuguuauagaaauuucuuuugagaccucuccaaaaucuucugcucuccaguggcucacuccugaacagacuucugggaaggaacacccauaucucuuuagucagugccaggccauccacugcagagcaauccuuccuugucaggacacuccuucugugaaauuaaccuauacugcagaggugucugucccuaaagaacugguggcacuuaugagugcuauucgugauggagaaacaccugacccagaagacccaagcaggaaaauauacaaauucauccaaaaaguuccaauacccugcuaccugauugcuuuaguuguuggagcuuuagaaagcaggcaaauuggcccaagaacuuugguguggucugagaaagagcagguggaaaagucugcuuaugaguuuucugagacugaaucuaugcuuaaaauagcagaagaucugggaggaccguauguauggggacaguaugaccuauugguccugccaccauccuucccuuaugguggcauggagaauccuugccuuacuuuuguaacuccuacucuacuggcaggcgacaagucacucuccaaugucauugcacaugaaauaucucauagcuggacagggaaucuagugaccaacaaaacuugggaucacuuuugguuaaaugagggacauacuguguacuuggaacgccacauuugcggacgauuguuuggugaaaaguucagacauuuuaaugcucugggaggauggggagaacuacagaauucgguaaagacauuuggggagacacauccuuucaccaaacuugugguugaucugacagauauagacccugauguagcuuauucuucaguucccuaugagaagggcuuugcuuuacuuuuuuaccuugaacaacugcuuggaggaccagagauuuuccuaggauucuuaaaagcuuauguugagaaguuuuccuauaagagcauaacuacugaugacuggaaggauuuccuguauuccuauuuuaaagauaagguugauguucucaaucaaguugauuggaaugccuggcucuacucuccuggacugccucccauaaagcccaauuaugauaugacucugacaaaugcuuguauugccuuaagucaaagauggauuacugccaaagaagaugauuuaaauucauucaaugccacagaccugaaggaucucucuucucaucaauugaaugaguuuuuagcacagacgcuccagagggcaccucuuccauuggggcacauaaagcgaaugcaagagguguacaacuucaaugccauuaacaauucugaaauacgauucagauggcugcggcucugcauucaauccaagugggaggacgcaauuccuuuggcgcuaaagauggcaacugaacaaggaagaaugaaguuuacccggcccuuauucaaggaucuugcugccuuugacaaaucccaugaucaagcuguccgaaccuaccaagagcacaaagcaagcaugcaucccgugacugcaaugcugguggggaaagacuuaaaaguggauuaa

SEQ ID NO: 4659 - RNA, 1836 nt, Artificial Sequence
  derived and/or modified sequence opt1 from LTalpha__Homo_sapiens__AAA36176
augcccgagaucguggacacgugcagccuggccuccccggccagcgucugccgcaccaagcaccuccaccuccggugcuccguggacuucacccgccggacccugaccggcaccgcggcccugacggugcagagccaggaggacaaccugcgcucccugguccucgacaccaaggaccugaccaucgagaagguggugaucaacgggcaggaggucaaguacgcccugggcgagcggcagagcuacaaggggucccccauggagaucagccuccccaucgcccuguccaagaaccaggagaucgugaucgagaucagcuucgagaccucccccaagagcuccgcccugcaguggcucacgccggagcagaccagcggcaaggagcaccccuaccuguucucccagugccaggcgauccacugccgcgccauccugcccugccaggacacccccagcgugaagcucaccuacacggccgaggucuccgugccgaaggagcugguggcccugaugagcgcgauccgggacggggagacccccgaccccgaggaccccucccgcaagaucuacaaguucauccagaaggucccgauccccugcuaccucaucgcccugguggugggcgcccuggagagccggcagaucggcccccgcacccucgucuggagcgagaaggagcaggucgagaaguccgccuacgaguucagcgagaccgaguccaugcugaagaucgccgaggaccucgggggccccuacgugugggggcaguacgaccugcuggugcugccgcccagcuuccccuacggcgggauggagaaccccugccucacguucgugaccccgacccugcuggcgggcgacaagucccucagcaacgugaucgcccacgagaucucccacagcuggaccggcaaccuggucacgaacaagaccugggaccacuucuggcugaacgaggggcacaccguguaccucgagcggcacaucugcggccgccuguucggggagaaguuccggcacuucaacgcccugggcggcuggggcgagcuccagaacuccgugaagaccuucggggagacgcaccccuucaccaagcuggucguggaccugaccgacaucgaccccgacgucgccuacagcuccgugcccuacgagaagggguucgcccuccuguucuaccuggagcagcuccugggcgggccggagaucuuccugggcuuccucaaggcguacguggagaaguucagcuacaaguccaucaccacggacgacuggaaggacuuccuguacagcuacuucaaggacaaggucgacgugcugaaccagguggacuggaacgccuggcucuacucccccggccugccgcccaucaagcccaacuacgacaugacccugaccaacgccugcaucgcccugagccagcgcuggaucaccgccaaggaggacgaccucaacuccuucaacgcgacggaccugaaggaccugagcucccaccagcucaacgaguuccuggcccagacccugcagcgggcgccccucccccuggggcacaucaagcgcaugcaggaggucuacaacuucaacgccaucaacaacagcgagauccgguuccgcuggcugcggcucugcauccagagcaagugggaggacgccaucccgcuggcccugaagauggccaccgagcagggccgcaugaaguucacccggccccucuucaaggaccuggccgccuucgacaagucccacgaccaggcggugcgcacguaccaggagcacaaggccagcaugcaccccgugaccgccaugcuggucgggaaggaccucaagguggacuga

SEQ ID NO: 4660 - RNA, 1836 nt, Artificial Sequence
  derived and/or modified sequence opt2 from LTalpha__Homo_sapiens__AAA36176
augcccgagaucgucgacaccugcucccucgccucccccgccuccgucugccgcaccaagcaccuccaccuccgcugcuccgucgacuucacccgccgcacccucaccggcaccgccgcccucaccguccagucccaggaggacaaccuccgcucccucguccucgacaccaaggaccucaccaucgagaaggucgucaucaacggccaggaggucaaguacgcccucggcgagcgccaguccuacaagggcucccccauggagaucucccuccccaucgcccucuccaagaaccaggagaucgucaucgagaucuccuucgagaccucccccaaguccuccgcccuccaguggcucacccccgagcagaccuccggcaaggagcaccccuaccucuucucccagugccaggccauccacugccgcgccauccuccccugccaggacacccccuccgucaagcucaccuacaccgccgaggucuccguccccaaggagcucgucgcccucauguccgccauccgcgacggcgagacccccgaccccgaggaccccucccgcaagaucuacaaguucauccagaagguccccauccccugcuaccucaucgcccucgucgucggcgcccucgagucccgccagaucggcccccgcacccucgucugguccgagaaggagcaggucgagaaguccgccuacgaguucuccgagaccgaguccaugcucaagaucgccgaggaccucggcggccccuacgucuggggccaguacgaccuccucguccucccccccuccuuccccuacggcggcauggagaaccccugccucaccuucgucacccccacccuccucgccggcgacaagucccucuccaacgucaucgcccacgagaucucccacuccuggaccggcaaccucgucaccaacaagaccugggaccacuucuggcucaacgagggccacaccgucuaccucgagcgccacaucugcggccgccucuucggcgagaaguuccgccacuucaacgcccucggcggcuggggcgagcuccagaacuccgucaagaccuucggcgagacccaccccuucaccaagcucgucgucgaccucaccgacaucgaccccgacgucgccuacuccuccguccccuacgagaagggcuucgcccuccucuucuaccucgagcagcuccucggcggccccgagaucuuccucggcuuccucaaggccuacgucgagaaguucuccuacaaguccaucaccaccgacgacuggaaggacuuccucuacuccuacuucaaggacaaggucgacguccucaaccaggucgacuggaacgccuggcucuacucccccggccucccccccaucaagcccaacuacgacaugacccucaccaacgccugcaucgcccucucccagcgcuggaucaccgccaaggaggacgaccucaacuccuucaacgccaccgaccucaaggaccucuccucccaccagcucaacgaguuccucgcccagacccuccagcgcgccccccucccccucggccacaucaagcgcaugcaggaggucuacaacuucaacgccaucaacaacuccgagauccgcuuccgcuggcuccgccucugcauccaguccaagugggaggacgccaucccccucgcccucaagauggccaccgagcagggccgcaugaaguucacccgcccccucuucaaggaccucgccgccuucgacaagucccacgaccaggccguccgcaccuaccaggagcacaaggccuccaugcaccccgucaccgccaugcucgucggcaaggaccucaaggucgacuga

SEQ ID NO: 4661 - RNA, 1836 nt, Artificial Sequence
  derived and/or modified sequence opt3 from LTalpha__Homo_sapiens__AAA36176
augcccgagaucguggauaccugcagccuggccuccccugcuucugucuguagaacaaagcaccuccaucuuaggugcucaguugacuucacucggcgcacgcugaccggcacagcagccuugacugugcagagucaagaagacaacuuacgaagccugguacuagauaccaaagaccucacaauugagaagguggucauaaaugggcaggaagugaaauacgcgcugggagagcgucaguccuauaaggguucuccaauggaaaucucgcuuccgauugcucugucaaagaaccaggagaucguuauugagaucagcuuugaaaccagucccaaguccucugccuugcaauggcucacuccugagcagacaagcggcaaggaacacccauaccuguucucccagugucaggcaauacauugcagagccauccugcccugucaagauaccccuucagugaaacucacguauacugcugaggucagugugccaaaggaguuaguagcacugaugagcgccauuagggacggggaaacccccgauccugaggacccaucucggaaaaucuacaaguuuauucagaaaguuccgauccccugcuaucuuauagcuuugguggucggagcccuggaaucccgccagauuggcccuagaacacuuguguggucagagaaggaacagguggagaaaagcgcguacgaguucagugaaacugagucuaugcucaaaaucgcagaagaucugggugggccauaugucuggggacaauacgaccuucugguuuugcccccuuccuuuccauacggcggcauggagaaucccugucucaccuucgugacaccgacccuguuagccggggauaagagccugucgaacguaauugcucacgaaaucucucauuccuggacgggaaaucucgugacuaacaaaacaugggaccacuuuuggcuuaaugagggucacaccgucuaucuggagaggcauaucugcggccgguuguucggggaaaaguuucgccacuucaacgcccuaggaggcuggggugagcugcaaaauucagugaaaacuuuuggggaaacacauccuuucaccaagcucguuguggaucugacggacauugaccccgaugucgcauacaguagcgugccauaugagaaaggauuugcucuacuguucuacuuggaacagcuccugggcggcccugagauauucuuaggguuucugaaggccuauguagagaaguucuccuacaaaucuaucaccacagacgauuggaaggacuuucuauauagcuacuucaaagauaagguugacgugcucaaccaggucgauuggaaugcguggcuguacucacccggacuuccacccauuaaaccuaacuaugacaugacuuugaccaaugccuguaucgcacugagucagcgauggauaacagcuaaggaagaugaccucaacuccuuuaaugccacugaucugaaggaccuuagcucucaccagcugaacgaguucuuggcucagacccuccaaagagccccacugccguuaggucacauuaaaaggaugcaggaaguguacaacuuuaaugcaaucaacaauucagagauccgguuccguuggcugcgccuaugcauucagaguaagugggaggacgccaucccccucgcucugaaaauggcgacagaacagggcagaaugaaguuuaccaggccucuuuucaaagauuuggcagccuuugacaagagccaugaucaagcuguccggacuuaucaggagcacaaggccuccaugcauccagugacggcaaugcugguugggaaagaccucaagguggauuga

SEQ ID NO: 4662 - RNA, 1836 nt, Artificial Sequence
  derived and/or modified sequence opt4 from LTalpha__Homo_sapiens__AAA36176
augcccgagaucguggacaccugcagccuggccagccccgccagcgugugcagaaccaagcaccugcaccugagaugcagcguggacuucaccagaagaacccugaccggcaccgccgcccugaccgugcagagccaggaggacaaccugagaagccuggugcuggacaccaaggaccugaccaucgagaagguggugaucaacggccaggaggugaaguacgcccugggcgagagacagagcuacaagggcagccccauggagaucagccugcccaucgcccugagcaagaaccaggagaucgugaucgagaucagcuucgagaccagccccaagagcagcgcccugcaguggcugacccccgagcagaccagcggcaaggagcaccccuaccuguucagccagugccaggccauccacugcagagccauccugcccugccaggacacccccagcgugaagcugaccuacaccgccgaggugagcgugcccaaggagcugguggcccugaugagcgccaucagagacggcgagacccccgaccccgaggaccccagcagaaagaucuacaaguucauccagaaggugcccauccccugcuaccugaucgcccugguggugggcgcccuggagagcagacagaucggccccagaacccugguguggagcgagaaggagcagguggagaagagcgccuacgaguucagcgagaccgagagcaugcugaagaucgccgaggaccugggcggccccuacguguggggccaguacgaccugcuggugcugccccccagcuuccccuacggcggcauggagaaccccugccugaccuucgugacccccacccugcuggccggcgacaagagccugagcaacgugaucgcccacgagaucagccacagcuggaccggcaaccuggugaccaacaagaccugggaccacuucuggcugaacgagggccacaccguguaccuggagagacacaucugcggcagacuguucggcgagaaguucagacacuucaacgcccugggcggcuggggcgagcugcagaacagcgugaagaccuucggcgagacccaccccuucaccaagcuggugguggaccugaccgacaucgaccccgacguggccuacagcagcgugcccuacgagaagggcuucgcccugcuguucuaccuggagcagcugcugggcggccccgagaucuuccugggcuuccugaaggccuacguggagaaguucagcuacaagagcaucaccaccgacgacuggaaggacuuccuguacagcuacuucaaggacaagguggacgugcugaaccagguggacuggaacgccuggcuguacagccccggccugccccccaucaagcccaacuacgacaugacccugaccaacgccugcaucgcccugagccagagauggaucaccgccaaggaggacgaccugaacagcuucaacgccaccgaccugaaggaccugagcagccaccagcugaacgaguuccuggcccagacccugcagagagccccccugccccugggccacaucaagagaaugcaggagguguacaacuucaacgccaucaacaacagcgagaucagauucagauggcugagacugugcauccagagcaagugggaggacgccaucccccuggcccugaagauggccaccgagcagggcagaaugaaguucaccagaccccuguucaaggaccuggccgccuucgacaagagccacgaccaggccgugagaaccuaccaggagcacaaggccagcaugcaccccgugaccgccaugcuggugggcaaggaccugaagguggacuga

SEQ ID NO: 4663 - RNA, 1836 nt, Artificial Sequence
  derived and/or modified sequence opt5 from LTalpha__Homo_sapiens__AAA36176
augcccgagaucguggauaccugcagccuggccuccccugcuucugucuguagaacaaagcaccuccaucugcggugcagcguugacuucacgcgcagaacccuuacaggcaccgccgcgcugacagugcagucccaagaagacaaccuccggucucuggugcuugauaccaaagaccugacaauugagaaggucgugaucaaugggcaggaaguuaaauacgcucucggagagcgccagagcuauaagggcuccccgauggaaauuucucugcccaucgcccugagcaaaaaccaggagauugugaucgagaucuccuuugaaaccagcccuaagucuuccgcccuccaauggcugacgcccgagcagaccagcgggaaggaacacccuuaccuuuucucucagugucaggcuauucauugcagagccauccugcccugucaagauacaccuuccgucaaacucaccuauacagcugaggugagcguuccgaaggagcugguggcccuuaugucugcgauucgggacggagaaacccccgauccugaggaccccucccgcaaaaucuacaaguuuauucagaaagucccuauccccugcuaucugauugcccucguggugggcgcucuggaaagcagacagaucgggccgcggacgcuggucugguccgagaaggaacagguugagaagucugccuacgaguucagcgaaacagaguccaugcucaaaaucgcugaagaucugggaggcccuuauguguggggccaauacgaccuucuggugcugcccccuagcuuucccuacgggggaauggagaaucccugucucaccuucgucacaccuacccuucuggccggcgauaagucucucuccaacgugauugcgcacgaaaucagccauucuuggaccgggaaucugguuacaaacaaaacgugggaccacuuuuggcugaaugagggacacaccguguaucucgagcgccauauuugcggcagacuguucggggaaaaguuucggcacuucaacgcccuuggaggcuggggcgagcugcagaauagcgucaaaacauuuggggaaacccauccguucacaaagcucgugguugaucugaccgacaucgaccccgauguggcuuacuccucugucccuuaugagaaaggauuugcccuucuguucuaccucgaacagcugcugggcgggcccgagauuuuccucggauuucugaaggcuuauguggagaaguucagcuacaaauccaucacgacagacgauuggaaggacuuucuuuauagcuacuucaaagauaaggucgacgugcugaaccaaguugauuggaaugccuggcucuacucuccuggccugcccccgaucaaaccuaacuaugacaugacccugaccaaugccuguauugcucuuucccagcgcuggaucacagcgaaggaagaugaccucaacagcuuuaaugccaccgaucugaaggaccugucuucccaccagcucaacgaguuccuggcucagacacuucaaagagcuccccugccucucgggcacauuaaacggaugcaggaaguguacaacuuuaaugccaucaacaauagcgagauucgcuucagauggcugcggcugugcauccaguccaagugggaggacgccaucccccuugcccucaaaauggcgacggaacagggaagaaugaaguuuacccgcccucuguucaaagaucuggcugccuuugacaagucucaugaucaagccguccggacauaucaggagcacaaggcuagcaugcaucccgugaccgccaugcucguuggcaaagaccugaagguggauuga

SEQ ID NO: 4664 - RNA, 1836 nt, Artificial Sequence
  derived and/or modified sequence opt6 from LTalpha__Homo_sapiens__AAA36176
augccagaaauaguagauacuuguucacuagcaagcccagcaucugucuguagaacuaaacaccuacaccucaggugcucuguagauuucacacgacgaacauuaacaggcacagcugcacuuacaguacaaucacaagaagauaacuuaagaagcuuaguacuagacacaaaagacuuaacuauagagaaaguuguaauaaauggucaagaaguaaaauaugcacuuggugaacgucaaucauacaaaggaucuccuauggaaauaucauuacccaucgcuuuaagcaaaaaccaagaaauugucauugaaaucuccuucgaaacaagcccaaaaucaucagcacuacaauggcuaaccccugagcaaacuucaggcaaagaacaccccuacuuauucucacaaugucaagcaauacacuguagggcaauauuaccaugucaagacacaccaucaguuaaacuaacuuauaccgcagaaguaucaguacccaaagaauuaguagccuuaaugucagcaauaagagauggagaaacucccgacccagaagaucccagccguaaaauuuauaaauucauucagaaaguaccuauaccuuguuaccuaauugcccuagucgucggagcccuagaaagcagacaaauaggaccaagaacacuaguauggagugagaaagaacaaguagaaaaauccgccuaugaauuuucagaaacagaaucaauguuaaaaauagcagaggaucucggaggaccauacguuuggggucaauacgaucuccuaguauuaccuccaucauuccccuacggaggaauggaaaaucccugucuaacauucguaaccccaacauuacuagcaggagauaaaucgcuauccaacguaauugcacaugaaauaucacauucauggacagguaaccuaguaacaaacaaaacaugggaucacuucugguuaaaugaaggacauacaguauaccuagaacgucauauaugcggcagacuuuucggagaaaaguuucgacacuuuaacgcacuagguggcuggggggaacuccaaaacucaguuaaaacauuuggagaaacacaucccuucacaaaacuaguaguagaucuaaccgauauugacccagacguugcuuauucaucaguuccauacgaaaaaggauucgcacuacuauuuuaccuagaacaacuuuuaggcggaccugaaauuuucuuaggcuuucuaaaagcauacguagaaaaauuuaguuauaaaucaaucacaacagaugacuggaaagauuucuuauauucguacuucaaggauaaaguagacguacuaaaucaaguagacuggaacgcauggcuauacucuccaggacucccuccaauuaaacccaacuacgauaugacauuaacaaacgcauguauagcacuaucacaaagauggauuacagcuaaagaagacgaccuuaauucauucaacgcaacagauuuaaaagaccuaucaucucaucaacucaacgaauuccuagcacaaaccuuacaaagagcaccacuaccacuaggacacauaaaaagaaugcaagaagucuauaacuuuaacgcaauaaauaacucagaaauuagauuuagauggcucagacucuguauacaaucaaaaugggaggaugcaauaccauuagcacuaaaaauggcaacagaacaagguagaaugaaauuuacaagaccucuuuuuaaagaccucgccgcauucgacaaaucacacgaccaagcaguaagaacuuaucaagaacacaaggccucaaugcauccaguaacagcaaugcuaguuggaaaagauuuaaaagucgauuaa

SEQ ID NO: 4665 - protein, 205 aa, Artificial Sequence
  LTalpha__Homo_sapiens__Q5ST95
MTPPERLFLPRVCGTTLHLLLLGLLLVLLPGAQGLPGVGLTPSAAQTARQHPKMHLAHSNLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 4666 - RNA, 618 nt, Artificial Sequence
  LTalpha__Homo_sapiens__BAE78638
augacaccaccugaacgucucuuccucccaaggguguguggcaccacccuacaccuccuccuucuggggcugcugcugguucugcugccuggggcccaggggcucccugguguuggccucacaccuucagcugcccagacugcccgucagcaccccaagaugcaucuugcccacagcaaccucaaaccugcugcucaccucauuggagaccccagcaagcagaacucacugcucuggagagcaaacacggaccgugccuuccuccaggaugguuucuccuugagcaacaauucucuccugguccccaccaguggcaucuacuucgucuacucccagguggucuucucugggaaagccuacucucccaaggccaccuccuccccacucuaccuggcccaugagguccagcucuucuccucccaguaccccuuccaugugccucuccucagcucccagaagaugguguauccagggcugcaggaacccuggcugcacucgauguaccacggggcugcguuccagcucacccagggagaccagcuauccacccacacagauggcaucccccaccuaguccucagcccuaguacugucuucuuuggagccuucgcucuguag

SEQ ID NO: 4667 - RNA, 618 nt, Artificial Sequence
  derived and/or modified sequence opt1 from LTalpha__Homo_sapiens__BAE78638
augacgcccccggagcgccuguuccucccccgggugugcggcaccacccugcaccuccuccugcuggggcuccugcugguccuccugcccggcgcccaggggcugcccggcguggggcucaccccgagcgccgcgcagaccgcccgccagcaccccaagaugcaccuggcccacuccaaccugaagcccgccgcccaccucaucggcgaccccagcaagcagaacucccugcuguggcgggcgaacaccgaccgcgccuuccuccaggacggcuucagccuguccaacaacagccugcucgugccgacguccgggaucuacuucgucuacagccaggugguguucuccggcaaggccuacagccccaaggccaccuccagcccccuguaccuggcgcacgagguccagcuguucuccagccaguaccccuuccacgugccgcugcuguccagccagaagaugguguaccccgggcuccaggagcccuggcugcacuccauguaccacggcgccgccuuccagcugacccagggggaccagcucagcacccacacggacggcaucccccaccugguccuguccccgagcaccguguucuucggcgccuucgcccucuga

SEQ ID NO: 4668 - RNA, 618 nt, Artificial Sequence
  derived and/or modified sequence opt2 from LTalpha__Homo_sapiens__BAE78638
augaccccccccgagcgccucuuccucccccgcgucugcggcaccacccuccaccuccuccuccucggccuccuccucguccuccuccccggcgcccagggccuccccggcgucggccucacccccuccgccgcccagaccgcccgccagcaccccaagaugcaccucgcccacuccaaccucaagcccgccgcccaccucaucggcgaccccuccaagcagaacucccuccucuggcgcgccaacaccgaccgcgccuuccuccaggacggcuucucccucuccaacaacucccuccucguccccaccuccggcaucuacuucgucuacucccaggucgucuucuccggcaaggccuacucccccaaggccaccuccuccccccucuaccucgcccacgagguccagcucuucuccucccaguaccccuuccacgucccccuccucuccucccagaagauggucuaccccggccuccaggagcccuggcuccacuccauguaccacggcgccgccuuccagcucacccagggcgaccagcucuccacccacaccgacggcaucccccaccucguccucucccccuccaccgucuucuucggcgccuucgcccucuga

SEQ ID NO: 4669 - RNA, 618 nt, Artificial Sequence
  derived and/or modified sequence opt3 from LTalpha__Homo_sapiens__BAE78638
augacacccccugagagacuguuccucccaagggugugcggcaccacucuucaccuguuguuacuggggcuacuccugguccuucugccgggagcccaggguuugcccggcguugggcucacgccuagcgcugcacaaaccgcccggcagcauccaaagaugcaccuggcgcauuccaaccugaaacccgcugcccaccucaucggagacccuucuaagcagaacucauuacuguggcgcgcaaauacagaucgagccuuucuucaggacggcuucaguuugagcaauaacucccugcuagugccaacuucugguauuuacuuuguauauucgcaaguggucuucucagggaaggcuuacagccccaaagcaaccaguuccccucucuaucuggcccaugaagugcagcuguuuucuagccaguacccauuccacguuccgcuuuuguccucacagaaaaugguguaucccggacuccaagagccuuggcugcacaguauguaccauggcgcugccuuucaguuaacacagggcgaucagcugagcacccacacugacgggauaccacaucucguccuuucucccuccacaguguucuuuggagcguucgcacuguga

SEQ ID NO: 4670 - RNA, 618 nt, Artificial Sequence
  derived and/or modified sequence opt4 from LTalpha__Homo_sapiens__BAE78638
augaccccccccgagagacuguuccugcccagagugugcggcaccacccugcaccugcugcugcugggccugcugcuggugcugcugcccggcgcccagggccugcccggcgugggccugacccccagcgccgcccagaccgccagacagcaccccaagaugcaccuggcccacagcaaccugaagcccgccgcccaccugaucggcgaccccagcaagcagaacagccugcuguggagagccaacaccgacagagccuuccugcaggacggcuucagccugagcaacaacagccugcuggugcccaccagcggcaucuacuucguguacagccaggugguguucagcggcaaggccuacagccccaaggccaccagcagcccccuguaccuggcccacgaggugcagcuguucagcagccaguaccccuuccacgugccccugcugagcagccagaagaugguguaccccggccugcaggagcccuggcugcacagcauguaccacggcgccgccuuccagcugacccagggcgaccagcugagcacccacaccgacggcaucccccaccuggugcugagccccagcaccguguucuucggcgccuucgcccuguga

SEQ ID NO: 4671 - RNA, 618 nt, Artificial Sequence
  derived and/or modified sequence opt5 from LTalpha__Homo_sapiens__BAE78638
augacacccccugagagacuguuccucccgcgggugugcggcaccacgcugcaccuucugcuccuggggcuucugcucguccugcugcccggagcccagggccucccugggguuggacugacccccagcgcugcccaaacagcgcgccagcauccuaagaugcaccuugcucauuccaaccugaaacccgccgcccaccucaucggcgacccuucuaagcagaauagccugcuuuggagagcuaacaccgaucgggccuuucugcaggacggguucucccucucuaauaacagccugcuggugccgacauccggaauuuacuuuguguauucucaagucguguucagcggcaaggcuuacucccccaaagccaccagcucuccucucuaucuggcgcaugaaguucagcuguuuuccagccaguaccccuuccacgugccucuucucucuucccagaaaauggucuaucccggccugcaagagccguggcuucacagcauguaccauggggccgcuuuucagcugacacagggagaucagcucucuacccacacggacggcaucccucaucuggugcugucccccagcaccguuuucuuuggggccuucgcucucuga

SEQ ID NO: 4672 - RNA, 618 nt, Artificial Sequence
  derived and/or modified sequence opt6 from LTalpha__Homo_sapiens__BAE78638
augacaccaccagaaagacuauuccuaccaagaguaugcggaacaacauuacaccuacuacuacuaggauuacuacuaguauuauuacccggagcacaaggccuaccaggaguuggacuaacaccaucagcagcacaaacagcaagacaacacccaaaaaugcaccuagcacacucaaaucuaaaacccgcagcacaccuaaucggagaccccuccaaacaaaacucacuucuauggagagcaaauacagauagagcauuccuacaagacggcuucucauuaucaaacaacucacuacuaguaccaacaucuggaauauacuucguauauucccaaguaguauucucaggaaaagcauacucaccaaaagcaacaucauccccacuauacuuagcacacgaaguacaauuauuuucaucccaauacccauuucacgucccacuacuaucaucccaaaaaaugguauauccaggacuacaagaaccauggcuacacucaauguaccacggcgcagcauuucaauuaacacaaggcgaccaacuaucaacacacacagacggcauaccacaccuaguacuaucaccaucaacaguauucuucggcgcauucgcacuauaa

SEQ ID NO: 4673 - protein, 205 aa, Artificial Sequence; identical to SEQ ID NO: 4649
  LTalpha__Homo_sapiens__Q5STV3

SEQ ID NO: 4674 - RNA, 618 nt, Artificial Sequence; identical to SEQ ID NO: 4650
  LTalpha__Homo_sapiens__BAC54943

SEQ ID NO: 4675 - RNA, 618 nt, Artificial Sequence; identical to SEQ ID NO: 4651
  derived and/or modified sequence opt1 from LTalpha__Homo_sapiens__BAC54943

SEQ ID NO: 4676 - RNA, 618 nt, Artificial Sequence; identical to SEQ ID NO: 4652
  derived and/or modified sequence opt2 from LTalpha__Homo_sapiens__BAC54943

SEQ ID NO: 4677 - RNA, 618 nt, Artificial Sequence; identical to SEQ ID NO: 4653
  derived and/or modified sequence opt3 from LTalpha__Homo_sapiens__BAC54943

SEQ ID NO: 4678 - RNA, 618 nt, Artificial Sequence; identical to SEQ ID NO: 4654
  derived and/or modified sequence opt4 from LTalpha__Homo_sapiens__BAC54943

SEQ ID NO: 4679 - RNA, 618 nt, Artificial Sequence; identical to SEQ ID NO: 4655
  derived and/or modified sequence opt5 from LTalpha__Homo_sapiens__BAC54943

SEQ ID NO: 4680 - RNA, 618 nt, Artificial Sequence
  derived and/or modified sequence opt6 from LTalpha__Homo_sapiens__BAC54943
augacaccaccagaacgccuauuuuuaccaagaguaugcggaacaacacuacaucuacuacuacuaggacuacuacuaguauuacuaccaggagcacaaggauuaccaggaguaggacuaacaccaucagcagcacaaacagcaagacaacacccaaaaaugcaucuagcacacucuacacuaaaaccagcagcacaccucauaggagacccaucaaaacaaaacucacuauuauggagagcaaacacagacagagcauuccuacaagacggauuuucacuaucaaacaacucacuacuagucccaacaucaggaauauacuucguauacucacaaguaguauucucaggcaaagcauauucaccaaaagcaaccucaucaccacuauaccuagcacacgaaguccaacuauucucaucacaauacccauuccacguaccauuacuaucaucacaaaaaaugguauauccaggacuacaagaaccauggcuacacucaauguaccacggagccgcauuccaacuaacacaaggcgaccaacuaucaacacacacagauggaauaccacacuuaguauuaucacccucaaccgucuucuucggagcauucgcacuauaa

SEQ ID NO: 4681 - protein, 205 aa, Artificial Sequence
  LTalpha__Homo_sapiens__Q6FG55
MTPPERLFLPRVRGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 4682 - RNA, 618 nt, Artificial Sequence
  LTalpha__Homo_sapiens__CAG47049
augacaccaccugaacgucucuuccucccaagggugcguggcaccacccuacaccuccuccuucuggggcugcugcugguucugcugccuggggcccaggggcucccugguguuggccucacaccuucagcugcccagacugcccgucagcaccccaagaugcaucuugcccacagcacccucaaaccugcugcucaccucauuggagaccccagcaagcagaacucacugcucuggagagcaaacacggaccgugccuuccuccaggaugguuucuccuugagcaacaauucucuccugguccccaccaguggcaucuacuucgucuacucccagguggucuucucugggaaagccuacucucccaaggccaccuccuccccacucuaccuggcccaugagguccagcucuucuccucccaguaccccuuccaugugccucuccucagcucccagaagaugguguauccagggcugcaggaacccuggcugcacucgauguaccacggggcugcguuccagcucacccagggagaccagcuauccacccacacagauggcaucccccaccuaguccucagcccuaguacugucuucuuuggagccuucgcucuguag

SEQ ID NO: 4683 - RNA, 618 nt, Artificial Sequence
  derived and/or modified sequence opt1 from LTalpha__Homo_sapiens__CAG47049
augacgcccccggagcgccuguuccucccccgggugcgcggcaccacccugcaccuccuccugcuggggcuccugcugguccuccugcccggcgcccaggggcugcccggcguggggcucaccccgagcgccgcgcagaccgcccggcagcaccccaagaugcaccuggcccacuccacccugaagcccgccgcccaccucaucggcgaccccagcaagcagaacucccugcuguggcgcgcgaacacggaccgggccuuccuccaggacggcuucagccuguccaacaacagccugcucgugccgaccuccgggaucuacuucgucuacagccaggugguguucuccggcaaggccuacagccccaaggccaccuccagcccccuguaccuggcgcacgagguccagcuguucuccagccaguaccccuuccacgugccgcugcuguccagccagaagaugguguaccccgggcuccaggagcccuggcugcacuccauguaccacggcgccgccuuccagcugacccagggggaccagcucagcacgcacaccgacggcaucccccaccugguccuguccccgagcaccguguucuucggcgccuucgcccucuga

SEQ ID NO: 4684 - RNA, 618 nt, Artificial Sequence
  derived and/or modified sequence opt2 from LTalpha__Homo_sapiens__CAG47049
augaccccccccgagcgccucuuccucccccgcguccgcggcaccacccuccaccuccuccuccucggccuccuccucguccuccuccccggcgcccagggccuccccggcgucggccucacccccuccgccgcccagaccgcccgccagcaccccaagaugcaccucgcccacuccacccucaagcccgccgcccaccucaucggcgaccccuccaagcagaacucccuccucuggcgcgccaacaccgaccgcgccuuccuccaggacggcuucucccucuccaacaacucccuccucguccccaccuccggcaucuacuucgucuacucccaggucgucuucuccggcaaggccuacucccccaaggccaccuccuccccccucuaccucgcccacgagguccagcucuucuccucccaguaccccuuccacgucccccuccucuccucccagaagauggucuaccccggccuccaggagcccuggcuccacuccauguaccacggcgccgccuuccagcucacccagggcgaccagcucuccacccacaccgacggcaucccccaccucguccucucccccuccaccgucuucuucggcgccuucgcccucuga

SEQ ID NO: 4685 - RNA, 618 nt, Artificial Sequence
  derived and/or modified sequence opt3 from LTalpha__Homo_sapiens__CAG47049
augacacccccugagagacuguuccucccaagggugcggggcaccacucuucaccuguuguuacuggggcuacuccugguccuucugccgggagcccaggguuugcccggcguugggcucacgccuagcgcugcacaaaccgcccgccagcauccaaagaugcaccuggcgcauuccacacugaaacccgcugcccaccucaucggagacccuucuaagcagaacucauuacuguggcgagcaaauacugaucgugccuuucuucaggacggcuucaguuugagcaacaauucccugcuagugccaaccucugguauuuacuuuguauauucgcaaguggucuucucagggaaggcuuacagccccaaagcaacaaguuccccucucuaucuggcccaugaagugcagcuguuuucuagccaguacccauuccacguuccgcuuuuguccucacagaaaaugguguaucccggacuccaagagccuuggcugcacaguauguaccauggcgcugccuuucaguuaacccagggcgaucagcugagcacucacacagacgggauaccacaucucguccuuucucccuccaccguguucuuuggagcguucgcacuguga

SEQ ID NO: 4686 - RNA, 618 nt, Artificial Sequence
  derived and/or modified sequence opt4 from LTalpha__Homo_sapiens__CAG47049
augaccccccccgagagacuguuccugcccagagugagaggcaccacccugcaccugcugcugcugggccugcugcuggugcugcugcccggcgcccagggccugcccggcgugggccugacccccagcgccgcccagaccgccagacagcaccccaagaugcaccuggcccacagcacccugaagcccgccgcccaccugaucggcgaccccagcaagcagaacagccugcuguggagagccaacaccgacagagccuuccugcaggacggcuucagccugagcaacaacagccugcuggugcccaccagcggcaucuacuucguguacagccaggugguguucagcggcaaggccuacagccccaaggccaccagcagcccccuguaccuggcccacgaggugcagcuguucagcagccaguaccccuuccacgugccccugcugagcagccagaagaugguguaccccggccugcaggagcccuggcugcacagcauguaccacggcgccgccuuccagcugacccagggcgaccagcugagcacccacaccgacggcaucccccaccuggugcugagccccagcaccguguucuucggcgccuucgcccuguga

SEQ ID NO: 4687 - RNA, 618 nt, Artificial Sequence
  derived and/or modified sequence opt5 from LTalpha__Homo_sapiens__CAG47049
augacacccccugagagacuguuccucccgcgggugcgcggcaccacgcugcaccuucugcuccuggggcuucugcucguccugcugcccggagcccagggccucccugggguuggacugacccccagcgcugcccaaacagcgagacagcauccuaagaugcaccuugcucauuccacccugaaacccgccgcccaccucaucggcgacccuucuaagcagaacagccugcuuuggcgggcuaauacagaucgcgccuuucugcaggacggguucucccucucuaacaauagccugcuggugccgaccuccggaauuuacuuuguguauucucaagucguguucagcggcaaggcuuacucccccaaagccacaagcucuccucucuaucuggcgcaugaaguucagcuguuuuccagccaguaccccuuccacgugccucuucucucuucccagaaaauggucuaucccggccugcaagagccguggcuucacagcauguaccauggggccgcuuuucagcugacccagggagaucagcucucuacgcacaccgacggcaucccucaucuggugcugucccccagcacaguuuucuuuggggccuucgcucucuga

SEQ ID NO: 4688 - RNA, 618 nt, Artificial Sequence
  derived and/or modified sequence opt6 from LTalpha__Homo_sapiens__CAG47049
augaccccaccagaaagacuauuucuaccaagaguaagaggaacaacacuacaucuacuacuacuaggacuacuacuaguauuacuaccaggagcacaaggucuaccaggaguaggauuaacaccuucagcagcccaaacagcaagacaacacccaaaaaugcaccuagcacacucaacacuaaaaccagcagcacacuuaauaggagacccaucaaaacaaaacucccuccuauggagagcaaacacagacagagcauuccuacaagauggauucucacucucaaauaacucauuacuagucccaacaucaggaauauacuucguauacucacaaguaguauucucaggaaaagcauacucaccaaaagcaacaucaucaccacuauaccuagcccacgaaguacaacuauuuucaucccaauacccauuucacguaccacuacuaucaucacaaaaaaugguauacccaggacuacaagaaccauggcuacacucaauguaccacggugcagcauuccaauuaacccaaggagaccaauuaucaacacauacagacggaaucccacaccuaguccuaucaccaucaacagucuucuucggagcauucgcauuauaa

SEQ ID NO: 4689 - protein, 244 aa, Artificial Sequence
  LTbeta__Homo_sapiens__Q06643
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 4690 - RNA, 735 nt, Artificial Sequence
  LTbeta__Homo_sapiens__AAA36191
augggggcacuggggcuggagggcaggggugggaggcuccaggggagggguucccuccugcuagcuguggcaggagccacuucucuggugaccuuguugcuggcggugccuaucacuguccuggcugugcuggccuuagugccccaggaucagggaggacugguaacggagacggccgaccccggggcacaggcccagcaaggacugggguuucagaagcugccagaggaggagccagaaacagaucucagccccgggcucccagcugcccaccucauaggcgcuccgcugaaggggcaggggcuaggcugggagacgacgaaggaacaggcguuucugacgagcgggacgcaguucucggacgccgaggggcuggcgcucccgcaggacggccucuauuaccucuacugucucgucggcuaccggggccgggcgcccccuggcggcggggacccccagggccgcucggucacgcugcgcagcucucuguaccgggcggggggcgccuacgggccgggcacucccgagcugcugcucgagggcgccgagacggugacuccagugcuggacccggccaggagacaaggguacgggccucucugguacacgagcgugggguucggcggccuggugcagcuccggaggggcgagaggguguacgucaacaucagucaccccgauaugguggacuucgcgagagggaagaccuucuuuggggccgugauggugggguga

SEQ ID NO: 4691 - RNA, 735 nt, Artificial Sequence
  derived and/or modified sequence opt1 from LTbeta__Homo_sapiens__AAA36191
augggcgcccuggggcucgagggccgcgggggccggcugcaggggcgcggcagccugcuccuggccguggcgggcgccaccucccuggucacccuccugcuggccgugcccaucacggugcucgccguccuggcccuggugccgcaggaccagggcgggcucgugaccgagaccgcggaccccggggcccaggcccagcagggccugggguuccagaagcugcccgaggaggagcccgagaccgaccucagcccgggccugcccgccgcgcaccugaucggcgcgccccucaaggggcagggccuggggugggagacgaccaaggagcaggccuuccugaccuccggcacccaguucagcgacgccgagggccucgcccugccccaggacgggcuguacuaccucuacugccuggucggcuaccgggggcgcgccccgcccggcgggggcgacccccagggccgguccgugacgcugcgcagcucccucuaccgggccgggggcgccuacgggcccggcaccccggagcugcugcucgagggggccgagaccgugacccccguccuggaccccgcccgccggcagggcuacggcccccugugguacacgagcgugggguucggcgggcucgugcagcugcgccggggcgagcgcgucuacgugaacaucucccacccggacaugguggacuucgcgcgggggaagaccuucuucggcgccgucauggugggcuga

SEQ ID NO: 4692 - RNA, 735 nt, Artificial Sequence
  derived and/or modified sequence opt2 from LTbeta__Homo_sapiens__AAA36191
augggcgcccucggccucgagggccgcggcggccgccuccagggccgcggcucccuccuccucgccgucgccggcgccaccucccucgucacccuccuccucgccguccccaucaccguccucgccguccucgcccucgucccccaggaccagggcggccucgucaccgagaccgccgaccccggcgcccaggcccagcagggccucggcuuccagaagcuccccgaggaggagcccgagaccgaccucucccccggccuccccgccgcccaccucaucggcgccccccucaagggccagggccucggcugggagaccaccaaggagcaggccuuccucaccuccggcacccaguucuccgacgccgagggccucgcccucccccaggacggccucuacuaccucuacugccucgucggcuaccgcggccgcgccccccccggcggcggcgacccccagggccgcuccgucacccuccgcuccucccucuaccgcgccggcggcgccuacggccccggcacccccgagcuccuccucgagggcgccgagaccgucacccccguccucgaccccgcccgccgccagggcuacggcccccucugguacaccuccgucggcuucggcggccucguccagcuccgccgcggcgagcgcgucuacgucaacaucucccaccccgacauggucgacuucgcccgcggcaagaccuucuucggcgccgucauggucggcuga

SEQ ID NO: 4693 - RNA, 735 nt, Artificial Sequence
  derived and/or modified sequence opt3 from LTbeta__Homo_sapiens__AAA36191
augggcgcccuggggcucgagggaagagguggcaggcuucaggggcggggaagccuguuguuagcuguggcaggcgccaccucccuggucacacuacuccuggcgguucccaucacugugcuugcuguacuggccuuggugccucaagaccagggugggcucgucacggaaaccgcagauccaggagcccaggcucagcaaggccugggcuuccagaagcugccggaggaggaacccgaaacagaccucucuccuggguuaccagcagcccaccugauuggagcuccccuuaaaggucagggcuuggggugggagacuaccaaggagcaggccuuucugacaucaggaacccaauucagugaugcggaaggccuagcacucccucaggacggucuguacuaucuuuacugccuggugggguaucgcggacgagccccacccggcggcggggauccucagggacguagcguuacuuugagauccucucucuacagggcugguggcgccuaugggccaggaacaccggagcuguuacuggaaggcgcagagaccgugacgcccguccucgacccugcucggcgccaggguuacgggccacuuugguauacuucggugggcuuuggaggccugguacaauugagaaggggagagcggguuuacgugaacauaucacaucccgauauggucgacuucgcccgcgggaaaaccuuuuucggugcggugauggugggcuga

SEQ ID NO: 4694 - RNA, 735 nt, Artificial Sequence
  derived and/or modified sequence opt4 from LTbeta__Homo_sapiens__AAA36191
augggcgcccugggccuggagggcagaggcggcagacugcagggcagaggcagccugcugcuggccguggccggcgccaccagccuggugacccugcugcuggccgugcccaucaccgugcuggccgugcuggcccuggugccccaggaccagggcggccuggugaccgagaccgccgaccccggcgcccaggcccagcagggccugggcuuccagaagcugcccgaggaggagcccgagaccgaccugagccccggccugcccgccgcccaccugaucggcgccccccugaagggccagggccugggcugggagaccaccaaggagcaggccuuccugaccagcggcacccaguucagcgacgccgagggccuggcccugccccaggacggccuguacuaccuguacugccuggugggcuacagaggcagagccccccccggcggcggcgacccccagggcagaagcgugacccugagaagcagccuguacagagccggcggcgccuacggccccggcacccccgagcugcugcuggagggcgccgagaccgugacccccgugcuggaccccgccagaagacagggcuacggcccccugugguacaccagcgugggcuucggcggccuggugcagcugagaagaggcgagagaguguacgugaacaucagccaccccgacaugguggacuucgccagaggcaagaccuucuucggcgccgugauggugggcuga

SEQ ID NO: 4695 - RNA, 735 nt, Artificial Sequence
  derived and/or modified sequence opt5 from LTbeta__Homo_sapiens__AAA36191
augggcgcccuggggcucgagggaagaggcgggcggcugcagggacgcggcagccuucugcucgcuguggccggggcgaccucccuggucacacuucugcucgcuguucccaucacggugcuggccgugcuggcccucgucccucaagaccagggaggccuggugaccgaaacagcugauccgggcgcccaggcucagcaagggcuuggauuccagaagcugcccgaggaggaaccugaaaccgaccucucucccggccugccugccgcgcaccuuauuggggcgccccugaaaggacagggccucgggugggagacaaccaaggagcaggcuuuucugacaagcggaacccaauucuccgaugccgaaggccuggcucucccucaggacggccuguacuaucuuuacugccugguuggguauagaggacgggccccgcccggcgggggagauccucagggccgcucugugacgcucagaagcucccuguaccgggccgggggagccuauggccccggcaccccugagcuucugcucgaaggggcugagacagucacccccgugcuggacccggcccgcagacagggauacggcccucugugguauacaucuguuggguuuggaggccucgugcaacugcggcgcggggagagagucuacgugaacaucagccaucccgauaugguggacuucgcucggggcaaaaccuuuuucggagccgucaugguuggcuga

SEQ ID NO: 4696 - RNA, 735 nt, Artificial Sequence
  derived and/or modified sequence opt6 from LTbeta__Homo_sapiens__AAA36191
augggagcauuaggauuagaagguagaggaggaagauuacaaggaagaggaagucugcuucuagcaguugcaggagcaacaaguuuaguaacacuacuauuagcaguaccaauuacaguauuagcaguauuagcacuaguaccacaagaucaaggaggauuaguaacagaaacagcagauccaggugcacaagcacaacagggucuaggauuucaaaaauuaccagaagaagaaccagaaacagauuuaaguccgggauuaccugcagcucauuuaauaggugcaccauuaaaaggacaaggauuaggaugggaaacaacaaaagaacaagcauuuuuaacaagugguacacaauuuagugaugcagaagguuuagcauuaccucaagacggauuauauuauuuauauugcuuaguuggauauagaggaagagcaccaccagguggaggagauccacaaggaagaaguguaacauuaagaucaucauuauauagagcaggaggagcauacggaccaggaacaccagaacuacuuuuagaaggagcagaaacaguaacaccaguauuagauccagcaagaagacaaggauauggaccauuaugguauacaaguguaggauuuggaggauuaguucaauuaagaagaggagaaagaguauauguaaauauaagccauccugauaugguagauuuugcaagaggaaaaacauuuuuuggagcaguaaugguaggauaa

SEQ ID NO: 4697 - protein, 244 aa, Artificial Sequence; identical to SEQ ID NO: 4689
  LTbeta__Homo_sapiens__Q5STB2

SEQ ID NO: 4698 - RNA, 735 nt, Artificial Sequence; identical to SEQ ID NO: 4690
  LTbeta__Homo_sapiens__BAC54938

SEQ ID NO: 4699 - RNA, 735 nt, Artificial Sequence; identical to SEQ ID NO: 4691
  derived and/or modified sequence opt1 from LTbeta__Homo_sapiens__BAC54938

SEQ ID NO: 4700 - RNA, 735 nt, Artificial Sequence; identical to SEQ ID NO: 4692
  derived and/or modified sequence opt2 from LTbeta__Homo_sapiens__BAC54938

SEQ ID NO: 4701 - RNA, 735 nt, Artificial Sequence; identical to SEQ ID NO: 4693
  derived and/or modified sequence opt3 from LTbeta__Homo_sapiens__BAC54938

SEQ ID NO: 4702 - RNA, 735 nt, Artificial Sequence; identical to SEQ ID NO: 4694
  derived and/or modified sequence opt4 from LTbeta__Homo_sapiens__BAC54938

SEQ ID NO: 4703 - RNA, 735 nt, Artificial Sequence; identical to SEQ ID NO: 4695
  derived and/or modified sequence opt5 from LTbeta__Homo_sapiens__BAC54938

SEQ ID NO: 4704 - RNA, 735 nt, Artificial Sequence
  derived and/or modified sequence opt6 from LTbeta__Homo_sapiens__BAC54938
augggugcacuaggauuagaaggaagaggagguagauuacaaggaagaggaaguuuacuauuagcaguagcaggggcaacaagucuaguaacuuuauuacuagcaguaccaauaacaguauuagcaguauuagcauugguaccacaagaucaagguggauuaguaacagaaacugcagauccaggagcacaagcacaacaaggauuaggauuucaaaaauuaccagaagaagaaccugaaacugauuuaaguccaggauuaccagcagcacauuuaauaggagcaccacuaaaaggacaaggauuaggaugggaaacaacaaaagaacaagcauuucuaacaaguggaacacaauucucagaugcagaaggauuagcauuaccacaagauggauuauacuauuuauacuguuuaguaggauauagaggaagagcaccgccuggaggaggagauccacaaggaagaucaguaacacuacgcaguagcuuauauagagcaggaggagcauacgguccaggaacaccagaauuauuguuagaaggagccgaaacaguaacaccaguuuuagauccagcaagaagacaaggauaugguccauuaugguauacaaguguagguuuugguggauuaguacaacuaagaagaggagaaagaguauauguaaauauaucacauccagauauggucgauuuugcaagaggaaaaacauuuuuuggagcaguaaugguaggauaa

SEQ ID NO: 4705 - protein, 554 aa, Artificial Sequence
  M-CSF__Homo_sapiens__P09603
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQESVFHLLVPSVILVLLAVGGLLFYRWRRRSHQEPQRADSPLEQPEGSPLTQDDRQVELPV

SEQ ID NO: 4706 - RNA, 1665 nt, Artificial Sequence
  M-CSF__Homo_sapiens__CCDS816.1
augaccgcgccgggcgccgccgggcgcugcccucccacgacauggcugggcucccugcuguuguuggucugucuccuggcgagcaggaguaucaccgaggaggugucggaguacuguagccacaugauugggaguggacaccugcagucucugcagcggcugauugacagucagauggagaccucgugccaaauuacauuugaguuuguagaccaggaacaguugaaagauccagugugcuaccuuaagaaggcauuucuccugguacaagacauaauggaggacaccaugcgcuucagagauaacacccccaaugccaucgccauugugcagcugcaggaacucucuuugaggcugaagagcugcuucaccaaggauuaugaagagcaugacaaggccugcguccgaacuuucuaugagacaccucuccaguugcuggagaaggucaagaaugucuuuaaugaaacaaagaaucuccuugacaaggacuggaauauuuucagcaagaacugcaacaacagcuuugcugaaugcuccagccaagauguggugaccaagccugauugcaacugccuguaccccaaagccaucccuagcagugacccggccucugucuccccucaucagccccucgcccccuccauggccccuguggcuggcuugaccugggaggacucugagggaacugagggcagcucccucuugccuggugagcagccccugcacacaguggauccaggcagugccaagcagcggccacccaggagcaccugccagagcuuugagccgccagagaccccaguugucaaggacagcaccaucgguggcucaccacagccucgccccucugucggggccuucaaccccgggauggaggauauucuugacucugcaaugggcacuaauugggucccagaagaagccucuggagaggccagugagauucccguaccccaagggacagagcuuucccccuccaggccaggagggggcagcaugcagacagagcccgccagacccagcaacuuccucucagcaucuucuccacucccugcaucagcaaagggccaacagccggcagauguaacugguaccgccuugcccagggugggccccgugaggcccacuggccaggacuggaaucacaccccccagaagacagaccauccaucugcccugcucagagaccccccggagccaggcucucccaggaucucaucacugcgcccccagggccucagcaaccccuccacccucucugcucagccacagcuuuccagaagccacuccucgggcagcgugcugccccuuggggagcuggagggcaggaggagcaccagggaucggaggagccccgcagagccagaaggaggaccagcaagugaaggggcagccaggccccugccccguuuuaacuccguuccuuugacugacacaggccaugagaggcaguccgagggauccuucagcccgcagcuccaggagucugucuuccaccugcuggugcccagugucauccuggucuugcuggccgucggaggccucuuguucuacagguggaggcggcggagccaucaagagccucagagagcggauucucccuuggagcaaccagagggcagcccccugacucaggaugacagacagguggaacugccaguguag

SEQ ID NO: 4707 - RNA, 1665 nt, Artificial Sequence
  derived and/or modified sequence opt1 from M-CSF__Homo_sapiens__CCDS816.1
augaccgcccccggcgccgcggggcgcugcccgcccaccacguggcugggcagccuccugcugcucgugugccugcuggccucccggagcaucaccgaggaggucuccgaguacugcagccacaugaucggguccggccaccuccagagccugcagcgccugaucgacucccagauggagaccagcugccagaucaccuucgaguucguggaccaggagcagcucaaggaccccgugugcuaccugaagaaggccuuccugcucguccaggacaucauggaggacacgaugcgguuccgcgacaacacccccaacgccaucgccaucgugcagcugcaggagcugucccuccggcugaaguccugcuucaccaaggacuacgaggagcacgacaaggcgugcgugcgcaccuucuacgagacgccgcugcagcuccuggagaaggucaagaacguguucaacgagaccaagaaccugcucgacaaggacuggaacaucuucuccaagaacugcaacaacagcuucgccgagugcuccagccaggacguggucaccaagcccgacugcaacugccuguaccccaaggccauccccuccagcgacccggccuccgugagcccccaccagccccuggcgcccuccauggccccgguggccgggcucaccugggaggacagcgagggcacggagggcagcucccugcugcccggggagcagccccuccacaccgucgaccccggcagcgccaagcagcggccgccccgcuccacgugccagagcuucgagccgcccgagacccccguggugaaggacuccaccaucgggggcagcccccagccccggcccuccgucggggccuucaacccgggcauggaggacauccuggacagcgcgaugggcaccaacugggugcccgaggaggccuccggggaggccagcgagauccccgugccccagggcaccgagcuguccccgagccgccccgggggcggcuccaugcagaccgagcccgcccggccgagcaacuuccucuccgccagcuccccgcugcccgcgagcgccaaggggcagcagcccgccgacgucacgggcaccgcccugccccgcguggggcccgugcggcccaccggccaggacuggaaccacacgccccagaagaccgaccacccguccgcccuccugcgcgacccgcccgagcccgggagcccccggaucagcucccugcgcccccagggccucagcaaccccuccacccugagcgcgcagccccagcugucccggagccacuccagcggcuccguccucccgcugggggagcuggagggccgccggagcacccgcgaccggcgcucccccgccgagcccgagggcgggcccgccagcgagggggccgcccgcccgcucccccgguucaacuccgugccccugaccgacacgggccacgagcgccagagcgagggcuccuucagcccccagcugcaggaguccguguuccaccuccuggucccgagcgugauccugguccuccuggcggucgggggccugcuguucuaccgguggcgccggcgcagccaccaggagccccagcgggccgacagcccccucgagcagccggaggggagcccccugacccaggacgaccgccagguggagcugcccguguga

SEQ ID NO: 4708 - RNA, 1665 nt, Artificial Sequence
  derived and/or modified sequence opt2 from M-CSF__Homo_sapiens__CCDS816.1
augaccgcccccggcgccgccggccgcugcccccccaccaccuggcucggcucccuccuccuccucgucugccuccucgccucccgcuccaucaccgaggaggucuccgaguacugcucccacaugaucggcuccggccaccuccagucccuccagcgccucaucgacucccagauggagaccuccugccagaucaccuucgaguucgucgaccaggagcagcucaaggaccccgucugcuaccucaagaaggccuuccuccucguccaggacaucauggaggacaccaugcgcuuccgcgacaacacccccaacgccaucgccaucguccagcuccaggagcucucccuccgccucaaguccugcuucaccaaggacuacgaggagcacgacaaggccugcguccgcaccuucuacgagaccccccuccagcuccucgagaaggucaagaacgucuucaacgagaccaagaaccuccucgacaaggacuggaacaucuucuccaagaacugcaacaacuccuucgccgagugcuccucccaggacgucgucaccaagcccgacugcaacugccucuaccccaaggccauccccuccuccgaccccgccuccgucuccccccaccagccccucgcccccuccauggcccccgucgccggccucaccugggaggacuccgagggcaccgagggcuccucccuccuccccggcgagcagccccuccacaccgucgaccccggcuccgccaagcagcgccccccccgcuccaccugccaguccuucgagccccccgagacccccgucgucaaggacuccaccaucggcggcuccccccagccccgccccuccgucggcgccuucaaccccggcauggaggacauccucgacuccgccaugggcaccaacuggguccccgaggaggccuccggcgaggccuccgagauccccgucccccagggcaccgagcucucccccucccgccccggcggcggcuccaugcagaccgagcccgcccgccccuccaacuuccucuccgccuccuccccccuccccgccuccgccaagggccagcagcccgccgacgucaccggcaccgcccucccccgcgucggccccguccgccccaccggccaggacuggaaccacaccccccagaagaccgaccaccccuccgcccuccuccgcgacccccccgagcccggcuccccccgcaucuccucccuccgcccccagggccucuccaaccccuccacccucuccgcccagccccagcucucccgcucccacuccuccggcuccguccucccccucggcgagcucgagggccgccgcuccacccgcgaccgccgcucccccgccgagcccgagggcggccccgccuccgagggcgccgcccgcccccucccccgcuucaacuccgucccccucaccgacaccggccacgagcgccaguccgagggcuccuucuccccccagcuccaggaguccgucuuccaccuccucguccccuccgucauccucguccuccucgccgucggcggccuccucuucuaccgcuggcgccgccgcucccaccaggagccccagcgcgccgacuccccccucgagcagcccgagggcuccccccucacccaggacgaccgccaggucgagcuccccgucuga

SEQ ID NO: 4709 - RNA, 1665 nt, Artificial Sequence
  derived and/or modified sequence opt3 from M-CSF__Homo_sapiens__CCDS816.1
augaccgcccccggcgcugcagggagaugcccuccaacaacuuggcugggaagccuccuucuguugguguguuuacuggccuccaggucuaucacggaggaagucucagaguacugcagucacaugauugguagcggccaucuacagucccuccaacggcugauagacucucagauggaaaccucgugucagaucacauucgaguuuguugaucaggaacaacuuaaggacccggugugcuaucugaaaaaggcguucuugcucguacaggauauuauggaggacacuaugcgcuuucgagauaacacccccaaugcuaucgccauugugcagcugcaggagcugucacuccguuuaaaaagcuguuucacaaaggacuacgaagaacacgauaaagcaugcgucagaaccuuuuaugaaacuccucugcaacuuuuggagaaggugaagaacguuuucaaugagaccaaaaaccugcuagacaaggauuggaauaucuuuaguaaaaacuguaauaacuccuucgccgaaugcucuagccaggacguggucacaaagccagauuguaauugccucuaccccaaagcuauaccuuccucagacccagcaagugugagcccccaucagccucuggccccaucuauggcuccgguagccgggcuuacgugggaggauuccgaaggaacugagggcucaagccuguugcccggugaacagccucuccacaccguugacccagggagugcgaagcaaaggcccccucggucuacaugucaguccuuugagccacccgagacuccgguggucaaggacagcaccaucggaggcucgccucagccccgcccaucugugggcgcauucaacccugggauggaagauauucuggacuccgccaugggaacaaauugggugcccgaggaggcuucaggugaggccagugaaaucccagucccccaaggcaccgaguuaagcccuuccagaccagggggaggcucuaugcagacggagccggcaaggcccagcaacuuucugucagcuaguuccccucucccagccagcgcgaaaggucagcagcccgccgauguuacugggacagcacuuccucgggugggaccaguacgccccaccggccaagacuggaaucauacuccgcagaagacagaucacccuucugcucuguugcgagacccacccgaaccuggcucacccagaauuaguagccuaaggccacaggggcuguccaacccuucuacccucucggcccagccccaacugagccggucccacucaaguggaucugugcuuccacugggugaguuggaaggccgucgcagcacgagagauaggcgguccccggcugagccugaagggggacccgccucagagggcgcagcccgaccacucccccgcuucaauagcgucccucugaccgacacaggucaugagagacagucugaaggguccuuuaguccacaguuacaggagagcguguuccaucugcuaguucccucugugauccucguccugcuugcugugggcggauugcuguucuauagguggcggcgcagaucccaccaagaaccucagagggcggauucaccgcucgagcagccagagggcaguccccugacucaggacgaucgucaaguagaacuuccuguuuga

SEQ ID NO: 4710 - RNA, 1665 nt, Artificial Sequence
  derived and/or modified sequence opt4 from M-CSF__Homo_sapiens__CCDS816.1
augaccgcccccggcgccgccggcagaugcccccccaccaccuggcugggcagccugcugcugcuggugugccugcuggccagcagaagcaucaccgaggaggugagcgaguacugcagccacaugaucggcagcggccaccugcagagccugcagagacugaucgacagccagauggagaccagcugccagaucaccuucgaguucguggaccaggagcagcugaaggaccccgugugcuaccugaagaaggccuuccugcuggugcaggacaucauggaggacaccaugagauucagagacaacacccccaacgccaucgccaucgugcagcugcaggagcugagccugagacugaagagcugcuucaccaaggacuacgaggagcacgacaaggccugcgugagaaccuucuacgagaccccccugcagcugcuggagaaggugaagaacguguucaacgagaccaagaaccugcuggacaaggacuggaacaucuucagcaagaacugcaacaacagcuucgccgagugcagcagccaggacguggugaccaagcccgacugcaacugccuguaccccaaggccauccccagcagcgaccccgccagcgugagcccccaccagccccuggcccccagcauggcccccguggccggccugaccugggaggacagcgagggcaccgagggcagcagccugcugcccggcgagcagccccugcacaccguggaccccggcagcgccaagcagagaccccccagaagcaccugccagagcuucgagccccccgagacccccguggugaaggacagcaccaucggcggcagcccccagcccagacccagcgugggcgccuucaaccccggcauggaggacauccuggacagcgccaugggcaccaacugggugcccgaggaggccagcggcgaggccagcgagauccccgugccccagggcaccgagcugagccccagcagacccggcggcggcagcaugcagaccgagcccgccagacccagcaacuuccugagcgccagcagcccccugcccgccagcgccaagggccagcagcccgccgacgugaccggcaccgcccugcccagagugggccccgugagacccaccggccaggacuggaaccacaccccccagaagaccgaccaccccagcgcccugcugagagacccccccgagcccggcagccccagaaucagcagccugagaccccagggccugagcaaccccagcacccugagcgcccagccccagcugagcagaagccacagcagcggcagcgugcugccccugggcgagcuggagggcagaagaagcaccagagacagaagaagccccgccgagcccgagggcggccccgccagcgagggcgccgccagaccccugcccagauucaacagcgugccccugaccgacaccggccacgagagacagagcgagggcagcuucagcccccagcugcaggagagcguguuccaccugcuggugcccagcgugauccuggugcugcuggccgugggcggccugcuguucuacagauggagaagaagaagccaccaggagccccagagagccgacagcccccuggagcagcccgagggcagcccccugacccaggacgacagacagguggagcugcccguguga

SEQ ID NO: 4711 - RNA, 1665 nt, Artificial Sequence
  derived and/or modified sequence opt5 from M-CSF__Homo_sapiens__CCDS816.1
augaccgcccccggcgcugccgggagaugcccuccgacaacguggcugggaagccuccugcuucuggugugucuccuggcgucccggucuaucaccgaggaagucagcgaguacugcucccacaugauuggcucugggcaucuucagagccugcaacgccucaucgacucccagauggaaacaucuugucagauuaccuucgaguuuguugaucaggaacaacugaaggaccccgugugcuaucugaaaaaggcuuuccuccuggugcaggauaucauggaggacacaaugagauuucgggauaacaccccuaaugccauugccaucguccagcuucaggagcugagccuccgccugaaauccuguuucacaaaggacuacgaggaacacgauaaggcuugcgugagaaccuuuuaugaaacgccccuucaacugcucgagaaaguuaagaacguguucaaugagaccaaaaaccugcuggacaaggauuggaauaucuuuagcaaaaacuguaauaacucuuucgccgaaugcuccagccaggacgucgugacaaagccugauuguaauugccucuaccccaaagcuauuccuucuuccgacccggccagcguuucuccccaucagccucuggcgcccuccauggccccuguggcuggacuuaccugggaggauagcgaaggcacagagggguccucucugcuccccggagaacagccgcugcacaccgucgacccuggcagcgccaagcaacggcccccucgcuccacgugucagagcuuugagccucccgagacacccguggugaaggacucuaccaucggcggguccccgcagcccagaccuagcgucggagcuuucaaccccggcauggaagauauucuugacucugccauggggacaaauuggguuccugaggaagcgagcggagaggccuccgaaauccccgugccgcaaggcaccgagcugucuccuagccggcccgggggaggcuccaugcagaccgagccugcucgccccagcaacuuucucucugccuccagcccucugcccgcuucugccaaaggccagcagccggccgaugugacagggacggcucugccuagagucggacccgugcggcccaccggccaagacuggaaucauacaccucagaagaccgaucacccguccgcgcuccugcgcgaucccccugaacccgggagcccuagaauuuccucucuucggccccagggacugagcaacccuuccacacucucugcccagccccaacugagccgcucccacagcucuggcuccguucuuccgcugggggagcucgaaggaagacggagcaccagagaccgccggucuccugcugagcccgaaggcggcccugccuccgagggggccgcuagaccccugccgcgcuucaauagcgugccucugacggacacaggacaugagcggcagucugaaggcagcuuuagcccccagcuccaggaguccgucuuccaucugcuugugccuucuguuauccuggugcuccuggccgucgggggacugcuuuucuauagauggcgccggagaucccaccaagaaccccagcgcgcggauagcccccucgagcagccugagggcuccccgcugacccaggacgaucggcaaguggaacugcccgucuga

SEQ ID NO: 4712 - RNA, 1665 nt, Artificial Sequence
  derived and/or modified sequence opt6 from M-CSF__Homo_sapiens__CCDS816.1
augacggcaccaggagcagccggcagaugcccuccaacuacauggcuaggaucauuauuauuacucguaugcuugcuagcuucaagaucaaucacugaagaaguauccgaauauuguucacauaugauuggauccggccaucuacaaagcuuacaaagacuuauagauucacaaauggaaacaaguugccaaauaacauuugaauuuguagaccaagaacaauuaaaagauccaguuuguuaucucaaaaaggcauuuuuauuaguacaagacauaauggaagacacaaugagauucagagauaacacaccaaacgcuauagcuauaguacaacuacaagaacuaucucuucgccuuaaaucauguuuuacaaaagauuacgaagaacaugauaaagcauguguaagaaccuuuuacgaaacaccacuacaacuauuagaaaaaguuaaaaacguauucaacgaaacaaaaaaucuuuuagauaaagacuggaacauuuuuucaaaaaacugcaauaauucauucgcagaauguucaucacaagacguaguaaccaaaccagacuguaacugccuauaccccaaagcuauaccaaguucugauccagccagcguuucaccucaccaaccacuagcaccuucaauggcaccugucgcaggccuaacaugggaagacucagagggaaccgaaggaaguucucuacuaccaggagaacaaccuuuacauaccguagacccuggcucagcaaaacaaagaccuccacgaucuacaugccaaucauuugagccaccagaaacaccuguaguaaaagauucuacaauaggcggaagcccacaaccacguccaucugucggugccuucaaucccggaauggaagacauuuuagauucagcaauggguacaaauuggguaccagaagaagcauccggagaagcauccgaaauaccaguuccacaaggaacagaacuuaguccaucuagaccaggaggaggauccaugcaaacugaacccgcaagaccaucaaacuuuuuaucagcaucauccccauuaccagcauccgcaaaaggccaacaaccagcagacgucacaggaacugcuuuaccacgaguaggaccaguaagaccuacaggucaagauuggaaucauaccccacaaaaaacagaucaucccucagcccuacuaagagacccaccagaaccagguucaccaagaauuucuagucuaagaccacaaggauuaucaaauccuucaacauuauccgcucaaccucaauuaucuagaucucauagcucaggaagcguucucccccuuggagaacucgaaggaagaagaucuacacgagaucgaagaucaccagcagaaccugaaggcggcccagcaucagaaggugcagcacguccacuaccaagauuuaacucuguaccacuaacugauacaggacaugaaagacaaucagaaggaaguuucucaccccaacuacaagaaucaguauuccauuuacuuguaccaaguguaauucuaguccuucuagcaguuggaggcuuacucuucuacagauggagacgacguucccaucaagaaccacaacgagcagauucaccacuagaacaaccugaaggaucaccacuaacccaagacgacagacaaguagaacugccaguauaa

SEQ ID NO: 4713 - protein, 113 aa, Artificial Sequence [sequence omitted]

SEQ ID NO: 4714 - RNA, 342 nt, Artificial Sequence
  MIF__Homo_sapiens__ABR12395
auguucaucguaaacaccaacgugccccgcgccuccgugccggacggguuccucuccgagcucacccagcagcuggcgcaggccaccggcaagcccccccaguacauugcggugcaaguggucccggaccagcucauggccuuugggggguccagcgaaccgugggcguuuugcagccugcacagcauuggcaaaaucggcggcgcgcagaaccgcuccuacagcaagcugcuguucggccugcuggccgagcgccugcgcaucagcccggacaggguuuacaucaacuauuacgacaugaacgcggccaaugugggguggaacaacucccccuuugccuaa

SEQ ID NO: 4715 - RNA, 342 nt, Artificial Sequence
  derived and/or modified sequence opt1 from MIF__Homo_sapiens__ABR12395
auguucaucgugaacaccaacgucccccgcgccagcgugccggacggcuuccuguccgagcucacccagcagcuggcccaggcgacggggaagccgccccaguacaucgccgugcaggucgugcccgaccagcugauggccuucggcgggagcuccgagcccugggccuucugcagccuccacuccaucggcaagaucgggggcgcccagaaccggagcuacuccaagcugcuguucggccuccuggcggagcgccugcggaucagccccgaccgcguguacaucaacuacuacgacaugaacgccgccaacgucggguggaacaacucccccuucgccuga

SEQ ID NO: 4716 - RNA, 342 nt, Artificial Sequence
  derived and/or modified sequence opt2 from MIF__Homo_sapiens__ABR12395
auguucaucgucaacaccaacgucccccgcgccuccguccccgacggcuuccucuccgagcucacccagcagcucgcccaggccaccggcaagcccccccaguacaucgccguccaggucguccccgaccagcucauggccuucggcggcuccuccgagcccugggccuucugcucccuccacuccaucggcaagaucggcggcgcccagaaccgcuccuacuccaagcuccucuucggccuccucgccgagcgccuccgcaucucccccgaccgcgucuacaucaacuacuacgacaugaacgccgccaacgucggcuggaacaacucccccuucgccuga

SEQ ID NO: 4717 - RNA, 342 nt, Artificial Sequence
  derived and/or modified sequence opt3 from MIF__Homo_sapiens__ABR12395
auguucaucgugaacaccaauguccccagagccagcguuccugacggcuuucuguccgagcucacacagcaacuugcucaggcaacugggaagccaccgcaguacauugccgugcagguagugcccgaucaacugauggcguucggagguucuucagaaccuugggcuuuuugcaguuugcacagcauaggcaaaaucgggggagcccagaacagguccuauucuaaguuacuguucggccuacucgcagagcggcugcgcauuucgccagaccgagucuacaucaauuauuacgauaugaacgccgcuaauguggguuggaacaauucacccuuugcauga

SEQ ID NO: 4718 - RNA, 342 nt, Artificial Sequence
  derived and/or modified sequence opt4 from MIF__Homo_sapiens__ABR12395
auguucaucgugaacaccaacgugcccagagccagcgugcccgacggcuuccugagcgagcugacccagcagcuggcccaggccaccggcaagcccccccaguacaucgccgugcagguggugcccgaccagcugauggccuucggcggcagcagcgagcccugggccuucugcagccugcacagcaucggcaagaucggcggcgcccagaacagaagcuacagcaagcugcuguucggccugcuggccgagagacugagaaucagccccgacagaguguacaucaacuacuacgacaugaacgccgccaacgugggcuggaacaacagccccuucgccuga

SEQ ID NO: 4719 - RNA, 342 nt, Artificial Sequence
  derived and/or modified sequence opt5 from MIF__Homo_sapiens__ABR12395
auguucaucgugaacaccaauguccccagagccagcguuccugacggcuuucuguccgagcucacacagcaacuggcucaggccacggggaagccgccccaguacauugcgguccagguggugccugaucaacuuauggcuuucggaggcucuagcgaacccugggccuuuugcucccugcacucuaucgggaaaauuggaggcgcccagaaccggagcuauuccaagcuccuguucgggcuucuggcugagcgccucagaaucucuccugaccggguguacauuaauuauuacgauaugaacgccgcuaauguuggauggaacaauagccccuuugccuga

SEQ ID NO: 4720 - RNA, 342 nt, Artificial Sequence
  derived and/or modified sequence opt6 from MIF__Homo_sapiens__ABR12395
auguucauaguaaauacaaauguaccaagagcaagcguaccagauggauuucuaucagaauuaacacaacaauuagcacaagcaacaggaaaaccaccacaauauauagcaguacaaguaguaccagaucaauuaauggcauucggaggaucaagcgaaccaugggcauuuugcucacuacauagcauaggaaaaauaggaggagcacaaaauagaucauacucaaaauuacuauuuggauuacuagcagaaagacuaagaauaucaccagauagaguuuacauaaacuauuacgauaugaaugcagcaaacguaggauggaacaauagcccauucgcauaa

SEQ ID NO: 4721 - protein, 115 aa, Artificial Sequence
  MIF__Homo_sapiens__P14174
MPMFIVNTNVPRASVPDGFLSELTQQLAQATGKPPQYIAVHVVPDQLMAFGGSSEPCALCSLHSIGKIGGAQNRSYSKLLCGLLAERLRISPDRVYINYYDMNAANVGWNNSTFA

SEQ ID NO: 4722 - RNA, 348 nt, Artificial Sequence
  MIF__Homo_sapiens__AAA21814
augccgauguucaucguaaacaccaacgugccccgcgccuccgugccggacggguuccucuccgagcucacccagcagcuggcgcaggccaccggcaagcccccccaguacaucgcggugcacguggucccggaccagcucauggccuucggcggcuccagcgagccgugcgcgcucugcagccugcacagcaucggcaagaucggcggcgcgcagaaccgcuccuacagcaagcugcugugcggccugcuggccgagcgccugcgcaucagcccggacagggucuacaucaacuauuacgacaugaacgcggccaaugugggcuggaacaacuccaccuucgccuaa

SEQ ID NO: 4723 - RNA, 348 nt, Artificial Sequence
  derived and/or modified sequence opt1 from MIF__Homo_sapiens__AAA21814
augcccauguucaucgugaacaccaacgucccgcgcgccagcgugcccgacggcuuccuguccgagcucacccagcagcuggcccaggcgacggggaagccgccccaguacaucgccgugcacgucgugcccgaccagcugauggccuucggcgggagcuccgagcccugcgcccucugcagccugcacuccaucggcaagaucgggggcgcccagaaccggagcuacuccaagcugcucugcggccugcuggcggagcgccuccggaucagccccgaccgcguguacaucaacuacuacgacaugaacgccgccaacgucggguggaacaacuccaccuucgccuga

SEQ ID NO: 4724 - RNA, 348 nt, Artificial Sequence
  derived and/or modified sequence opt2 from MIF__Homo_sapiens__AAA21814
augcccauguucaucgucaacaccaacgucccccgcgccuccguccccgacggcuuccucuccgagcucacccagcagcucgcccaggccaccggcaagcccccccaguacaucgccguccacgucguccccgaccagcucauggccuucggcggcuccuccgagcccugcgcccucugcucccuccacuccaucggcaagaucggcggcgcccagaaccgcuccuacuccaagcuccucugcggccuccucgccgagcgccuccgcaucucccccgaccgcgucuacaucaacuacuacgacaugaacgccgccaacgucggcuggaacaacuccaccuucgccuga

SEQ ID NO: 4725 - RNA, 348 nt, Artificial Sequence
  derived and/or modified sequence opt3 from MIF__Homo_sapiens__AAA21814
augcccauguucaucgugaacaccaaugucccuagagccagcguuccagacggcuuucuguccgagcucacacagcaacuugcucaggcaacugggaagccgccccaguacauugccgugcacguagugccugaucagcugauggcguucggagguucuucagaaccaugcgcuuuguguaguuuacauagcauaggcaaaaucgggggagcccaaaacagguccuauucuaagcugcuaugcggccuccuggcagagcggcuucgcauuucgcccgaccgagucuacaucaauuauuacgauaugaacgccgcuaauguggguuggaacaauucaacguuugcauga

SEQ ID NO: 4726 - RNA, 348 nt, Artificial Sequence
  derived and/or modified sequence opt4 from MIF__Homo_sapiens__AAA21814
augcccauguucaucgugaacaccaacgugcccagagccagcgugcccgacggcuuccugagcgagcugacccagcagcuggcccaggccaccggcaagcccccccaguacaucgccgugcacguggugcccgaccagcugauggccuucggcggcagcagcgagcccugcgcccugugcagccugcacagcaucggcaagaucggcggcgcccagaacagaagcuacagcaagcugcugugcggccugcuggccgagagacugagaaucagccccgacagaguguacaucaacuacuacgacaugaacgccgccaacgugggcuggaacaacagcaccuucgccuga

SEQ ID NO: 4727 - RNA, 348 nt, Artificial Sequence
  derived and/or modified sequence opt5 from MIF__Homo_sapiens__AAA21814
augcccauguucaucgugaacaccaaugucccuagagccagcguuccggacggcuuucuguccgagcucacacagcaacuggcucaggccacggggaagcccccucaguacauugcggugcacgugguccccgaucagcuuauggcuuucggaggcucuagcgaaccuugcgcccuguguucccuccauucuaucgggaaaauuggaggcgcccaaaaccggagcuauuccaagcugcuuugcgggcugcucgcugagcgccugagaaucucucccgaccggguguacauuaauuauuacgauaugaacgccgcuaauguuggauggaacaauagcaccuuugccuga

SEQ ID NO: 4728 - RNA, 348 nt, Artificial Sequence
  derived and/or modified sequence opt6 from MIF__Homo_sapiens__AAA21814
augccaauguucauaguaaacacaaauguaccaagagcaucaguaccagacggauuccuaucagaauuaacacaacaacuagcacaagcaacaggaaaaccaccacaauacauagcaguacacguaguaccagaccaacuaauggcauucggaggaucaucagaaccaugcgcacuaugcucacuacacucaauaggaaaaauaggaggagcacaaaacagaucauacucaaaauuacuaugcggacuacuagcagaaagacuaagaauaucaccagacagaguauacauaaacuauuacgacaugaacgcagcaaacguaggauggaacaauucaacauucgcauaa

SEQ ID NO: 4729 - protein, 252 aa, Artificial Sequence
  OSM__Homo_sapiens__P13725
MGVLLTQRTLLSLVLALLFPSMASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 4730 - RNA, 759 nt, Artificial Sequence
  OSM__Homo_sapiens__AAA36388
auggggguacugcucacacagaggacgcugcucagucugguccuugcacuccuguuuccaagcauggcgagcauggcggcuauaggcagcugcucgaaagaguaccgcgugcuccuuggccagcuccagaagcagacagaucucaugcaggacaccagcagacuccuggaccccuauauacguauccaaggccuggauguuccuaaacugagagagcacugcagggagcgccccggggccuuccccagugaggagacccugagggggcugggcaggcggggcuuccugcagacccucaaugccacacugggcugcguccugcacagacuggccgacuuagagcagcgccuccccaaggcccaggauuuggagaggucugggcugaacaucgaggacuuggagaagcugcagauggcgaggccgaacauccucgggcucaggaacaacaucuacugcauggcccagcugcuggacaacucagacacggcugagcccacgaaggcuggccggggggccucucagccgcccacccccaccccugccucggaugcuuuucagcgcaagcuggagggcugcagguuccugcauggcuaccaucgcuucaugcacucaguggggcgggucuucagcaaguggggggagagcccgaaccggagccggagacacagcccccaccaggcccugaggaagggggugcgcaggaccagacccuccaggaaaggcaagagacucaugaccaggggacagcugccccgguag

SEQ ID NO: 4731 - RNA, 759 nt, Artificial Sequence
  derived and/or modified sequence opt1 from OSM__Homo_sapiens__AAA36388
augggcgugcugcucacccagcgcacccugcugagccucguccuggcccuccuguuccccuccauggccagcauggcggccaucggguccugcagcaaggaguaccgggugcugcugggccagcuccagaagcagacggaccugaugcaggacaccucccgccugcucgacccguacauccggauccaggggcuggacgugcccaagcugcgcgagcacugccgggagcgccccggcgccuuccccagcgaggagacccuccgggggcugggccgccggggcuuccugcagacccucaacgccacgcuggggugcguccugcaccgccucgccgaccuggagcagcggcugccgaaggcgcaggaccucgagcgcuccggccugaacaucgaggaccuggagaagcuccagauggcccggcccaacauccuggggcugcgcaacaacaucuacugcauggcccagcuccuggacaacagcgacaccgccgagcccaccaaggcgggccgcggggccucccagcccccgacccccacgcccgccagcgacgccuuccagcggaagcuggagggcugccgguuccuccacggcuaccaccgcuucaugcacuccguggggcggguguucagcaaguggggcgagucccccaaccgcagccggcgccacuccccgcaccaggcccugcgcaaggggguccggcgcacccggcccagccgcaagggcaagcggcugaugacccgcggccagcucccccgguga

SEQ ID NO: 4732 - RNA, 759 nt, Artificial Sequence
  derived and/or modified sequence opt2 from OSM__Homo_sapiens__AAA36388
augggcguccuccucacccagcgcacccuccucucccucguccucgcccuccucuuccccuccauggccuccauggccgccaucggcuccugcuccaaggaguaccgcguccuccucggccagcuccagaagcagaccgaccucaugcaggacaccucccgccuccucgaccccuacauccgcauccagggccucgacguccccaagcuccgcgagcacugccgcgagcgccccggcgccuuccccuccgaggagacccuccgcggccucggccgccgcggcuuccuccagacccucaacgccacccucggcugcguccuccaccgccucgccgaccucgagcagcgccuccccaaggcccaggaccucgagcgcuccggccucaacaucgaggaccucgagaagcuccagauggcccgccccaacauccucggccuccgcaacaacaucuacugcauggcccagcuccucgacaacuccgacaccgccgagcccaccaaggccggccgcggcgccucccagccccccacccccacccccgccuccgacgccuuccagcgcaagcucgagggcugccgcuuccuccacggcuaccaccgcuucaugcacuccgucggccgcgucuucuccaaguggggcgagucccccaaccgcucccgccgccacuccccccaccaggcccuccgcaagggcguccgccgcacccgccccucccgcaagggcaagcgccucaugacccgcggccagcucccccgcuga

SEQ ID NO: 4733 - RNA, 759 nt, Artificial Sequence
  derived and/or modified sequence opt3 from OSM__Homo_sapiens__AAA36388
augggcgugcugcucacccagagaacacuucugagcuuggucuuagcccugcuauuccccuccauggcuucuauggcagccaucgggucaugcaguaaggaguacaggguucuccugggacaacuucagaaacagacugaccugaugcaggauacgagccgguugcucgacccuuauauucgcauacaaggucuggaugugccaaagcugcgagaacacugucgugagagaccgggcgcguuucccuccgaagagacccucaggggguuaggacggcgcggcuuccugcagacacuuaacgcuacuuuggguugcguacugcauagacuagccgaccucgaacagaggcugccuaaagcacaggaucuugagcggucugggcugaauaucgaggacuuggaaaagcuccaaauggcccgcccaaacauucugggauuacgaaauaacaucuacuguauggcucagcugcucgauaauucggacaccgcagagcccacaaaagccggcagaggcgcuucacagccuccaacccccacuccugccagcgaugcguuucagaggaaacuugaagggugccgguuccugcacggauaucaucguuuuaugcacagugugggucgcgucuucuccaaguggggcgagucuccaaacagaagcaggcggcauuccccgcaccaagcauugcgaaagggggugcgcagaacaaggcccucacggaagggaaaacgccuaaugaccagaggccagcugccuagguga

SEQ ID NO: 4734 - RNA, 759 nt, Artificial Sequence
  derived and/or modified sequence opt4 from OSM__Homo_sapiens__AAA36388
augggcgugcugcugacccagagaacccugcugagccuggugcuggcccugcuguuccccagcauggccagcauggccgccaucggcagcugcagcaaggaguacagagugcugcugggccagcugcagaagcagaccgaccugaugcaggacaccagcagacugcuggaccccuacaucagaauccagggccuggacgugcccaagcugagagagcacugcagagagagacccggcgccuuccccagcgaggagacccugagaggccugggcagaagaggcuuccugcagacccugaacgccacccugggcugcgugcugcacagacuggccgaccuggagcagagacugcccaaggcccaggaccuggagagaagcggccugaacaucgaggaccuggagaagcugcagauggccagacccaacauccugggccugagaaacaacaucuacugcauggcccagcugcuggacaacagcgacaccgccgagcccaccaaggccggcagaggcgccagccagccccccacccccacccccgccagcgacgccuuccagagaaagcuggagggcugcagauuccugcacggcuaccacagauucaugcacagcgugggcagaguguucagcaaguggggcgagagccccaacagaagcagaagacacagcccccaccaggcccugagaaagggcgugagaagaaccagacccagcagaaagggcaagagacugaugaccagaggccagcugcccagauga

SEQ ID NO: 4735 - RNA, 759 nt, Artificial Sequence
  derived and/or modified sequence opt5 from OSM__Homo_sapiens__AAA36388
augggcgugcugcucacccagagaacacugcuuagccugguccucgcccugcuuuuccccuccauggcuucuauggccgcgaucgggagcugcuccaaggaguaccggguucugcucggacaacugcagaaacagacggaccugaugcaggauaccucucgccuccuggacccuuauauuagaauccaaggccuugaugugccgaagcugcgggaacacugucgcgagagacccggggcuuuuccuagcgaagagacacuccggggacugggccgcagaggguuccuucagacccugaacgccacacucggaugcgugcugcaucggcuggccgaccucgaacagcgccugcccaaagcucaggaucuugagagauccggccugaauauugaggaccucgaaaagcugcaaauggcccggccuaacauccuuggccugcgcaauaacauuuacuguauggcucagcuccuggauaauucugacaccgccgagcccacaaaagcggggagaggagccagccagccuccgacccccacgccugcuuccgaugccuuucagcggaagcuggaaggcugccgcuuccuccacggguaucauagauuuaugcacagcgucggacggguguucucuaaguggggcgagucccccaacagaagccgccggcauucuccucaccaagcucugagaaaagggguucgccggaccagacccucccgcaagggaaaacggcuuaugacaagaggccagcugccgcgcuga

SEQ ID NO: 4736 - RNA, 759 nt, Artificial Sequence
  derived and/or modified sequence opt6 from OSM__Homo_sapiens__AAA36388
augggcguauuauuaacacaaagaacauuacuaucacuaguacuagcauuauuauuccccucaauggccucaauggcagcaauaggcucaugcucaaaagaauacagaguacuauuaggacaacuacaaaaacaaacagacuuaaugcaagacacaagcagacuucuagauccauauauaagaauacaaggauuagacgucccaaaacuaagagaacacugcagagaaagaccaggagcauucccaucagaagaaacacuaagaggauuaggacgaagaggauucuuacaaacacuaaacgcaacacuaggauguguauuacauagauuagccgaccuagaacaaagacuaccaaaagcacaagaccuagaacgaucaggacuaaacauagaagacuuagaaaaauuacaaauggcaagaccaaacauacucggauuacgaaacaauauauauugcauggcacaacuauuagacaacucagauacagcagaacccacaaaagcaggacgaggagcaucacaaccaccaacaccaacaccagcaucagacgcauuccaacgaaaacuagaaggauguagauuccuacauggauaccacagauuuaugcacucagucggaagaguauucucaaaauggggagaaaguccaaacagaucaagaagacacucaccacaccaagcacucagaaaaggaguaagaagaacaagaccaucaagaaaaggaaaacgacuaaugacaaggggccaacuaccaagauaa

SEQ ID NO: 4737 - protein, 183 aa, Artificial Sequence
  OX40L__Homo_sapiens__P23510
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 4738 - RNA, 552 nt, Artificial Sequence
  OX40L__Homo_sapiens__BAA14259
auggaaaggguccaaccccuggaagagaaugugggaaaugcagccaggccaagauucgagaggaacaagcuauugcugguggccucuguaauucagggacuggggcugcuccugugcuucaccuacaucugccugcacuucucugcucuucagguaucacaucgguauccucgaauucaaaguaucaaaguacaauuuaccgaauauaagaaggagaaagguuucauccucacuucccaaaaggaggaugaaaucaugaaggugcagaacaacucagucaucaucaacugugauggguuuuaucucaucucccugaagggcuacuucucccaggaagucaacauuagccuucauuaccagaaggaugaggagccccucuuccaacugaagaaggucaggucugucaacuccuugaugguggccucucugacuuacaaagacaaagucuacuugaaugugaccacugacaauaccucccuggaugacuuccaugugaauggcggagaacugauucuuauccaucaaaauccuggugaauucuguguccuuuga

SEQ ID NO: 4739 - RNA, 552 nt, Artificial Sequence
  derived and/or modified sequence opt1 from OX40L__Homo_sapiens__BAA14259
auggagcgcgugcagccccuggaggagaacgucggcaacgccgcccggccgcgcuucgagcggaacaagcuccugcugguggcgagcgugauccaggggcucggccugcugcucugcuucaccuacaucugccugcacuucuccgcccugcaggucagccaccgcuacccccggauccaguccaucaaggugcaguucaccgaguacaagaaggagaagggguucauccucacgagccagaaggaggacgagaucaugaaggugcagaacaacuccgucaucaucaacugcgacggcuucuaccugaucagccugaagggguacuucucccaggaggugaacaucagccuccacuaccagaaggacgaggagccccuguuccagcugaagaaggugcgcuccgucaacagccucaugguggccucccugaccuacaaggacaagguguaccugaacgucaccaccgacaacacgagccucgacgacuuccacgugaacggcggcgagcugauccugauccaccagaaccccggggaguucugcgugcucuga

SEQ ID NO: 4740 - RNA, 552 nt, Artificial Sequence
  derived and/or modified sequence opt2 from OX40L__Homo_sapiens__BAA14259
auggagcgcguccagccccucgaggagaacgucggcaacgccgcccgcccccgcuucgagcgcaacaagcuccuccucgucgccuccgucauccagggccucggccuccuccucugcuucaccuacaucugccuccacuucuccgcccuccaggucucccaccgcuacccccgcauccaguccaucaagguccaguucaccgaguacaagaaggagaagggcuucauccucaccucccagaaggaggacgagaucaugaagguccagaacaacuccgucaucaucaacugcgacggcuucuaccucaucucccucaagggcuacuucucccaggaggucaacaucucccuccacuaccagaaggacgaggagccccucuuccagcucaagaagguccgcuccgucaacucccucauggucgccucccucaccuacaaggacaaggucuaccucaacgucaccaccgacaacaccucccucgacgacuuccacgucaacggcggcgagcucauccucauccaccagaaccccggcgaguucugcguccucuga

SEQ ID NO: 4741 - RNA, 552 nt, Artificial Sequence
  derived and/or modified sequence opt3 from OX40L__Homo_sapiens__BAA14259
auggagagagugcagccccuggaagagaacgucggcaaugccgcuaggccucgguucgaacgcaacaagcuccuucugguugcaagcgugauccaaggguugggauuacugcuaugcuuuaccuacauuugucuccacuucuccgcccugcagguaucucaucgauauccacguauacagucaaucaaagugcaguuuacagaguacaagaaagaaaaggguuucauucuuacgagucaaaaagaggacgagaucaugaagguccagaauaacagcgugauuaucaauugcgauggcuuuuaucugauauccuugaagggguacuucucucaggaaguuaacaucucgcuccacuaucagaaagacgaggaaccgcuguuucaacugaagaaagugagaucagucaauagccucaugguggcgaguuuaacuuacaaggauaaaguauaucugaacguuaccacagacaauacuucccuugaugacuuccaugugaacggaggcgaguugauucugauccaccagaaucccggugaguuuuguguccuauga

SEQ ID NO: 4742 - RNA, 552 nt, Artificial Sequence
  derived and/or modified sequence opt4 from OX40L__Homo_sapiens__BAA14259
auggagagagugcagccccuggaggagaacgugggcaacgccgccagacccagauucgagagaaacaagcugcugcugguggccagcgugauccagggccugggccugcugcugugcuucaccuacaucugccugcacuucagcgcccugcaggugagccacagauaccccagaauccagagcaucaaggugcaguucaccgaguacaagaaggagaagggcuucauccugaccagccagaaggaggacgagaucaugaaggugcagaacaacagcgugaucaucaacugcgacggcuucuaccugaucagccugaagggcuacuucagccaggaggugaacaucagccugcacuaccagaaggacgaggagccccuguuccagcugaagaaggugagaagcgugaacagccugaugguggccagccugaccuacaaggacaagguguaccugaacgugaccaccgacaacaccagccuggacgacuuccacgugaacggcggcgagcugauccugauccaccagaaccccggcgaguucugcgugcuguga

SEQ ID NO: 4743 - RNA, 552 nt, Artificial Sequence
  derived and/or modified sequence opt5 from OX40L__Homo_sapiens__BAA14259
auggagagagugcagccccuggaagagaacgucggcaaugccgcucggccucgcuucgaaagaaacaagcuccugcuuguugccagcgugauccaagggcugggacuccugcuuugcuuuaccuacauuugucugcacuucuccgcgcuccaggugucucaucgguauccgcgcauccagagcauuaaaguccaguuuacagaguacaagaaagaaaagggcuucauccugacgucccaaaaagaggacgagauuaugaaggugcagaauaacucuguuaucaucaauugcgauggguuuuaucugauuagccucaagggauacuucucccaggaagugaacaucucucugcacuaucagaaagacgaggaaccccuuuuucaacugaagaaagucagaagcguuaauucccucaugguggcuagccugaccuacaaggauaaaguguaucuuaacgucacaaccgacaauacaucucuggaugacuuccaugugaacggcggggagcucauucugauccaccagaauccuggagaguuuugugugcuguga

SEQ ID NO: 4744 - RNA, 552 nt, Artificial Sequence
  derived and/or modified sequence opt6 from OX40L__Homo_sapiens__BAA14259
auggaaagaguacaaccacuagaagaaaacguaggaaacgcagcaagaccaagauucgaaagaaacaaauuacuacuaguagcaucaguaauacaaggacuaggacuacuauuaugcuucacauacauaugccuacacuucucagcacuacaaguaucccacagauacccaagaauacaaucaauaaaaguacaauucaccgaauacaaaaaagaaaaaggcuucauacuaacaucccaaaaagaagacgaaauaaugaaaguacaaaacaacucaguaauaauaaacugcgauggauucuaccuaauaucacuaaaaggauacuucucacaagaaguaaacauaucccuacacuaccaaaaagacgaagaaccacuauuccaacuaaaaaaaguaagaucaguaaacucacuaauggucgcaucacuaacauacaaagacaaaguauaucuaaacgucacaaccgacaacacaucccuagacgacuuccacguaaacggaggagaacuaauacuaauacaccaaaacccaggagaauucugcguacucuaa

SEQ ID NO: 4745 - protein, 277 aa, Artificial Sequence
  OX40L__Homo_sapiens__P43489
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 4746 - RNA, 834 nt, Artificial Sequence
  OX40L__Homo_sapiens__AAI05071
augugcgugggggcucggcggcugggccgcgggccgugugcggcucugcuccuccugggccuggggcugagcaccgugacggggcuccacugugucggggacaccuaccccagcaacgaccggugcugccacgagugcaggccaggcaacgggauggugagccgcugcagccgcucccagaacacggugugccguccgugcgggccgggcuucuacaacgacguggucagcuccaagccgugcaagcccugcacgugguguaaccucagaagugggagugagcggaagcagcugugcacggccacacaggacacagucugccgcugccgggcgggcacccagccccuggacagcuacaagccuggaguugacugugcccccugcccuccagggcacuucuccccaggcgacaaccaggccugcaagcccuggaccaacugcaccuuggcugggaagcacacccugcagccggccagcaauagcucggacgcaaucugugaggacagggaccccccagccacgcagccccaggagacccagggccccccggccaggcccaucacuguccagcccacugaagccuggcccagaaccucacagggacccuccacccggcccguggagguccccgggggccgugcgguugccgccauccugggccugggccuggugcuggggcugcugggcccccuggccauccugcuggcccuguaccugcuccggagggaccagaggcugccccccgaugcccacaagcccccugggggaggcaguuuccggacccccauccaagaggagcaggccgacgcccacuccacccuggccaagaucuga

SEQ ID NO: 4747 - RNA, 834 nt, Artificial Sequence
  derived and/or modified sequence opt1 from OX40L__Homo_sapiens__AAI05071
augugcgugggcgcccgccggcuggggcgcggccccugcgccgcgcuccugcugcucgggcugggccugagcaccgucaccgggcuccacugcgugggcgacacguaccccuccaacgaccggugcugccacgagugccgccccggcaacgggauggugagccggugcucccgcagccagaacaccgucugccggcccugcggccccggguucuacaacgacgugguguccagcaagccgugcaagcccugcaccuggugcaaccugcgcuccggcagcgagcggaagcagcugugcaccgccacgcaggacaccgucugccgcugccgggccgggacccagccccucgacuccuacaagcccggcguggacugcgccccgugcccgcccggccacuucagccccggggacaaccaggccugcaagcccuggaccaacugcacgcuggcgggcaagcacacccugcagcccgccuccaacagcuccgacgccaucugcgaggaccgcgacccgcccgccacccagccccaggagacccaggggccgcccgcgcggcccaucacggugcagcccaccgaggccuggccccgcaccagccagggccccuccacccggcccgucgaggugccgggcgggcgcgccguggccgccauccucggccuggggcugguccucggccugcuggggccccucgcgauccugcuggcccucuaccugcugcggcgcgaccagcggcucccgcccgacgcccacaagccgcccggcggcgggagcuuccgcacgcccauccaggaggagcaggccgacgcccacuccacccuggcgaagaucuga

SEQ ID NO: 4748 - RNA, 834 nt, Artificial Sequence
  derived and/or modified sequence opt2 from OX40L__Homo_sapiens__AAI05071
augugcgucggcgcccgccgccucggccgcggccccugcgccgcccuccuccuccucggccucggccucuccaccgucaccggccuccacugcgucggcgacaccuaccccuccaacgaccgcugcugccacgagugccgccccggcaacggcauggucucccgcugcucccgcucccagaacaccgucugccgccccugcggccccggcuucuacaacgacgucgucuccuccaagcccugcaagcccugcaccuggugcaaccuccgcuccggcuccgagcgcaagcagcucugcaccgccacccaggacaccgucugccgcugccgcgccggcacccagccccucgacuccuacaagcccggcgucgacugcgcccccugcccccccggccacuucucccccggcgacaaccaggccugcaagcccuggaccaacugcacccucgccggcaagcacacccuccagcccgccuccaacuccuccgacgccaucugcgaggaccgcgacccccccgccacccagccccaggagacccagggcccccccgcccgccccaucaccguccagcccaccgaggccuggccccgcaccucccagggccccuccacccgccccgucgagguccccggcggccgcgccgucgccgccauccucggccucggccucguccucggccuccucggcccccucgccauccuccucgcccucuaccuccuccgccgcgaccagcgccucccccccgacgcccacaagccccccggcggcggcuccuuccgcacccccauccaggaggagcaggccgacgcccacuccacccucgccaagaucuga

SEQ ID NO: 4749 - RNA, 834 nt, Artificial Sequence
  derived and/or modified sequence opt3 from OX40L__Homo_sapiens__AAI05071
augugcgugggcgccagaaggcuggggcggggacccugugcugcacuccuucuguuggguuuaggccugagcaccgucacagggcuacacugcguuggagacacuuacccuuccaacgaucgcuguugccaugagugucgaccaggcaaugguauggugucucguugcucaagaagucagaacacgguauguaggccgugcgggcccggauucuauaaugacguggucagcuccaagccuuguaaaccaugcaccugguguaaccuccggucuggcucggaacgcaagcaacugugcacagccacucaggauaccgugugcagauguagggcgggcacacagccccuugacucauacaaaccugggguugauugcgcuccaugucccccuggacacuuuagcccaggugacaaucaggccugcaagccguggaccaacuguacucuggcaggcaaacauacauugcaacccgccaguaauuccucugaugcuaucugcgaggaccgggauccuccagcaacccagccccaggaaacgcaggggccuccagcccgccccauuacugugcaaccgaccgaggcuuggccucgaacaagccagggacccuccacuagaccagucgaagugccuggcgguagggccguagcggcaauacucgggcugggacugguucucggcuuacugggcccccuugccaucuugcuggcucuauaucuccugcggcgugaccagcgccuuccacccgaugcccacaagccuccagggggagguucauucagaaccccgauucaggaggagcaagcagacgcucauaguacacuggccaagaucuga

SEQ ID NO: 4750 - RNA, 834 nt, Artificial Sequence
  derived and/or modified sequence opt4 from OX40L__Homo_sapiens__AAI05071
augugcgugggcgccagaagacugggcagaggccccugcgccgcccugcugcugcugggccugggccugagcaccgugaccggccugcacugcgugggcgacaccuaccccagcaacgacagaugcugccacgagugcagacccggcaacggcauggugagcagaugcagcagaagccagaacaccgugugcagacccugcggccccggcuucuacaacgacguggugagcagcaagcccugcaagcccugcaccuggugcaaccugagaagcggcagcgagagaaagcagcugugcaccgccacccaggacaccgugugcagaugcagagccggcacccagccccuggacagcuacaagcccggcguggacugcgcccccugcccccccggccacuucagccccggcgacaaccaggccugcaagcccuggaccaacugcacccuggccggcaagcacacccugcagcccgccagcaacagcagcgacgccaucugcgaggacagagacccccccgccacccagccccaggagacccagggcccccccgccagacccaucaccgugcagcccaccgaggccuggcccagaaccagccagggccccagcaccagacccguggaggugcccggcggcagagccguggccgccauccugggccugggccuggugcugggccugcugggcccccuggccauccugcuggcccuguaccugcugagaagagaccagagacugccccccgacgcccacaagccccccggcggcggcagcuucagaacccccauccaggaggagcaggccgacgcccacagcacccuggccaagaucuga

SEQ ID NO: 4751 - RNA, 834 nt, Artificial Sequence
  derived and/or modified sequence opt5 from OX40L__Homo_sapiens__AAI05071
augugcgugggcgccagacggcuggggcgcggacccugugcugcccuccugcuucugggccucgggcugagcaccgucacaggacuucacugcguuggcgacacguacccuuccaacgauagauguugccaugagugucggccggggaauggaauggugucucgcugcagcagaucccagaacaccgugugucggcccugcggcccuggcuucuauaaugacgucgugucuagcaagcccuguaaaccuugcacaugguguaaccugcgcuccgggucugaaagaaagcaacucugcaccgcgacacaggauaccguuugccggugucgcgcuggaacacagccccuggacagcuacaaaccuggcguggauugcgccccgugucccccugggcacuuuucccccggagacaaucaggccugcaagccuuggaccaacuguacgcuggcuggcaaacauacccuccaacccgccagcaauucuuccgaugcuaucugcgaggacagagauccgccugccacacagccccaggaaacccaggggccucccgcgcggcccauuacaguccaaccuaccgaggccuggccgcgcacgagccagggacccucuacaagaccuguggaaguucccggcggccgggcuguggccgcuauccuggggcuuggacugguccucggccugcuugggccucuggccauucuccuggcgcuguaucuccugcgcagagaccagcggcuucccccggaugcccacaagccucccggaggcggguccuucagaaccccuauccaggaggagcaagcugacgcccauagcacacuggcuaagauuuga

SEQ ID NO: 4752 - RNA, 834 nt, Artificial Sequence
  derived and/or modified sequence opt6 from OX40L__Homo_sapiens__AAI05071
auguguguuggagcacguagauuaggaagaggaccaugugcagcauuacuacuacuaggauuaggauuaucaacaguaacaggucuacauugcguuggagauacauacccaucaaacgacagauguugccaugaauguagaccuggaaauggaaugguauccagauguagcagaagccaaaacacaguaugcagaccaugcggcccaggauuuuauaacgauguaguauccucuaaaccauguaaacccuguacaugguguaauuuacgaucaggaagcgaaagaaaacaauuauguacagcaacacaagauacaguaugcagaugcagagcaggaacacaaccacuagauucauacaaaccagguguagauugcgcuccauguccuccaggacacuucucacccggagacaaucaagcauguaaaccauggacaaauugcacauuagcaggaaaacauacucuacaaccagcaucaaauaguucagaugcaauaugugaagauagagauccaccagcaacccaaccacaagaaacacaaggaccaccagcacgaccaauaacaguacaaccgacagaagcauggccaagaacaucacaaggaccaucaacaagaccagucgaaguaccaggaggaagagcaguagcagcaauauuaggauuaggacuaguauuaggacuacuaggcccacuagcaauauuacuagcacuauaucuauuaagaagagaccaaagauuaccaccagacgcacacaaaccaccaggcggaggcucauucaggacuccaauacaagaagaacaagcagacgcacacucaacauuggcaaaaauauaa

SEQ ID NO: 4753 - protein, 317 aa, Artificial Sequence
  RANK_ligand__Homo_sapiens__O14788
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 4754 - RNA, 954 nt, Artificial Sequence
  RANK_ligand__Homo_sapiens__CCDS9384.1
augcgccgcgccagcagagacuacaccaaguaccugcguggcucggaggagaugggcggcggccccggagccccgcacgagggcccccugcacgccccgccgccgccugcgccgcaccagcccccugccgccucccgcuccauguucguggcccuccuggggcuggggcugggccagguugucugcagcgucgcccuguucuucuauuucagagcgcagauggauccuaauagaauaucagaagauggcacucacugcauuuauagaauuuugagacuccaugaaaaugcagauuuucaagacacaacucuggagagucaagauacaaaauuaauaccugauucauguaggagaauuaaacaggccuuucaaggagcugugcaaaaggaauuacaacauaucguuggaucacagcacaucagagcagagaaagcgaugguggauggcucaugguuagaucuggccaagaggagcaagcuugaagcucagccuuuugcucaucucacuauuaaugccaccgacaucccaucugguucccauaaagugagucuguccucuugguaccaugaucgggguugggccaagaucuccaacaugacuuuuagcaauggaaaacuaauaguuaaucaggauggcuuuuauuaccuguaugccaacauuugcuuucgacaucaugaaacuucaggagaccuagcuacagaguaucuucaacuaaugguguacgucacuaaaaccagcaucaaaaucccaaguucucauacccugaugaaaggaggaagcaccaaguauuggucagggaauucugaauuccauuuuuauuccauaaacguugguggauuuuuuaaguuacggucuggagaggaaaucagcaucgaggucuccaaccccuccuuacuggauccggaucaggaugcaacauacuuuggggcuuuuaaaguucgagauauagauuga

SEQ ID NO: 4755 - RNA, 954 nt, Artificial Sequence
  derived and/or modified sequence opt1 from RANK_ligand__Homo_sapiens__CCDS9384.1
augcgccgggccagccgcgacuacaccaaguaccugcggggcuccgaggagaugggcggcgggcccggcgccccgcacgaggggccccuccacgcgcccccgccgcccgcgccccaccagcccccggccgccagccgcuccauguucguggcccugcugggccucggccuggggcaggucgugugcagcguggcccuguucuucuacuuccgggcccagauggaccccaaccgcaucuccgaggacggcacccacugcaucuaccggauccuccgccugcacgagaacgccgacuuccaggacacgacccuggagagccaggacaccaagcucauccccgacuccugccggcgcaucaagcaggccuuccagggggcgguccagaaggagcugcagcacaucguggggagccagcacauccgggccgagaaggccaugguggacggguccuggcuggaccucgccaagcgcagcaagcuggaggcccagcccuucgcgcaccugaccaucaacgccacggacauccccuccggcagccacaaggucucccucagcuccugguaccacgaccggggcugggccaagaucagcaacaugaccuucuccaacgggaagcugaucgugaaccaggacggcuucuacuaccuguacgccaacaucugcuuccgccaccacgagaccagcggggaccucgccaccgaguaccugcagcugaugguguacgucacgaagaccuccaucaagauccccagcagccacacccucaugaagggcggcuccaccaaguacuggagcgggaacuccgaguuccacuucuacagcaucaacgugggcggguucuucaagcugcgguccggcgaggagaucagcaucgagguguccaaccccagccugcucgaccccgaccaggacgcgacguacuucggggccuucaagguccgcgacaucgacuga

SEQ ID NO: 4756 - RNA, 954 nt, Artificial Sequence
  derived and/or modified sequence opt2 from RANK_ligand__Homo_sapiens__CCDS9384.1
augcgccgcgccucccgcgacuacaccaaguaccuccgcggcuccgaggagaugggcggcggccccggcgccccccacgagggcccccuccacgccccccccccccccgccccccaccagccccccgccgccucccgcuccauguucgucgcccuccucggccucggccucggccaggucgucugcuccgucgcccucuucuucuacuuccgcgcccagauggaccccaaccgcaucuccgaggacggcacccacugcaucuaccgcauccuccgccuccacgagaacgccgacuuccaggacaccacccucgagucccaggacaccaagcucauccccgacuccugccgccgcaucaagcaggccuuccagggcgccguccagaaggagcuccagcacaucgucggcucccagcacauccgcgccgagaaggccauggucgacggcuccuggcucgaccucgccaagcgcuccaagcucgaggcccagcccuucgcccaccucaccaucaacgccaccgacauccccuccggcucccacaaggucucccucuccuccugguaccacgaccgcggcugggccaagaucuccaacaugaccuucuccaacggcaagcucaucgucaaccaggacggcuucuacuaccucuacgccaacaucugcuuccgccaccacgagaccuccggcgaccucgccaccgaguaccuccagcucauggucuacgucaccaagaccuccaucaagauccccuccucccacacccucaugaagggcggcuccaccaaguacugguccggcaacuccgaguuccacuucuacuccaucaacgucggcggcuucuucaagcuccgcuccggcgaggagaucuccaucgaggucuccaaccccucccuccucgaccccgaccaggacgccaccuacuucggcgccuucaagguccgcgacaucgacuga

SEQ ID NO: 4757 - RNA, 954 nt, Artificial Sequence
  derived and/or modified sequence opt3 from RANK_ligand__Homo_sapiens__CCDS9384.1
augagaagggccagccgggacuacaccaaguaucugcgcggcuccgaggaaaugggagggggucccggcgcuccucacgaggggccacuccaugcaccgcccccuccagcgccccaccagccuccagccgcuucucgaucaauguucguggcccuucugggauugggcuuaggucaagucguuugcaguguggcacuguuuuucuacuuucgugcccagauggaucccaacagaaucagcgaagacgggacacauuguauuuauaggauacuacggcuccacgagaaugcugauuuccaggacacuacgcuggaaucccaggauaccaaacuuaucccugacucuugccgcagaauuaagcaagcauuucagggagccguacagaaagagcugcagcauaucgugggcucgcaacacauuagggcugagaaggccauggucgauggcucaugguuggaccucgcgaaacggagcaagcuggaagcacagccauucgcccaccugacaaucaacgcuacugauauaccgagugggucccauaaggugucucucagcuccugguaccacgaccgcggaugggccaaaaucucaaauaugaccuuuaguaacgguaaguuaauuguuaaucaggauggcuucuauuaccuguaugcaaacaucuguuuucgacaucacgagacaagcggggaccuugcuaccgaauacuugcagcugaugguguacgucacuaaaacaucuauuaagauccccuccucacacacccuaaugaaaggaggcagcacgaaguauuggagugguaauucugaguuccauuuuuacuccauaaacguagggggauucuuuaagcucagaagcggcgaggaaauuucgaucgaggugucuaauccuucccugcuugauccagaccaagacgccacuuauuucggcgcguucaaaguuagggauauugacuga

SEQ ID NO: 4758 - RNA, 954 nt, Artificial Sequence
  derived and/or modified sequence opt4 from RANK_ligand__Homo_sapiens__CCDS9384.1
augagaagagccagcagagacuacaccaaguaccugagaggcagcgaggagaugggcggcggccccggcgccccccacgagggcccccugcacgccccccccccccccgccccccaccagccccccgccgccagcagaagcauguucguggcccugcugggccugggccugggccagguggugugcagcguggcccuguucuucuacuucagagcccagauggaccccaacagaaucagcgaggacggcacccacugcaucuacagaauccugagacugcacgagaacgccgacuuccaggacaccacccuggagagccaggacaccaagcugauccccgacagcugcagaagaaucaagcaggccuuccagggcgccgugcagaaggagcugcagcacaucgugggcagccagcacaucagagccgagaaggccaugguggacggcagcuggcuggaccuggccaagagaagcaagcuggaggcccagcccuucgcccaccugaccaucaacgccaccgacauccccagcggcagccacaaggugagccugagcagcugguaccacgacagaggcugggccaagaucagcaacaugaccuucagcaacggcaagcugaucgugaaccaggacggcuucuacuaccuguacgccaacaucugcuucagacaccacgagaccagcggcgaccuggccaccgaguaccugcagcugaugguguacgugaccaagaccagcaucaagauccccagcagccacacccugaugaagggcggcagcaccaaguacuggagcggcaacagcgaguuccacuucuacagcaucaacgugggcggcuucuucaagcugagaagcggcgaggagaucagcaucgaggugagcaaccccagccugcuggaccccgaccaggacgccaccuacuucggcgccuucaaggugagagacaucgacuga

SEQ ID NO: 4759 - RNA, 954 nt, Artificial Sequence
  derived and/or modified sequence opt5 from RANK_ligand__Homo_sapiens__CCDS9384.1
augagacgggccagccgcgacuacaccaaguaucugagaggcuccgaggaaaugggagggggccccggggcuccucacgagggaccgcuccaugcgcccccucccccugcuccccaccagccuccggccgccucucggagcauguucguggcccugcuuggccuggggcucggacaagucguuugcuccguggcucuguuuuucuacuuucgcgcccagauggaucccaacagaaucucugaagacggcacacauuguauuuaucggauccuucgccugcacgagaaugcugauuuccaggacacgacccucgaaagccaggauacaaaacugauuccugacuccugcagacggaucaagcaagccuuucagggcgcggugcagaaagagcugcagcauauugucgggucucaacacauccgcgccgagaaggcuaugguggauggaagcuggcucgaccuggccaaaagauccaaacuugaagcucagcccuucgcccaccugaccaucaacgcgacagauauuccuagcggcucucauaagguuucccucagcucuugguaccacgaccgggggugggccaagaucuccaauaugaccuuuagcaacggaaagcugauugugaaucaggauggcuucuauuaccuuuaugcuaacaucuguuuucgccaucacgagacaucuggggaccuggccaccgaauaccuccagcugauggucuacgugacgaaaaccuccauuaagauccccagcucccacacacugaugaaaggaggcucuaccaaguauuggagcggcaauuccgaguuccauuuuuacagcauuaacguugggggauucuuuaagcucagaucuggcgaggaaaucuccaucgaggugagcaauccgucucugcuugauccugaccaagacgcuacauauuucggggccuucaaaguccgggauauugacuga

SEQ ID NO: 4760 - RNA, 954 nt, Artificial Sequence
  derived and/or modified sequence opt6 from RANK_ligand__Homo_sapiens__CCDS9384.1
augagaagagcaagcagagacuacacaaaauacuuaagaggaagcgaagaaaugggaggagguccaggagcaccacaugaaggaccauuacaugcgccuccaccaccagcaccacaccaaccaccagcagcaucaagaucaauguuuguagcacuauuaggacuaggacuuggacaaguagucuguucaguagcacuauuuuucuacuucagagcacaaauggacccaaacagaauaucagaagacggaacacacugcauauaccgaauauuaagacuacacgaaaacgcagacuuucaagauacaacauuagaaucacaagacacaaaacuaauaccugacaguugcagaagaauaaaacaagcauuccaaggagcaguacaaaaagaauuacaacauauaguaggaucacaacacauaagagcagaaaaagcaaugguagacggaucaugguuagaccuagccaaaagaucaaaacuagaagcacaaccauucgcccacuuaacaauaaacgcaacagacaucccaaguggaagucacaaaguaucacuaucaucaugguaccacgacagagguugggcaaaaauaaguaauaugacauucucaaacggaaaauuaauaguaaaccaagacggauuuuacuacuuauaugcaaacauaugcuucagacaucacgaaaccucaggcgaccuagcaacagaauaccuacaauuaaugguauacguaacaaaaacaucaauaaaaauaccaaguucacauacacuaaugaaaggcggaucaaccaaauacuggucugguaauucagaauuccacuuuuacucuaucaacguaggaggauuuuucaaacuacgaucaggggaagaaauaagcauagaaguaucaaauccuucacuauuagaccccgaccaagaugcuacauacuucggcgcauucaaaguaagagacauagacuaa

SEQ ID NO: 4761 - protein, 245 aa, Artificial Sequence
  Stem_Cell_Factor__Homo_sapiens__P21583-2
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKGKAKNPPGDSSLHWAAMALPALFSLIIGFAFGALYWKKRQPSLTRAVENIQINEEDNEISMLQEKEREFQEV

SEQ ID NO: 4762 - RNA, 738 nt, Artificial Sequence
  Stem_Cell_Factor__Homo_sapiens__CCDS31867.1
augaagaagacacaaacuuggauucucacuugcauuuaucuucagcugcuccuauuuaauccucucgucaaaacugaagggaucugcaggaaucgugugacuaauaauguaaaagacgucacuaaauugguggcaaaucuuccaaaagacuacaugauaacccucaaauauguccccgggauggauguuuugccaagucauuguuggauaagcgagaugguaguacaauugucagacagcuugacugaucuucuggacaaguuuucaaauauuucugaaggcuugaguaauuauuccaucauagacaaacuugugaauauaguggaugaccuuguggagugcgugaaagaaaacucaucuaaggaucuaaaaaaaucauucaagagcccagaacccaggcucuuuacuccugaagaauucuuuagaauuuuuaauagauccauugaugccuucaaggacuuuguaguggcaucugaaacuagugauugugugguuucuucaacauuaaguccugagaaagggaaggccaaaaaucccccuggagacuccagccuacacugggcagccauggcauugccagcauuguuuucucuuauaauuggcuuugcuuuuggagccuuauacuggaagaagagacagccaagucuuacaagggcaguugaaaauauacaaauuaaugaagaggauaaugagauaaguauguugcaagagaaagagagagaguuucaagaaguguaa

SEQ ID NO: 4763 - RNA, 738 nt, Artificial Sequence
  derived and/or modified sequence opt1 from Stem_Cell_Factor__Homo_sapiens__CCDS31867.1
augaagaagacccagaccuggauccugacgugcaucuaccuccagcugcuccucuucaacccccuggugaagaccgagggcaucugccgcaaccgggucaccaacaacgugaaggacgugaccaagcuggucgccaaccucccgaaggacuacaugaucacgcugaaguacgugcccgggauggacgugcugcccagccacugcuggaucuccgagauggucgugcagcucagcgacucccugaccgaccugcucgacaaguucagcaacaucuccgagggccugagcaacuacuccaucaucgacaagcuggugaacaucgucgacgaccucguggagugcgugaaggagaacagcuccaaggaccugaagaaguccuucaagagccccgagccgcgccuguucacccccgaggaguucuuccggaucuucaaccgcagcaucgacgccuucaaggacuucgucguggcguccgagaccagcgacugcguggucuccagcacgcucucccccgagaaggggaaggccaagaacccgcccggcgacagcucccugcacugggccgccauggcccugcccgcgcuguucagccugaucaucggguucgccuucggcgcccuguacuggaagaagcggcagcccagccucacccgcgccguggagaacauccagaucaacgaggaggacaacgagaucuccaugcugcaggagaaggagcgggaguuccaggagguguga

SEQ ID NO: 4764 - RNA, 738 nt, Artificial Sequence
  derived and/or modified sequence opt2 from Stem_Cell_Factor__Homo_sapiens__CCDS31867.1
augaagaagacccagaccuggauccucaccugcaucuaccuccagcuccuccucuucaacccccucgucaagaccgagggcaucugccgcaaccgcgucaccaacaacgucaaggacgucaccaagcucgucgccaaccuccccaaggacuacaugaucacccucaaguacguccccggcauggacguccuccccucccacugcuggaucuccgagauggucguccagcucuccgacucccucaccgaccuccucgacaaguucuccaacaucuccgagggccucuccaacuacuccaucaucgacaagcucgucaacaucgucgacgaccucgucgagugcgucaaggagaacuccuccaaggaccucaagaaguccuucaagucccccgagccccgccucuucacccccgaggaguucuuccgcaucuucaaccgcuccaucgacgccuucaaggacuucgucgucgccuccgagaccuccgacugcgucgucuccuccacccucucccccgagaagggcaaggccaagaacccccccggcgacuccucccuccacugggccgccauggcccuccccgcccucuucucccucaucaucggcuucgccuucggcgcccucuacuggaagaagcgccagcccucccucacccgcgccgucgagaacauccagaucaacgaggaggacaacgagaucuccaugcuccaggagaaggagcgcgaguuccaggaggucuga

SEQ ID NO: 4765 - RNA, 738 nt, Artificial Sequence
  derived and/or modified sequence opt3 from Stem_Cell_Factor__Homo_sapiens__CCDS31867.1
augaagaaaacccagacauggauccugacuugcauuuaccuccaacuucuguuguucaaccccuuagugaagacggagggcauauguagaaauagggucaccaacaauguuaaagacgugacaaagcugguagccaaccuaccuaaagauuauaugaucacucucaaguacgugccagggauggacguccugccgagccacugcuggauuuccgaaauggugguucagcuuucugauucacugaccgacuugcucgauaaguuuaguaauaucagcgagggacuguccaacuauucuauuaucgacaaacuggugaauauagucgaugaccucguggaauguguaaaggagaacucgucaaaagauuuaaagaaaaguuucaagagccccgaaccucggcuguuuacaccagaggaguucuuucgcaucuucaaucgauccauugacgcuuuuaaggauuucguuguggcaucugaaaccagcgacugcgucguguccucaacucuuagucccgagaaagguaaggccaaaaacccuccaggcgauagcucuuugcauugggcggcuauggcccugcccgcacuauuuucccucaucauuggguucgccuuuggagcucuguacuggaagaaacgucagccuucacuuacaagagcaguggaaaauauccagauaaacgaggaggacaaugaaauuagcaugcugcaagagaaggaaagggaguuccaggaagucuga

SEQ ID NO: 4766 - RNA, 738 nt, Artificial Sequence
  derived and/or modified sequence opt4 from Stem_Cell_Factor__Homo_sapiens__CCDS31867.1
augaagaagacccagaccuggauccugaccugcaucuaccugcagcugcugcuguucaacccccuggugaagaccgagggcaucugcagaaacagagugaccaacaacgugaaggacgugaccaagcugguggccaaccugcccaaggacuacaugaucacccugaaguacgugcccggcauggacgugcugcccagccacugcuggaucagcgagaugguggugcagcugagcgacagccugaccgaccugcuggacaaguucagcaacaucagcgagggccugagcaacuacagcaucaucgacaagcuggugaacaucguggacgaccugguggagugcgugaaggagaacagcagcaaggaccugaagaagagcuucaagagccccgagcccagacuguucacccccgaggaguucuucagaaucuucaacagaagcaucgacgccuucaaggacuucgugguggccagcgagaccagcgacugcguggugagcagcacccugagccccgagaagggcaaggccaagaacccccccggcgacagcagccugcacugggccgccauggcccugcccgcccuguucagccugaucaucggcuucgccuucggcgcccuguacuggaagaagagacagcccagccugaccagagccguggagaacauccagaucaacgaggaggacaacgagaucagcaugcugcaggagaaggagagagaguuccaggagguguga

SEQ ID NO: 4767 - RNA, 738 nt, Artificial Sequence
  derived and/or modified sequence opt5 from Stem_Cell_Factor__Homo_sapiens__CCDS31867.1
augaagaaaacccagacauggauccugacgugcauuuaccuccaacugcuucuguucaacccccucgugaagaccgagggcaucuguagaaaucgggucacaaacaauguuaaagacgugaccaagcugguggccaaccuuccuaaagauuauaugauuacacugaaguacgucccggggauggacgugcuccccagccacugcuggaucuccgaaaugguugugcagcugucugauagccugaccgaccuccuggauaaguuuuccaauauuucugagggacuuagcaacuauuccaucaucgacaaacuggucaauauuguggaugaccucguugaaugugugaaggagaacucuagcaaagaucugaagaaauccuucaagagcccugaaccccgccuuuuuacaccugaggaguucuuuagaaucuucaaucggucuauugacgcuuuuaaggauuucgucguggccuccgaaaccagcgacugcguggucucuuccacgcugagccccgagaaaggcaaggcgaaaaacccuccgggggauucuucccuccauugggcugccauggcccugcccgcucuguuuagccucaucauuggauucgccuuuggcgcucuguacuggaagaaacgccagccuucccuuaccagagccguugaaaauauccagauuaacgaggaggacaaugaaaucucuaugcugcaagagaaggaacgggaguuccaggaaguguga

SEQ ID NO: 4768 - RNA, 738 nt, Artificial Sequence
  derived and/or modified sequence opt6 from Stem_Cell_Factor__Homo_sapiens__CCDS31867.1
augaaaaaaacacaaaccuggauacuaacaugcauauaucuacaauuauuauuauucaacccacuaguaaaaacagaaggaauaugccgaaacagagucacaaacaacguaaaagacguaacaaaacuaguagcaaacuuaccaaaagacuacaugauaacacuaaaauacguaccaggaauggacguacuaccaucacacugcuggauaucagaaaugguaguacaacuaucagauuccuuaacagaccuauuagacaaauucucaaacauaucagaaggauuaucaaacuauucaauaauagacaaacuaguaaacauaguagacgaccuaguagaaugcguaaaagaaaacucaucaaaagacuuaaaaaaaucauucaaaucaccagaaccaagacuauuuacaccagaagaauucuucagaauauucaacagaucaauagacgcauuuaaagacuucguaguagcuucagaaacaucagacugcguaguaucaucaacacuaucaccagaaaaaggcaaagcaaaaaacccaccaggagacucaucauuacacugggcagcaauggcacuacccgcacuauucucacuaauaauaggauucgccuuuggugcauuauacuggaaaaaaagacaaccaucacucacaagagcaguagaaaacauacaaaucaacgaagaagacaacgaaauaucaaugcuacaagaaaaagaacgagaauuccaagaaguauaa

SEQ ID NO: 4769 - protein, 273 aa, Artificial Sequence
  Stem_Cell_Factor__Homo_sapiens__P21583
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 4770 - RNA, 822 nt, Artificial Sequence
  Stem_Cell_Factor__Homo_sapiens__CCDS31868.1
augaagaagacacaaacuuggauucucacuugcauuuaucuucagcugcuccuauuuaauccucucgucaaaacugaagggaucugcaggaaucgugugacuaauaauguaaaagacgucacuaaauugguggcaaaucuuccaaaagacuacaugauaacccucaaauauguccccgggauggauguuuugccaagucauuguuggauaagcgagaugguaguacaauugucagacagcuugacugaucuucuggacaaguuuucaaauauuucugaaggcuugaguaauuauuccaucauagacaaacuugugaauauaguggaugaccuuguggagugcgugaaagaaaacucaucuaaggaucuaaaaaaaucauucaagagcccagaacccaggcucuuuacuccugaagaauucuuuagaauuuuuaauagauccauugaugccuucaaggacuuuguaguggcaucugaaacuagugauugugugguuucuucaacauuaaguccugagaaagauuccagagucagugucacaaaaccauuuauguuacccccuguugcagccagcucccuuaggaaugacagcaguagcaguaauaggaaggccaaaaaucccccuggagacuccagccuacacugggcagccauggcauugccagcauuguuuucucuuauaauuggcuuugcuuuuggagccuuauacuggaagaagagacagccaagucuuacaagggcaguugaaaauauacaaauuaaugaagaggauaaugagauaaguauguugcaagagaaagagagagaguuucaagaaguguaa

SEQ ID NO: 4771 - RNA, 822 nt, Artificial Sequence
  derived and/or modified sequence opt1 from Stem_Cell_Factor__Homo_sapiens__CCDS31868.1
augaagaagacccagaccuggauccugacgugcaucuaccuccagcugcuccuguucaacccccuggugaagaccgagggcaucugccgcaaccgggucaccaacaacgugaaggacgugaccaagcuggucgccaaccucccgaaggacuacaugaucacgcugaaguacgugcccgggauggacgugcugcccagccacugcuggaucuccgagauggucgugcagcucagcgacucccugaccgaccugcucgacaaguucagcaacaucuccgagggccugagcaacuacuccaucaucgacaagcuggugaacaucgucgacgaccucguggagugcgugaaggagaacagcuccaaggaccugaagaaguccuucaagagccccgagccgcgccuguucacccccgaggaguucuuccggaucuucaaccgcagcaucgacgccuucaaggacuucgucguggcguccgagaccagcgacugcguggucuccagcacgcucucccccgagaaggacagccggguguccgugaccaagcccuucaugcugccgcccgucgccgccagcagccugcgcaacgacuccagcuccagcaaccggaaggccaagaacccgcccggggacuccagccuccacugggccgcgauggcccugcccgcccuguucucccucaucaucggcuucgccuucggggcgcuguacuggaagaagcgccagcccagccugacccgggccguggagaacauccagaucaacgaggaggacaacgagaucuccaugcuccaggagaaggagcgcgaguuccaggagguguga

SEQ ID NO: 4772 - RNA, 822 nt, Artificial Sequence
  derived and/or modified sequence opt2 from Stem_Cell_Factor__Homo_sapiens__CCDS31868.1
augaagaagacccagaccuggauccucaccugcaucuaccuccagcuccuccucuucaacccccucgucaagaccgagggcaucugccgcaaccgcgucaccaacaacgucaaggacgucaccaagcucgucgccaaccuccccaaggacuacaugaucacccucaaguacguccccggcauggacguccuccccucccacugcuggaucuccgagauggucguccagcucuccgacucccucaccgaccuccucgacaaguucuccaacaucuccgagggccucuccaacuacuccaucaucgacaagcucgucaacaucgucgacgaccucgucgagugcgucaaggagaacuccuccaaggaccucaagaaguccuucaagucccccgagccccgccucuucacccccgaggaguucuuccgcaucuucaaccgcuccaucgacgccuucaaggacuucgucgucgccuccgagaccuccgacugcgucgucuccuccacccucucccccgagaaggacucccgcgucuccgucaccaagcccuucaugcucccccccgucgccgccuccucccuccgcaacgacuccuccuccuccaaccgcaaggccaagaacccccccggcgacuccucccuccacugggccgccauggcccuccccgcccucuucucccucaucaucggcuucgccuucggcgcccucuacuggaagaagcgccagcccucccucacccgcgccgucgagaacauccagaucaacgaggaggacaacgagaucuccaugcuccaggagaaggagcgcgaguuccaggaggucuga

SEQ ID NO: 4773 - RNA, 822 nt, Artificial Sequence
  derived and/or modified sequence opt3 from Stem_Cell_Factor__Homo_sapiens__CCDS31868.1
augaagaaaacccagacauggauccugacuugcauuuaccuccaacuucuguuguucaaccccuuagugaagacggagggcauauguagaaauagggucaccaacaauguuaaagacgugacaaagcugguagccaaccuaccuaaagauuauaugaucacucucaaguacgugccagggauggacguccugccgagccacugcuggauuuccgaaauggugguucagcuuucugauucacugaccgacuugcucgauaaguuuaguaauaucagcgagggacuguccaacuauucuauuaucgacaaacuggugaauauagucgaugaccucguggaauguguaaaggagaacucgucaaaagauuuaaagaaaaguuucaagagccccgaaccucggcuguuuacaccagaggaguucuuucgcaucuucaaucgauccauugacgcuuuuaaggauuucguuguggcaucugaaaccagcgacugcgucguguccucaacucuuagucccgagaaagauagccgugugucugucacaaagccuuuuauguugccacccguugccgcguccucacugagaaacgacagcaguucuuccaauaggaaagcuaagaacccuccaggugacagcucgcuacauugggccgcaauggcccucccggcucuguucucucuuaucauuggcuuugcauucggggcccuguacuggaaaaagcggcagcccuccuugacccgcgcuguggaaaauauccagauaaacgaggaggauaaugaaauuucaaugcuccaagagaaagaaagagaguuucaggaaguauga

SEQ ID NO: 4774 - RNA, 822 nt, Artificial Sequence
  derived and/or modified sequence opt4 from Stem_Cell_Factor__Homo_sapiens__CCDS31868.1
augaagaagacccagaccuggauccugaccugcaucuaccugcagcugcugcuguucaacccccuggugaagaccgagggcaucugcagaaacagagugaccaacaacgugaaggacgugaccaagcugguggccaaccugcccaaggacuacaugaucacccugaaguacgugcccggcauggacgugcugcccagccacugcuggaucagcgagaugguggugcagcugagcgacagccugaccgaccugcuggacaaguucagcaacaucagcgagggccugagcaacuacagcaucaucgacaagcuggugaacaucguggacgaccugguggagugcgugaaggagaacagcagcaaggaccugaagaagagcuucaagagccccgagcccagacuguucacccccgaggaguucuucagaaucuucaacagaagcaucgacgccuucaaggacuucgugguggccagcgagaccagcgacugcguggugagcagcacccugagccccgagaaggacagcagagugagcgugaccaagcccuucaugcugccccccguggccgccagcagccugagaaacgacagcagcagcagcaacagaaaggccaagaacccccccggcgacagcagccugcacugggccgccauggcccugcccgcccuguucagccugaucaucggcuucgccuucggcgcccuguacuggaagaagagacagcccagccugaccagagccguggagaacauccagaucaacgaggaggacaacgagaucagcaugcugcaggagaaggagagagaguuccaggagguguga

SEQ ID NO: 4775 - RNA, 822 nt, Artificial Sequence
  derived and/or modified sequence opt5 from Stem_Cell_Factor__Homo_sapiens__CCDS31868.1
augaagaaaacccagacauggauccugacgugcauuuaccuccaacugcuucuguucaacccccucgugaagaccgagggcaucuguagaaaucgggucacaaacaauguuaaagacgugaccaagcugguggccaaccuuccuaaagauuauaugauuacacugaaguacgucccggggauggacgugcuccccagccacugcuggaucuccgaaaugguugugcagcugucugauagccugaccgaccuccuggauaaguuuuccaauauuucugagggacuuagcaacuauuccaucaucgacaaacuggucaauauuguggaugaccucguugaaugugugaaggagaacucuagcaaagaucugaagaaauccuucaagagcccugaaccccgccuuuuuacaccugaggaguucuuuagaaucuucaaucggucuauugacgcuuuuaaggauuucgucguggccuccgaaaccagcgacugcguggucucuuccacgcugagccccgagaaagauucucgcguuuccgugaccaagccuuuuaugcucccgcccguggcggcuagcucccugagaaacgacucuagcuccagcaaucggaaagccaagaacccucccggcgacucuucccugcauugggccgcuauggcccucccugcucuguucagccuuaucauuggguuugccuucggagcgcuguacuggaaaaagcgccagcccucucucacaagagccgucgaaaauauccagauuaacgaggaggauaaugaaaucagcaugcugcaagagaaagaacgggaguuucaggaaguguga

SEQ ID NO: 4776 - RNA, 822 nt, Artificial Sequence
  derived and/or modified sequence opt6 from Stem_Cell_Factor__Homo_sapiens__CCDS31868.1
augaaaaaaacacaaacauggauccucacaugcauauaccuacaacuacuacuauucaacccauuaguaaaaacagaaggaaucugcagaaacagaguaacaaacaacgucaaagacguaacaaaacuaguagcaaaucuacccaaagacuacaugauaacacuaaaauacguaccaggaauggacguacucccaucccacugcuggauauccgaaaugguaguacaacuaucagauucacuaacagaccuauuagacaaauucucaaacauaucagaaggauuaucaaacuacucuauaauagacaaauuaguaaacauaguagacgaccuagucgaauguguuaaagaaaacuccucaaaagaccuaaaaaaaagcuucaaaucaccagaaccucgacuauucacacccgaagaauucuucagaauauucaacagaucaauagacgcauucaaagacuucguuguagcaucagaaacaucugacuguguaguaagcucaacacuaucaccagaaaaagacucacgaguauccgucacaaaaccauuuaugcuaccaccaguagcugcaucaucauuaagaaacgacucaucaucauccaacagaaaagcaaaaaacccaccaggagacucaucacuacacugggcagcaauggcacuaccagcauuauuuucauuaauaauaggauucgcauucggagcacuauacuggaaaaaacgucaaccaucauuaacacgagcaguagaaaacauacaaauaaacgaagaagauaacgaaauaucaaugcuacaagaaaaagaaagagaauuucaagaaguuuaa

SEQ ID NO: 4777 - protein, 390 aa, Artificial Sequence
  TGFbeta1__Homo_sapiens__A0A024R0P8
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 4778 - RNA, 1173 nt, Artificial Sequence
  TGFbeta1__Homo_sapiens__EAW57033
augccgcccuccgggcugcggcugcugcugcugcugcuaccgcugcuguggcuacuggugcugacgccuggccggccggccgcgggacuauccaccugcaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcuga

SEQ ID NO: 4779 - RNA, 1173 nt, Artificial Sequence
  derived and/or modified sequence opt1 from TGFbeta1__Homo_sapiens__EAW57033
augcccccgagcggccugcgccuccugcugcuccugcugccccuccuguggcugcucgugcugacccccgggcggcccgccgccggccuguccacgugcaagaccaucgacauggagcucgucaagcgcaagcggaucgaggcgauccgcgggcagauccugagcaagcugcggcucgccuccccgcccagccagggcgaggugccgcccgggccccugcccgaggccgugcuggcccucuacaacuccacccgcgaccgggucgccggcgagagcgcggagcccgagcccgagccggaggccgacuacuacgccaaggaggugacccgcgugcugauggucgagacccacaacgagaucuacgacaaguucaagcaguccacgcacagcaucuacauguucuucaacaccuccgagcugcgggaggccgugcccgagcccgugcuccugagccgcgcggagcugcggcuccugcgccugaagcucaaggucgagcagcacguggagcuguaccagaaguacuccaacaacagcuggcgguaccuguccaaccgccuccuggcccccagcgacuccccggaguggcugagcuucgacgugaccggcgucgugcggcaguggcucucccgcgggggcgagaucgagggguuccggcugagcgcccacugcuccugcgacagccgcgacaacacccuccagguggacaucaacggcuucacgaccgggcggcgcggcgaccuggccaccauccacggcaugaaccggcccuuccugcugcucauggccacgccccuggagcgcgcgcagcaccuccagagcucccgccaccggcgcgcccuggacaccaacuacugcuucagcuccaccgagaagaacugcugcguccggcagcuguacaucgacuuccgcaaggaccugggguggaaguggauccacgagcccaagggcuaccacgccaacuucugccucgggccgugccccuacaucuggagccuggacacccaguacuccaaggugcuggcccucuacaaccagcacaaccccggcgccagcgcggcccccugcugcgugccgcaggcccuggagccccugcccaucgucuacuacgugggccggaagcccaagguggagcagcuguccaacaugaucguccgcagcugcaagugcuccuga

SEQ ID NO: 4780 - RNA, 1173 nt, Artificial Sequence
  derived and/or modified sequence opt2 from TGFbeta1__Homo_sapiens__EAW57033
augccccccuccggccuccgccuccuccuccuccuccucccccuccucuggcuccucguccucacccccggccgccccgccgccggccucuccaccugcaagaccaucgacauggagcucgucaagcgcaagcgcaucgaggccauccgcggccagauccucuccaagcuccgccucgccuccccccccucccagggcgaggucccccccggcccccuccccgaggccguccucgcccucuacaacuccacccgcgaccgcgucgccggcgaguccgccgagcccgagcccgagcccgaggccgacuacuacgccaaggaggucacccgcguccucauggucgagacccacaacgagaucuacgacaaguucaagcaguccacccacuccaucuacauguucuucaacaccuccgagcuccgcgaggccguccccgagcccguccuccucucccgcgccgagcuccgccuccuccgccucaagcucaaggucgagcagcacgucgagcucuaccagaaguacuccaacaacuccuggcgcuaccucuccaaccgccuccucgcccccuccgacucccccgaguggcucuccuucgacgucaccggcgucguccgccaguggcucucccgcggcggcgagaucgagggcuuccgccucuccgcccacugcuccugcgacucccgcgacaacacccuccaggucgacaucaacggcuucaccaccggccgccgcggcgaccucgccaccauccacggcaugaaccgccccuuccuccuccucauggccaccccccucgagcgcgcccagcaccuccaguccucccgccaccgccgcgcccucgacaccaacuacugcuucuccuccaccgagaagaacugcugcguccgccagcucuacaucgacuuccgcaaggaccucggcuggaaguggauccacgagcccaagggcuaccacgccaacuucugccucggccccugccccuacaucuggucccucgacacccaguacuccaagguccucgcccucuacaaccagcacaaccccggcgccuccgccgcccccugcugcgucccccaggcccucgagccccuccccaucgucuacuacgucggccgcaagcccaaggucgagcagcucuccaacaugaucguccgcuccugcaagugcuccuga

SEQ ID NO: 4781 - RNA, 1173 nt, Artificial Sequence
  derived and/or modified sequence opt3 from TGFbeta1__Homo_sapiens__EAW57033
augcccccuagcggccugagacuccuucuguuguuacugccacuacucuggcugcuugugcugaccccggggaggcccgccgcuggauuguccacaugcaagacuaucgacauggagcucgucaaacggaagcgcauugaagcaauacgaggucagauccugucuaaacugcgucucgccucaccuccaagucaaggcgagguucccccugggccauuacccgaagcggugcuggcucuuuacaacagcacgagagauaggguagccggagaguccgcagaaccugagccagagccggaagccgacuauuacgcuaaggaggugacccgggucuugaugguggaaacacacaaugagauuuaugauaaauucaagcagucuacucauucgaucuacauguuuuucaacaccucagagcugcgcgaagcaguucccgagccugugcuacucagcagagccgaacugaggcuucugcgguugaagcucaaagucgagcagcacguggaacuguaucagaaguacaguaauaacuccuggcgcuauuuaucuaaucgacugcucgcuccaagcgacucccccgaguggcuuucauuugauguaacaggcguugugagacaauggcugaguagggguggggagauugaaggauuccgguugagcgcccauuguucuugcgacucccgugauaacacccuacaggucgacaucaauggcuuuacuacaggccgcagaggggaucuggcgaccauacacggaaugaacaggccuuuccuccugcuuauggcaacgccacuggagcgggcccagcauuugcagucaagccgacaccgcagagcucucgacacuaauuacuguuuuaguucuaccgagaaaaacugcugugugaggcaacuguacaucgauuuccggaaggacuuagguuggaaauggauucacgaacccaagggcuaucaugccaauuuuugccuggggccguguccuuacaucuggucccuagauacacaguauagcaaggugcucgcacuguacaaccagcacaaucccggagcuucggccgcgccaugcugugucccucaggcccuugaacccuugccaauuguuuauuacgugggccgcaaacccaagguagagcaacugucuaacaugaucgugagauccugcaaauguucauga

SEQ ID NO: 4782 - RNA, 1173 nt, Artificial Sequence
  derived and/or modified sequence opt4 from TGFbeta1__Homo_sapiens__EAW57033
augccccccagcggccugagacugcugcugcugcugcugccccugcuguggcugcuggugcugacccccggcagacccgccgccggccugagcaccugcaagaccaucgacauggagcuggugaagagaaagagaaucgaggccaucagaggccagauccugagcaagcugagacuggccagcccccccagccagggcgaggugccccccggcccccugcccgaggccgugcuggcccuguacaacagcaccagagacagaguggccggcgagagcgccgagcccgagcccgagcccgaggccgacuacuacgccaaggaggugaccagagugcugaugguggagacccacaacgagaucuacgacaaguucaagcagagcacccacagcaucuacauguucuucaacaccagcgagcugagagaggccgugcccgagcccgugcugcugagcagagccgagcugagacugcugagacugaagcugaagguggagcagcacguggagcuguaccagaaguacagcaacaacagcuggagauaccugagcaacagacugcuggcccccagcgacagccccgaguggcugagcuucgacgugaccggcguggugagacaguggcugagcagaggcggcgagaucgagggcuucagacugagcgcccacugcagcugcgacagcagagacaacacccugcagguggacaucaacggcuucaccaccggcagaagaggcgaccuggccaccauccacggcaugaacagacccuuccugcugcugauggccaccccccuggagagagcccagcaccugcagagcagcagacacagaagagcccuggacaccaacuacugcuucagcagcaccgagaagaacugcugcgugagacagcuguacaucgacuucagaaaggaccugggcuggaaguggauccacgagcccaagggcuaccacgccaacuucugccugggccccugccccuacaucuggagccuggacacccaguacagcaaggugcuggcccuguacaaccagcacaaccccggcgccagcgccgcccccugcugcgugccccaggcccuggagccccugcccaucguguacuacgugggcagaaagcccaagguggagcagcugagcaacaugaucgugagaagcugcaagugcagcuga

SEQ ID NO: 4783 - RNA, 1173 nt, Artificial Sequence
  derived and/or modified sequence opt5 from TGFbeta1__Homo_sapiens__EAW57033
augcccccuagcggccugagacuccugcuucugcuccugccgcuucuguggcuccuggugcugacccccgggcggccugccgcuggacucuccacaugcaagacgaucgacauggagcuggucaaacgcaagagaauugaagccauccggggccagauucuuucuaaacugcgccucgcgagcccucccucccaaggggagguucccccuggaccgcugcccgaagcugugcuugcccuguacaacucuaccagagaucggguggccggcgagagcgcugaaccugagcccgagccugaagccgacuauuacgcuaaggaggucacacgcgugcucaugguugaaacccacaaugagaucuaugauaaauucaagcaguccacacauucuauuuacauguuuuucaacaccagcgagcugagagaagccgugcccgagccgguccugcucucccgggcggaacugcgccuucugagacucaagcugaaaguggagcagcacguugaacuuuaucagaaguacagcaauaacucuuggcgguaucuguccaaucgccuccuggccccuagcgacucucccgaguggcuguccuuugaugugacaggggucgugagacaauggcucagccggggaggcgagaucgaaggcuuccgccugucugcucauuguuccugcgacagcagagauaacacccuucagguggacaucaauggguuuacgaccggacggagaggcgaucuggccacaauucacgggaugaaccgcccuuuccuccugcuuauggcuacaccccuggagcgggcccagcaucuccaguccucuagacaccgccgggcgcuggacaccaauuacuguuuuagcuccaccgagaaaaacugcugugucagacaacuguacaucgauuuccgcaaggaccucggauggaaauggauucacgaacccaagggcuaucaugccaauuuuugccuggggccuuguccguacaucuggagccuugauacgcaguauucuaagguucuggcucucuacaaccagcacaaucccggagccuccgcugccccuugcugugugccccaggcccuggaaccucugcccauuguguauuacgucggccggaaaccgaagguggagcaacuuagcaacaugaucguuagaucuugcaaauguagcuga

SEQ ID NO: 4784 - RNA, 1173 nt, Artificial Sequence
  derived and/or modified sequence opt6 from TGFbeta1__Homo_sapiens__EAW57033
augccaccaucuggacuaagacuuuuauuacuacuacuaccacuauuauggcuuuuaguucuaacaccaggaaggccagcagcaggacuaucaacaugcaaaaccauugauauggaauuaguaaaacgaaaaagaaucgaagccauacgaggacaaauacuaucaaaacuuagacuugcaagcccaccuucccaaggcgaaguaccucccggaccauuaccugaagcaguauuagcucuauacaacuccacucgagaccgaguagccggagaauccgccgaaccagaaccagaaccagaagcagauuacuacgcaaaagaaguaacaagaguuuugaugguagaaacgcacaacgaaauauaugacaaauucaaacaauccacacauucuauauacauguucuucaauacaucugaacuaagagaagcaguacccgaaccaguacuauuaucacgagccgaacuaagacuucuccgacuaaaacuaaaaguagaacaacacguugaacuuuaucaaaaauacucaaauaauucauggagauauuuaucaaauagauuauuagcaccaucagacucuccagaauggcuaucauuugacguaaccggaguaguaagacaaugguuaucuagaggaggagaaauagaagguuuccgauuaucagcacacugcucaugcgauucccgagacaauacauuacaagucgacauaaauggauucacaacaggcagaagaggagaccuagcaacaauacacggaaugaauagaccauuccuauuauuaauggcaacaccauuagaaagagcacaacaccuacaaucuucaagacacagaagagcacuagacacaaacuacuguuucucaucuacagaaaaaaacugcugcgucagacaauuauauauagauuucagaaaagaccuuggauggaaauggauucaugaaccaaaaggauaccacgcaaacuucuguuuaggaccauguccauacauauggucacuagauacacaauacucaaaaguucuagcacucuacaaucaacacaacccaggagcuucagccgcaccaugcuguguaccacaagcucuagaaccacuuccaauaguuuacuauguaggaagaaaaccaaaaguagaacaauuaucaaacaugaucguacgaucauguaaaugcucauaa

SEQ ID NO: 4785 - protein, 390 aa, Artificial Sequence; identical to SEQ ID NO: 4777
  TGFbeta1__Homo_sapiens__P01137

SEQ ID NO: 4786 - RNA, 1173 nt, Artificial Sequence; identical to SEQ ID NO: 4778
  TGFbeta1__Homo_sapiens__AAH00125

SEQ ID NO: 4787 - RNA, 1173 nt, Artificial Sequence; identical to SEQ ID NO: 4779
  derived and/or modified sequence opt1 from TGFbeta1__Homo_sapiens__AAH00125

SEQ ID NO: 4788 - RNA, 1173 nt, Artificial Sequence; identical to SEQ ID NO: 4780
  derived and/or modified sequence opt2 from TGFbeta1__Homo_sapiens__AAH00125

SEQ ID NO: 4789 - RNA, 1173 nt, Artificial Sequence; identical to SEQ ID NO: 4781
  derived and/or modified sequence opt3 from TGFbeta1__Homo_sapiens__AAH00125

SEQ ID NO: 4790 - RNA, 1173 nt, Artificial Sequence; identical to SEQ ID NO: 4782
  derived and/or modified sequence opt4 from TGFbeta1__Homo_sapiens__AAH00125

SEQ ID NO: 4791 - RNA, 1173 nt, Artificial Sequence; identical to SEQ ID NO: 4783
  derived and/or modified sequence opt5 from TGFbeta1__Homo_sapiens__AAH00125

SEQ ID NO: 4792 - RNA, 1173 nt, Artificial Sequence
  derived and/or modified sequence opt6 from TGFbeta1__Homo_sapiens__AAH00125
augccaccaucaggauuaagauuacuacuauuacuacuaccacuucuaugguuauuaguacuaacaccaggaagacccgccgcaggacuaucaacaugcaaaacaauagacauggaauuaguaaaaagaaaacgcauagaagcaauaagaggacaaauauuaucaaaauuaagacuagcauccccacccucacaaggagaagucccaccaggcccacuaccagaagcaguacuagcacuauacaacucaacaagagacagaguagcaggagaaucagcagaaccugaaccggaaccagaagcagacuacuacgcaaaagaaguaacaagaguacuaaugguugaaacucauaacgaaauauaugacaaauucaaacaaucaacacauucaauuuauauguucuuuaacacaucagaacuaagagaagcaguuccugaaccaguccuauuauccagagcagaauuaagacuauuaagauuaaaauuaaaaguagaacaacauguagaacuauaucaaaaauacucaaacaauucuuggagauaccuauccaaucgucuccuagccccaucagauuccccagaauggcuaucauucgaugucacaggaguaguaaggcaaugguuauccagaggaggagaaauagaaggauuuagacuaucagcacacugcaguugcgacucuagagacaauacucuacaaguagauauaaauggcuuuacaacaggacguaggggagauuuagcaacuauacacgguaugaaucgaccauuucuauuacuaauggcaacaccacuugaacgugcucaacacuuacaaucuucacgccacagaagagcacucgacacaaauuacugcuucucaagcacagaaaaaaacugcugcguuagacaauuauacauagacuucagaaaagauuuaggauggaaauggauccacgaaccaaaaggauaccaugccaacuucuguuuaggaccaugcccauacauauggucacuagacacacaauacucaaaaguccuagcucuauauaaucaacauaacccaggugccuccgcagccccuuguuguguaccccaagcacuagaaccauuaccaauaguauauuacguaggaagaaaaccaaaaguagaacaacuaucaaauaugauaguaagaagcugcaaauguucauaa

SEQ ID NO: 4793 - protein, 414 aa, Artificial Sequence
  TGFbeta2__Homo_sapiens__P61812
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 4794 - RNA, 1245 nt, Artificial Sequence
  TGFbeta2__Homo_sapiens__AAH96235
augcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauaagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaa

SEQ ID NO: 4795 - RNA, 1245 nt, Artificial Sequence
  derived and/or modified sequence opt1 from TGFbeta2__Homo_sapiens__AAH96235
augcacuacugcgugcugagcgccuuccucauccugcaccuggucaccguggcccucucccugagcacgugcuccacccuggacauggaccaguucaugcgcaagcggaucgaggcgauccgcggccagauccucagcaagcugaagcugaccagcccgcccgaggacuaccccgagcccgaggaggugcccccggaggucaucuccaucuacaacuccacccgggaccuccugcaggagaaggccagccgccgggccgccgccugcgagcgcgagcgguccgacgaggaguacuacgcgaaggagguguacaagaucgacaugccgcccuucuuccccagcgagaacgccaucccgcccaccuucuaccgccccuacuuccggaucgugcgcuucgacgucuccgccauggagaagaacgccagcaaccuggugaaggcggaguuccggguguuccgccuccagaaccccaaggcccggguccccgagcagcgcaucgagcuguaccagauccugaaguccaaggaccucacgagccccacccagcgguacaucgacuccaagguggugaagacccgcgccgagggggaguggcugagcuucgacgucaccgacgccgugcacgaguggcugcaccacaaggaccggaaccucggcuucaagaucucccugcacugccccugcugcacguucgugcccagcaacaacuacaucaucccgaacaaguccgaggagcuggaggcccgcuucgcggggaucgacggcaccagcaccuacaccagcggggaccagaagacgaucaaguccacccggaagaagaacagcggcaagacgccccaccuccugcugaugcuccugcccuccuaccgccuggagagccagcagaccaaccggcgcaagaagcgcgcccucgacgccgccuacugcuuccggaacguccaggacaacugcugccugcgcccccuguacaucgacuucaagcgggaccucggcuggaaguggauccacgagccgaagggguacaacgccaacuucugcgcgggcgccugccccuaccugugguccagcgacacccagcacucccgcgugcugagccucuacaacaccaucaaccccgaggccuccgccagccccugcugcgugucccaggaccuggagccgcugaccauccucuacuacaucgggaagacccccaagaucgagcagcugagcaacaugaucgucaaguccugcaagugcagcuga

SEQ ID NO: 4796 - RNA, 1245 nt, Artificial Sequence
  derived and/or modified sequence opt2 from TGFbeta2__Homo_sapiens__AAH96235
augcacuacugcguccucuccgccuuccucauccuccaccucgucaccgucgcccucucccucuccaccugcuccacccucgacauggaccaguucaugcgcaagcgcaucgaggccauccgcggccagauccucuccaagcucaagcucaccuccccccccgaggacuaccccgagcccgaggaggucccccccgaggucaucuccaucuacaacuccacccgcgaccuccuccaggagaaggccucccgccgcgccgccgccugcgagcgcgagcgcuccgacgaggaguacuacgccaaggaggucuacaagaucgacaugccccccuucuuccccuccgagaacgccaucccccccaccuucuaccgccccuacuuccgcaucguccgcuucgacgucuccgccauggagaagaacgccuccaaccucgucaaggccgaguuccgcgucuuccgccuccagaaccccaaggcccgcguccccgagcagcgcaucgagcucuaccagauccucaaguccaaggaccucaccucccccacccagcgcuacaucgacuccaaggucgucaagacccgcgccgagggcgaguggcucuccuucgacgucaccgacgccguccacgaguggcuccaccacaaggaccgcaaccucggcuucaagaucucccuccacugccccugcugcaccuucguccccuccaacaacuacaucauccccaacaaguccgaggagcucgaggcccgcuucgccggcaucgacggcaccuccaccuacaccuccggcgaccagaagaccaucaaguccacccgcaagaagaacuccggcaagaccccccaccuccuccucaugcuccuccccuccuaccgccucgagucccagcagaccaaccgccgcaagaagcgcgcccucgacgccgccuacugcuuccgcaacguccaggacaacugcugccuccgcccccucuacaucgacuucaagcgcgaccucggcuggaaguggauccacgagcccaagggcuacaacgccaacuucugcgccggcgccugccccuaccucugguccuccgacacccagcacucccgcguccucucccucuacaacaccaucaaccccgaggccuccgccucccccugcugcgucucccaggaccucgagccccucaccauccucuacuacaucggcaagacccccaagaucgagcagcucuccaacaugaucgucaaguccugcaagugcuccuga

SEQ ID NO: 4797 - RNA, 1245 nt, Artificial Sequence
  derived and/or modified sequence opt3 from TGFbeta2__Homo_sapiens__AAH96235
augcacuacugcgugcugagcgccuuccucauccuucaucuggucaccguugcuuuguccuuaucuacauguucaacucuggacauggaucaguuuaugagaaagaggauugaggcaauacggggccaaauccuaaguaaacucaagcugacgagcccucccgaagacuauccagagccggaagaggugcccccugaaguaauuuccaucuacaacucuacccgcgaucuucugcaggagaaagccucgcgacgugcggcugccugcgagagagaaaggucagacgaggaauauuacgcaaaggagguguauaaaauugauaugccacccuucuuuccuagcgagaaugccaucccacccacauucuaccggccuuauuuucgcauagucagauucgacgugagugcuauggaaaagaacgcauccaauuugguuaaggccgaguuuaggguguuccggcuccagaacccaaaagcucgcgucccggaacagcgaaucgagcuguaccaaauucugaagucuaaagaucucacuagccccacccagagauacaucgacuccaaggugguaaaaacaagggccgaaggggagugguuaucauuugauguuaccgacgcggugcacgaguggcugcaucacaaggaucggaaucuuggauucaagauuaguuugcauuguccuugcuguacuuuugucccaagcaacaauuauaucauacccaacaaaucugaggaacuggaagcacguuucgccgguauugacggcacauccaccuacacgucaggggaucagaagacuaucaaaagcacccgcaagaaaaauaguggaaagacaccucaccuacuccugaugcuucugccaucuuauagauuggagucccagcaaacuaacaggcggaaaaagcgagcucucgacgccgcauacugcuuucgcaaugugcaggacaacuguugccugagacccuuauauauugauuucaagagggaccugggcuggaaauggauccacgaaccgaaggguuacaaugcuaacuucugugccggggcgugcccuuaucucuggagcucggauacccagcauucucgggugcuuucccuguacaauacaaucaaccccgaggccucagcaaguccauguugcgucagccaggacuuggagccucuaaccauucuguacuauauaggaaaaacgcccaagaucgaacaacucuccaacaugauuguuaaaucuugcaaguguagcuga

SEQ ID NO: 4798 - RNA, 1245 nt, Artificial Sequence
  derived and/or modified sequence opt4 from TGFbeta2__Homo_sapiens__AAH96235
augcacuacugcgugcugagcgccuuccugauccugcaccuggugaccguggcccugagccugagcaccugcagcacccuggacauggaccaguucaugagaaagagaaucgaggccaucagaggccagauccugagcaagcugaagcugaccagcccccccgaggacuaccccgagcccgaggaggugccccccgaggugaucagcaucuacaacagcaccagagaccugcugcaggagaaggccagcagaagagccgccgccugcgagagagagagaagcgacgaggaguacuacgccaaggagguguacaagaucgacaugccccccuucuuccccagcgagaacgccaucccccccaccuucuacagacccuacuucagaaucgugagauucgacgugagcgccauggagaagaacgccagcaaccuggugaaggccgaguucagaguguucagacugcagaaccccaaggccagagugcccgagcagagaaucgagcuguaccagauccugaagagcaaggaccugaccagccccacccagagauacaucgacagcaagguggugaagaccagagccgagggcgaguggcugagcuucgacgugaccgacgccgugcacgaguggcugcaccacaaggacagaaaccugggcuucaagaucagccugcacugccccugcugcaccuucgugcccagcaacaacuacaucauccccaacaagagcgaggagcuggaggccagauucgccggcaucgacggcaccagcaccuacaccagcggcgaccagaagaccaucaagagcaccagaaagaagaacagcggcaagaccccccaccugcugcugaugcugcugcccagcuacagacuggagagccagcagaccaacagaagaaagaagagagcccuggacgccgccuacugcuucagaaacgugcaggacaacugcugccugagaccccuguacaucgacuucaagagagaccugggcuggaaguggauccacgagcccaagggcuacaacgccaacuucugcgccggcgccugccccuaccuguggagcagcgacacccagcacagcagagugcugagccuguacaacaccaucaaccccgaggccagcgccagccccugcugcgugagccaggaccuggagccccugaccauccuguacuacaucggcaagacccccaagaucgagcagcugagcaacaugaucgugaagagcugcaagugcagcuga

SEQ ID NO: 4799 - RNA, 1245 nt, Artificial Sequence
  derived and/or modified sequence opt5 from TGFbeta2__Homo_sapiens__AAH96235
augcacuacugcgugcugagcgccuuccucauccugcaucuugucaccguugcucugucccucucuacauguagcacgcuggacauggaucaguuuaugagaaagcggauugaggccauccgcggccaaauucuuuccaaacugaagcucaccucucccccugaagacuauccggagcccgaagaggugccucccgaagugaucagcauuuacaacuccacaagagaucugcugcaggagaaagcgucucggcgcgcugccgccugcgagagagaacggagcgacgaggaauauuacgcuaaggaggucuauaaaaucgauaugccucccuucuuuccuuccgagaaugccaucccgcccaccuucuaccgcccuuauuuuagaauugugcgguucgacguuagcgcuauggaaaagaacgccucuaaucucgugaaggcggaguuucgcgucuucagacugcagaaccccaaagcccgggugccugaacagcgcaucgagcuuuaccaaauucugaaguccaaagaucucacaagccccacccagagauacaucgacucuaagguugugaaaacacgggcugaaggggaguggcuguccuuugaugucaccgacgccgugcacgaguggcuucaucacaaggaucgcaaucugggauucaagauuagccuccauuguccgugcuguacguuugugccuucuaacaauuauaucauucccaacaaauccgaggaacuggaagcuagauucgccggcaucgacgggaccagcacauacaccuccggagaucagaagacaaucaaaucuacccggaagaaaaauagcggcaagacgccucaucugcuccugaugcuucugcccuccuauagacucgagagccagcaaacaaaccgccggaaaaagagagcgcuggacgccgcuuacugcuuucgcaauguccaggacaacuguugccuucggccccuguauauugauuucaagagagaccucggguggaaauggauccacgaaccuaagggauacaaugccaacuucugugcuggcgccugcccguaucuguggucuuccgauacccagcacagccgcguucugucucucuacaauacaauuaaccccgaggccagcgcuuccccuuguugcgugucucaggaccuggagccccuuaccauccuguacuauauuggcaaaaccccuaagaucgaacaacucagcaacaugaucgugaaauccugcaaguguagcuga

SEQ ID NO: 4800 - RNA, 1245 nt, Artificial Sequence
  derived and/or modified sequence opt6 from TGFbeta2__Homo_sapiens__AAH96235
augcacuacugcguacuaucagccuucuuaauacuacaccuaguaacaguagcauuauccuuaucaacaugcucaacauuagacauggaucaauucaugcguaaaagaaucgaagcuauuagaggacaaauacuuucaaaacucaaacucaccucuccaccagaagauuacccagaaccagaagaaguacccccagaaguaauuucaauauacaauucaacaagagaucuacuccaagaaaaagcaucacgaagagcagcagccugcgaaagagaacguucagaugaagaauacuaugcaaaagaaguauacaaaauagacaugccaccauucuuuccaucugaaaacgcaauaccaccaaccuucuacagaccauauuuccgcauagucagauucgacgucucagcaauggaaaaaaaugcauccaaccuaguaaaagcagaauuccgaguauucagacuccaaaaccccaaagcccgagucccagaacaacgcauagaacucuaucaaauacuaaaauccaaagacuuaacauccccaacccaaagauauauugacucaaaaguaguaaaaacaagagccgaaggagaaugguuaucauuugacguaaccgacgccguacaugaauggcuacaccacaaagacagaaacuuaggauucaaaauaucccuacacugcccauguugcacauucguaccuagcaacaauuacauaaucccaaacaaaucagaagaacuagaagcaagauucgccgguauagacggaacaucuacuuacacauccggagaccaaaaaacaauaaaaucaacaagaaaaaaaaacucaggcaaaacaccacacuuacuccucaugcuauuaccaucauauagauuagaaucccaacaaacaaauagaagaaaaaaacgcgcccuagaugcagcauauuguuuucgaaacguacaagauaauugcugucuaagaccacucuacauugacuuuaaacgagaccuaggauggaaauggauccacgaaccaaaaggauauaacgcaaacuucugcgcaggugcaugucccuaccuaugguccucagacacacaacacucaagaguacucucacuauauaacacaauaaaucccgaagcaucggcaagcccaugcugcguaucacaagaucuagaaccacucacaauacuguauuacauaggaaaaacacccaaaauagaacaacucucaaacaugauaguaaaauccuguaaaugcucauaa

SEQ ID NO: 4801 - protein, 412 aa, Artificial Sequence
  TGFbeta3__Homo_sapiens__A5YM40
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 4802 - RNA, 1239 nt, Artificial Sequence
  TGFbeta3__Homo_sapiens__ABQ59024
augaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaauuccgggucuugcgggugcccaaccccagcucuaagcggaaugagcagaggaucgagcucuuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcuga

SEQ ID NO: 4803 - RNA, 1239 nt, Artificial Sequence
  derived and/or modified sequence opt1 from TGFbeta3__Homo_sapiens__ABQ59024
augaagaugcaccuccagcgcgcccucguggugcuggcccugcucaacuucgcgaccgugagccugucccugagcacgugcaccacccucgacuucggccacaucaagaagaagcggguggaggccauccgcgggcagauccuguccaagcugcggcucaccagcccgcccgagcccaccgucaugacgcacgugcccuaccaggugcuggcccuguacaacuccacccgcgagcuccuggaggagaugcacggcgagcgggaggaggggugcacccaggagaacaccgagagcgaguacuacgccaaggagauccacaaguucgacaugauccagggccuggccgagcacaacgagcucgcggucugccccaaggggaucacguccaagguguuccgcuucaacgugagcuccgucgagaagaaccggaccaaccuguuccgcgccgaguuccgggugcugcgcgugccgaaccccagcuccaagcggaacgagcagcgcaucgagcuguuccagauccugcggcccgacgagcacaucgccaagcagcgcuacaucggcggcaagaaccugcccacccgggggaccgccgaguggcucagcuucgacgucacggacaccgugcgcgaguggcugcugcggcgcgaguccaaccucggccuggagaucagcauccacugcccgugccacaccuuccagcccaacggggacauccuggagaacauccacgaggugauggagaucaaguucaagggcgucgacaacgaggacgaccacgggcggggcgaccucggccgccugaagaagcagaaggaccaccacaacccccaccugauccucaugaugaucccgccccaccggcuggacaaccccgggcagggcgggcagcgcaagaagcgcgcgcuggacaccaacuacugcuuccggaaccucgaggagaacugcugcgugcgcccccuguacaucgacuuccggcaggaccugggcuggaagugggugcacgagcccaagggcuacuacgccaacuucugcuccgggccgugccccuaccuccgcagcgccgacacgacccacuccaccguccugggccuguacaacacccucaaccccgaggccagcgccucccccugcugcgugccgcaggaccuggagccccugacgauccucuacuacguggggcggacccccaaggucgagcagcugagcaacaugguggucaagagcugcaagugcuccuga

SEQ ID NO: 4804 - RNA, 1239 nt, Artificial Sequence
  derived and/or modified sequence opt2 from TGFbeta3__Homo_sapiens__ABQ59024
augaagaugcaccuccagcgcgcccucgucguccucgcccuccucaacuucgccaccgucucccucucccucuccaccugcaccacccucgacuucggccacaucaagaagaagcgcgucgaggccauccgcggccagauccucuccaagcuccgccucaccuccccccccgagcccaccgucaugacccacguccccuaccagguccucgcccucuacaacuccacccgcgagcuccucgaggagaugcacggcgagcgcgaggagggcugcacccaggagaacaccgaguccgaguacuacgccaaggagauccacaaguucgacaugauccagggccucgccgagcacaacgagcucgccgucugccccaagggcaucaccuccaaggucuuccgcuucaacgucuccuccgucgagaagaaccgcaccaaccucuuccgcgccgaguuccgcguccuccgcguccccaaccccuccuccaagcgcaacgagcagcgcaucgagcucuuccagauccuccgccccgacgagcacaucgccaagcagcgcuacaucggcggcaagaaccuccccacccgcggcaccgccgaguggcucuccuucgacgucaccgacaccguccgcgaguggcuccuccgccgcgaguccaaccucggccucgagaucuccauccacugccccugccacaccuuccagcccaacggcgacauccucgagaacauccacgaggucauggagaucaaguucaagggcgucgacaacgaggacgaccacggccgcggcgaccucggccgccucaagaagcagaaggaccaccacaacccccaccucauccucaugaugauccccccccaccgccucgacaaccccggccagggcggccagcgcaagaagcgcgcccucgacaccaacuacugcuuccgcaaccucgaggagaacugcugcguccgcccccucuacaucgacuuccgccaggaccucggcuggaaguggguccacgagcccaagggcuacuacgccaacuucugcuccggccccugccccuaccuccgcuccgccgacaccacccacuccaccguccucggccucuacaacacccucaaccccgaggccuccgccucccccugcugcgucccccaggaccucgagccccucaccauccucuacuacgucggccgcacccccaaggucgagcagcucuccaacauggucgucaaguccugcaagugcuccuga

SEQ ID NO: 4805 - RNA, 1239 nt, Artificial Sequence
  derived and/or modified sequence opt3 from TGFbeta3__Homo_sapiens__ABQ59024
augaagaugcaucugcagagagcccucgugguccuugcucuguugaacuucgcaaccguuagcuuaucccugucuacaugcacuacgcuagacuuuggccacaucaaaaagaaaaggguggaggccauucgggggcaaauacucucaaagcugcgccuuaccagucccccugaaccaacaguaaugacucacgugccguaccagguccuggcguuguauaauagcacccgagagcuccuggaagagaugcauggagaacgugaggaggguuguacacaggaaaacaccgaguccgaauacuaugcuaaagagauccacaaguucgauaugauucagggccuggccgagcauaaugaacucgcagugugccccaaggggaucacuucuaaaguuuuuagauucaacgugucgucagucgagaagaauaggacaaacuuauuucgggccgaguuccgcgugcugagaguaccuaauccaagcaguaaaaggaacgaacaacggauugaacuuuuucagaucuugcgccccgacgagcacauagcuaagcagcgauacaucggaggcaaaaaucugccuaccagagguacggcagaguggcuauccuucgauguuacugacaccgugagggaauggcuccugcggcgugagucuaaccuugggcuggaaauuagcauccacuguccaugccauacauuucagcccaauggagauauuuuggagaacauccacgaagucauggagauaaaguucaagggcguggacaaugaggaugaccauggccgcggggaucucggaagacugaaaaagcaaaaagaccaccacaacccucauuuaauucugaugaugaucccaccgcacaggcucgauaaucccggucagggcgggcagcggaagaaacgagcccuugacacuaacuauuguuuucgcaaccuggaagagaauugcugugugagaccuuuguacauugauuucaggcaggaccuaggauggaaguggguccaugaaccaaaaggcuauuacgcuaacuuuugcuccggucccuguccuuaccugcggucagccgacaccacacacaguaccguucucgggcuguauaauacgcuuaacccagaggcgagcgcaucucccugcugugugccgcaagaucuggaaccuuugacuauccucuacuauguaggacgcacacccaagguggagcagcuguccaauauggucgugaagucaugcaaaugcagcuga

SEQ ID NO: 4806 - RNA, 1239 nt, Artificial Sequence
  derived and/or modified sequence opt4 from TGFbeta3__Homo_sapiens__ABQ59024
augaagaugcaccugcagagagcccugguggugcuggcccugcugaacuucgccaccgugagccugagccugagcaccugcaccacccuggacuucggccacaucaagaagaagagaguggaggccaucagaggccagauccugagcaagcugagacugaccagcccccccgagcccaccgugaugacccacgugcccuaccaggugcuggcccuguacaacagcaccagagagcugcuggaggagaugcacggcgagagagaggagggcugcacccaggagaacaccgagagcgaguacuacgccaaggagauccacaaguucgacaugauccagggccuggccgagcacaacgagcuggccgugugccccaagggcaucaccagcaagguguucagauucaacgugagcagcguggagaagaacagaaccaaccuguucagagccgaguucagagugcugagagugcccaaccccagcagcaagagaaacgagcagagaaucgagcuguuccagauccugagacccgacgagcacaucgccaagcagagauacaucggcggcaagaaccugcccaccagaggcaccgccgaguggcugagcuucgacgugaccgacaccgugagagaguggcugcugagaagagagagcaaccugggccuggagaucagcauccacugccccugccacaccuuccagcccaacggcgacauccuggagaacauccacgaggugauggagaucaaguucaagggcguggacaacgaggacgaccacggcagaggcgaccugggcagacugaagaagcagaaggaccaccacaacccccaccugauccugaugaugauccccccccacagacuggacaaccccggccagggcggccagagaaagaagagagcccuggacaccaacuacugcuucagaaaccuggaggagaacugcugcgugagaccccuguacaucgacuucagacaggaccugggcuggaagugggugcacgagcccaagggcuacuacgccaacuucugcagcggccccugccccuaccugagaagcgccgacaccacccacagcaccgugcugggccuguacaacacccugaaccccgaggccagcgccagccccugcugcgugccccaggaccuggagccccugaccauccuguacuacgugggcagaacccccaagguggagcagcugagcaacaugguggugaagagcugcaagugcagcuga

SEQ ID NO: 4807 - RNA, 1239 nt, Artificial Sequence
  derived and/or modified sequence opt5 from TGFbeta3__Homo_sapiens__ABQ59024
augaagaugcaccuucagagagcccucgugguccuggcucugcugaacuucgccaccguuagccucucccugucuacaugcacgacccuugacuuuggccauaucaaaaagaaacggguggaggcgauucgcgggcaaauccugagcaagcucagacugacaucucccccugaaccgaccgugaugacacacguccccuaccaggugcuggcucucuauaauuccacccgggagcugcuugaagagaugcauggagaacgcgaggagggcuguacacaggaaaacaccgagagcgaauacuaugccaaagagauucacaaguucgauaugauccaggggcuggccgagcauaaugaacucgcuguuugcccuaagggaauuacguccaaaguguuuagauucaacgucucuagcguggagaagaaucggaccaaccuguuucgcgccgaguucagaguucuucgggugcccaauccuuccagcaaacgcaacgaacaaagaaucgaacuguuucagauccuccggcccgacgagcacauugcuaagcagcgcuacaucggcgggaaaaaucugccuacaagaggaaccgccgaguggcugucuuucgaugucacagacaccgugcgggaauggcuccugcgcagagaguccaaccuuggccuggaaauuagcauccacuguccgugccauacguuucagcccaauggcgauauucucgagaacauccacgaagugauggagauuaaguucaagggggucgacaaugaggaugaccauggacggggcgaucuggggagacuuaaaaagcaaaaagaccaccacaacccucaucugauccucaugaugauucccccucaccgccuggauaaucccggacagggcgggcagcggaagaaaagagcgcuggacacaaacuauuguuuucgcaaccucgaagagaauugcuguguucggccgcuguacaucgauuucagacaggaccuuggauggaagugggugcaugaaccuaaaggcuauuacgccaacuuuugcucuggccccuguccuuaccugcgcuccgcugacaccacacacagcaccgugcucgggcuguauaauacccuuaaccccgaggccucugcuucccccugcugugucccucaagaucuggaaccgcucacaauccuguacuaugugggacggacgcccaagguugagcagcugagcaauaugguggucaaguccugcaaaugcucuuga

SEQ ID NO: 4808 - RNA, 1239 nt, Artificial Sequence
  derived and/or modified sequence opt6 from TGFbeta3__Homo_sapiens__ABQ59024
augaaaaugcaccuacaacgagcacuaguaguacuagcacuacucaauuucgccacaguaucacuaucacuaucaacaugcacaacccuagacuuuggacacauaaaaaaaaaaaggguagaagcaaucagaggacaaauuuuaucaaaacucagauuaacaucaccaccagaaccaacaguuaugacacacguaccauaccaaguccucgcauuauauaacagcacacgagaacuauuagaagaaaugcacggugaaagagaagaaggaugcacacaagaaaacacugaaucagaauacuacgcaaaagaaauccauaaauucgacaugauccaaggacuagcagaacauaacgaauuagccguaugcccaaaaggcauaaccucaaaaguauucagauucaacgucucaagcguagaaaaaaaccguacaaacuuauuccgagcggaauucagaguucuaagaguaccaaauccuucaucaaaaagaaacgaacagagaauagaauuauuucaaauacuccgaccagacgaacacauagcaaaacaaagauacauaggaggaaaaaaccuaccaacaagaggaaccgcagaauggcuaagcuuugacguaacagacacaguaagagaauggcuauuaaggagagaaucaaaccuaggacucgaaauaaguauacacugcccaugccacacauuccaaccaaacggagacauacuagaaaacauacacgaaguuauggaaauaaaauucaaaggagucgacaaugaagaugaucacggaaggggagaccuaggaagauuaaaaaaacaaaaagaccaccauaacccucaucuaauauuaaugaugauaccaccucacagauuagauaacccaggacaaggaggccaacgcaaaaaaagagcacucgauacaaacuauugcuucagaaaccuagaagaaaacugcugcguacgaccauuauauauagacuuuagacaagaccuaggauggaaauggguacacgaaccaaaaggauacuaugcaaacuucuguucuggacccugccccuaccucagaucagcagacacaacacauucaacaguacuaggcuuauacaacacauuaaaucccgaagcaucugcaucaccaugcugcgucccacaagacuuagaaccauuaaccauacuauacuacguaggacgaacaccaaaaguagaacaauuaucaaacauggucguaaaaucaugcaagugcuccuaa

SEQ ID NO: 4809 - protein, 412 aa, Artificial Sequence; identical to SEQ ID NO: 4801
  TGFbeta3__Homo_sapiens__P10600

SEQ ID NO: 4810 - RNA, 1239 nt, Artificial Sequence; identical to SEQ ID NO: 4802
  TGFbeta3__Homo_sapiens__AAC79727

SEQ ID NO: 4811 - RNA, 1239 nt, Artificial Sequence; identical to SEQ ID NO: 4803
  derived and/or modified sequence opt1 from TGFbeta3__Homo_sapiens__AAC79727

SEQ ID NO: 4812 - RNA, 1239 nt, Artificial Sequence; identical to SEQ ID NO: 4804
  derived and/or modified sequence opt2 from TGFbeta3__Homo_sapiens__AAC79727

SEQ ID NO: 4813 - RNA, 1239 nt, Artificial Sequence; identical to SEQ ID NO: 4805
  derived and/or modified sequence opt3 from TGFbeta3__Homo_sapiens__AAC79727

SEQ ID NO: 4814 - RNA, 1239 nt, Artificial Sequence; identical to SEQ ID NO: 4806
  derived and/or modified sequence opt4 from TGFbeta3__Homo_sapiens__AAC79727

SEQ ID NO: 4815 - RNA, 1239 nt, Artificial Sequence; identical to SEQ ID NO: 4807
  derived and/or modified sequence opt5 from TGFbeta3__Homo_sapiens__AAC79727

SEQ ID NO: 4816 - RNA, 1239 nt, Artificial Sequence
  derived and/or modified sequence opt6 from TGFbeta3__Homo_sapiens__AAC79727
augaaaaugcaccuacaacgagcacuaguaguauuagcauuacuaaauuucgcaaccguaagccuaucauuaucaacuugcacaacacuagauuucggacauaucaaaaaaaaacguguagaagcgauucgaggacaaauacuauccaaacuacgacuaacaaguccaccagaaccaacaguaaugacacacguaccauaccaaguacuagcauuauacaacucaaccagggaacuacuagaagaaaugcacggagaaagagaagaaggaugcacacaagaaaacacagaaucagaauacuacgccaaagaaauacacaaauuugacaugauccaaggauuagcagaacacaacgaauuagcugucugccccaaaggaauaacaucaaaagucuuuagauuuaauguaagcagcguugaaaaaaacagaacaaaccuauuccgagcagaauuuagaguacuaaggguaccaaaccccaguucaaaaagaaaugaacaaagaauagaacuauuucaaauauuacgaccagaugaacacauagcaaaacaaagauacauaggcggaaaaaaccuaccaacaagaggaacagcagaauggcuaucauuugacguaacagacacuguacgagaaugguuacuaagaagagaaucaaacuuaggacuagaaauaagcauacacugcccaugucacaccuuccaaccgaacggagacauauuagaaaacauacacgaaguaauggaaauaaaauucaaaggaguagacaaugaagaugaccauggaagaggagacuuagggagauuaaaaaaacaaaaagaccaucacaacccacauuuaauacuaaugaugaucccaccacacagacuagacaaccccggacaaggaggacaaagaaaaaaaagagcccuagauacaaauuacugcuuuagaaaccuagaagaaaacuguugcguacgaccauuauacauagacuucagacaagacuuaggauggaaauggguacacgaaccuaaaggauacuacgcaaacuuuugcagcggaccaugcccauaccuuagaucagcugacacaacccacuccacagucuuaggacuauauaacacauuaaauccagaagcaucagcaucaccauguuguguaccacaagaccuagaaccgcuaacaauacucuauuacguaggaagaacaccaaaaguagaacaacuaaguaacauggugguaaaaucaugcaaauguucauaa

SEQ ID NO: 4817 - protein, 251 aa, Artificial Sequence
  TL1A__Homo_sapiens__O95150
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 4818 - RNA, 756 nt, Artificial Sequence
  TL1A__Homo_sapiens__AAH69435
auggccgaggaucugggacugagcuuuggggaaacagccaguguggaaaugcugccagagcacggcagcugcaggcccaaggccaggagcagcagcgcacgcugggcucucaccugcugccugguguugcuccccuuccuugcaggacucaccacauaccugcuugucagccagcuccgggcccagggagaggccugugugcaguuccaggcucuaaaaggacaggaguuugcaccuucacaucagcaaguuuaugcaccucuuagagcagacggagauaagccaagggcacaccugacaguugugagacaaacucccacacagcacuuuaaaaaucaguucccagcucugcacugggaacaugaacuaggccuggccuucaccaagaaccgaaugaacuauaccaacaaauuccugcugaucccagagucgggagacuacuucauuuacucccaggucacauuccgugggaugaccucugagugcagugaaaucagacaagcaggccgaccaaacaagccagacuccaucacuguggucaucaccaagguaacagacagcuacccugagccaacccagcuccucauggggaccaagucugugugcgaaguagguagcaacugguuccagcccaucuaccucggagccauguucuccuugcaagaaggggacaagcuaauggugaacgucagugacaucucuuugguggauuacacaaaagaagauaaaaccuucuuuggagccuucuuacuauag

SEQ ID NO: 4819 - RNA, 756 nt, Artificial Sequence
  derived and/or modified sequence opt1 from TL1A__Homo_sapiens__AAH69435
auggccgaggaccugggccucagcuucggggagaccgccuccguggagaugcugcccgagcacggcagcugccgcccgaaggcgcgguccagcuccgcccgcugggcccugaccugcugccucguccugcugcccuuccucgccgggcugacgaccuaccugcucgugagccagcugcgggcccagggcgaggcgugcgugcaguuccaggcccugaaggggcaggaguucgcccccucccaccagcaggucuacgcgccccuccgcgccgacggcgacaagccgcgggcccaccugaccguggugcgccagacccccacgcagcacuucaagaaccaguuccccgcccugcacugggagcacgagcucggccuggccuucaccaagaaccggaugaacuacaccaacaaguuccugcucauccccgagagcggggacuacuucaucuacucccaggucaccuuccgcggcaugacgagcgagugcuccgagauccggcaggccgggcgcccgaacaagcccgacagcaucaccguggugaucaccaaggucaccgacuccuaccccgagcccacgcagcugcugaugggcaccaagagcgugugcgaggugggguccaacugguuccagccgaucuaccucggcgcgauguucagccugcaggagggcgacaagcugauggucaacguguccgacaucagccucguggacuacaccaaggaggacaagaccuucuucggggccuuccugcuguga

SEQ ID NO: 4820 - RNA, 756 nt, Artificial Sequence
  derived and/or modified sequence opt2 from TL1A__Homo_sapiens__AAH69435
auggccgaggaccucggccucuccuucggcgagaccgccuccgucgagaugcuccccgagcacggcuccugccgccccaaggcccgcuccuccuccgcccgcugggcccucaccugcugccucguccuccuccccuuccucgccggccucaccaccuaccuccucgucucccagcuccgcgcccagggcgaggccugcguccaguuccaggcccucaagggccaggaguucgcccccucccaccagcaggucuacgccccccuccgcgccgacggcgacaagccccgcgcccaccucaccgucguccgccagacccccacccagcacuucaagaaccaguuccccgcccuccacugggagcacgagcucggccucgccuucaccaagaaccgcaugaacuacaccaacaaguuccuccucauccccgaguccggcgacuacuucaucuacucccaggucaccuuccgcggcaugaccuccgagugcuccgagauccgccaggccggccgccccaacaagcccgacuccaucaccgucgucaucaccaaggucaccgacuccuaccccgagcccacccagcuccucaugggcaccaaguccgucugcgaggucggcuccaacugguuccagcccaucuaccucggcgccauguucucccuccaggagggcgacaagcucauggucaacgucuccgacaucucccucgucgacuacaccaaggaggacaagaccuucuucggcgccuuccuccucuga

SEQ ID NO: 4821 - RNA, 756 nt, Artificial Sequence
  derived and/or modified sequence opt3 from TL1A__Homo_sapiens__AAH69435
auggccgaggaccugggccucagcuucggggaaaccgcuuccguggagaugcuucccgaacacggaucuugcagaccuaaggcaaggucaaguagcgcccggugggcgcugacauguugcuuggucuuacugccauuucuagcuggucucacuacguaccugcuuguuucccagcugcgcgcccaaggcgaggcaugugugcaguuccaggccuugaaagggcaggaauuugcuccgucucaucaacagguauaugcaccccuccgagccgauggagacaagccucgugcucaccugaccguggucagacagacaccaacucagcauuucaaaaaccaauuucccgcccugcacugggagcaugagcucggcuuagcguucaccaagaauaggaugaacuacacaaauaaauuucugcuuaucccugaaucgggugauuauuucauuuacucacaggugaccuuucgggggaugacuagcgagugcagugaaauacgccaggcaggaagaccaaacaagcccgacuccaucacaguugugauuaccaaggucacggauucuuauccugagccaacucaguugcugaugggcaccaaaagcgugugugagguaggcuccaauugguuccaaccgaucuaccuaggggccauguuuucacuccaggaaggagacaagcugaugguuaacgugagugauauuagccuugucgacuauacaaaagaggauaagacuuucuuuggugcuuuccuguuguga

SEQ ID NO: 4822 - RNA, 756 nt, Artificial Sequence
  derived and/or modified sequence opt4 from TL1A__Homo_sapiens__AAH69435
auggccgaggaccugggccugagcuucggcgagaccgccagcguggagaugcugcccgagcacggcagcugcagacccaaggccagaagcagcagcgccagaugggcccugaccugcugccuggugcugcugcccuuccuggccggccugaccaccuaccugcuggugagccagcugagagcccagggcgaggccugcgugcaguuccaggcccugaagggccaggaguucgcccccagccaccagcagguguacgccccccugagagccgacggcgacaagcccagagcccaccugaccguggugagacagacccccacccagcacuucaagaaccaguuccccgcccugcacugggagcacgagcugggccuggccuucaccaagaacagaaugaacuacaccaacaaguuccugcugauccccgagagcggcgacuacuucaucuacagccaggugaccuucagaggcaugaccagcgagugcagcgagaucagacaggccggcagacccaacaagcccgacagcaucaccguggugaucaccaaggugaccgacagcuaccccgagcccacccagcugcugaugggcaccaagagcgugugcgaggugggcagcaacugguuccagcccaucuaccugggcgccauguucagccugcaggagggcgacaagcugauggugaacgugagcgacaucagccugguggacuacaccaaggaggacaagaccuucuucggcgccuuccugcuguga

SEQ ID NO: 4823 - RNA, 756 nt, Artificial Sequence
  derived and/or modified sequence opt5 from TL1A__Homo_sapiens__AAH69435
auggccgaggaccugggccucagcuucggggaaaccgcuuccguggagaugcugcccgaacacggaucuugcagaccuaaggcccggagcuccucugcgcgcugggcucuuacauguugccugguccuccugccguuucuugccggccugacgaccuaccuccugguuagccagcugagagcccaaggggaggcuugugugcaguuccaggcccucaaaggacaggaauuugcucccucccaucaacagguguaugccccucugcgggcggauggcgacaagccccgcgcccaccuuacagucgugagacagaccccuacacagcauuucaaaaaccaauuucccgcucugcacugggagcaugagcucgggcuggccuucaccaagaaucggaugaacuacacaaauaaauuucuucugaucccugaaucuggagauuauuucauuuacagccagguuaccuuucgcggcaugacguccgagugcagcgaaaucagacaggcuggccggccgaacaagcccgacucuauuaccguggucaucacaaaggugaccgauuccuauccugagcccacacagcuccugauggggaccaaaagcguuugugaggugggaucuaauugguuccaaccuauuuaccugggcgccauguuuucccuccaggaaggggacaagcugauggucaacgugagcgauaucucucuuguggacuauacgaaagaggauaagacauucuuuggagcguuccugcucuga

SEQ ID NO: 4824 - RNA, 756 nt, Artificial Sequence
  derived and/or modified sequence opt6 from TL1A__Homo_sapiens__AAH69435
auggcagaagaccuaggacuaucauucggagaaacagcaucaguagaaaugcuacccgaacacgguucaugcagaccaaaagcaagaucaucauccgcaagaugggcacuaacaugcugccuaguacuacuuccauuccuagcaggauuaacaacauaccuauuagucagccaacuacgagcacaaggagaagcaugcguacaauuccaagcacuaaaaggacaagaauucgcucccucacaccaacaaguauacgcaccacuaagagcagacggagacaaaccaagagcacaucuaacaguagucagacaaacaccuacacaacacuucaaaaaucaauuccccgcucuacacugggaacacgaacuaggauuagcauucacaaaaaauagaaugaacuacacaaacaaauuccuauuaauaccagaaucaggcgacuacuuuauauacucacaaguaacuuucagaggaaugacaucagaaugcucagaaauaagacaagcaggaagaccaaacaaaccagacuccauaacaguaguaauaacaaaaguaacagacucauaccccgaaccuacucaauuacuaaugggaacaaaaucaguaugcgaaguaggcucaaacugguuccaaccaauauacuuaggagcuauguucaguuuacaagaaggagauaaauuaaugguaaacguuuccgacauaucacuaguagacuacacaaaagaagauaaaacauucuucggagcauucuuacuauaa

SEQ ID NO: 4825 - protein, 249 aa, Artificial Sequence
  TWEAK__Homo_sapiens__Q4ACW9
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 4826 - RNA, 750 nt, Artificial Sequence
  TWEAK__Homo_sapiens__AAI04421
auggccgcccgucggagccagaggcggagggggcgccggggggagccgggcaccgcccugcuggucccgcucgcgcugggccugggccuggcgcuggccugccucggccuccugcuggccguggucaguuuggggagccgggcaucgcuguccgcccaggagccugcccaggaggagcugguggcagaggaggaccaggacccgucggaacugaauccccagacagaagaaagccaggauccugcgccuuuccugaaccgacuaguucggccucgcagaagugcaccuaaaggccggaaaacacgggcucgaagagcgaucgcagcccauuaugaaguucauccacgaccuggacaggacggagcgcaggcagguguggacgggacagugaguggcugggaggaagccagaaucaacagcuccagcccucugcgcuacaaccgccagaucggggaguuuauagucacccgggcugggcucuacuaccuguacugucaggugcacuuugaugaggggaaggcugucuaccugaagcuggacuugcugguggauggugugcuggcccugcgcugccuggaggaauucucagccacugcggcgaguucccucgggccccagcuccgccucugccaggugucugggcuguuggcccugcggccaggguccucccugcggauccgcacccuccccugggcccaucucaaggcugcccccuuccucaccuacuucggacucuuccagguucacuga

SEQ ID NO: 4827 - RNA, 750 nt, Artificial Sequence
  derived and/or modified sequence opt1 from TWEAK__Homo_sapiens__AAI04421
auggccgcccgccggagccagcgccggcgcgggcggcgcggggagcccggcaccgcgcugcucgugccgcuggcccuggggcucggccuggcccuggccugccucgggcugcugcucgccgucgugucccugggcagccgggcgucccugagcgcccaggagcccgcccaggaggagcucguggccgaggaggaccaggaccccuccgagcugaacccccagaccgaggagagccaggacccggcgcccuuccugaaccgccucguccggccccgccgguccgcccccaagggccgcaagacgcgggcccgccgggccaucgccgcgcacuacgaggugcacccgcgccccgggcaggacggcgcccaggccgggguggacggcaccgucagcgggugggaggaggcccggaucaacuccagcagcccccugcgcuacaaccggcagaucggcgaguucaucgugacccgcgccggccuguacuaccucuacugccaggugcacuucgacgaggggaaggcggucuaccugaagcuggaccuccugguggacggcgugcuggcccuccggugccuggaggaguucuccgccaccgccgccuccagccuggggccccagcuccgccugugccaggucuccggccugcucgcgcugcgcccgggcagcucccugcggauccgcacgcuccccugggcccaccugaaggccgcccccuuccugaccuacuucggccucuuccaggugcacuga

SEQ ID NO: 4828 - RNA, 750 nt, Artificial Sequence
  derived and/or modified sequence opt2 from TWEAK__Homo_sapiens__AAI04421
auggccgcccgccgcucccagcgccgccgcggccgccgcggcgagcccggcaccgcccuccucgucccccucgcccucggccucggccucgcccucgccugccucggccuccuccucgccgucgucucccucggcucccgcgccucccucuccgcccaggagcccgcccaggaggagcucgucgccgaggaggaccaggaccccuccgagcucaacccccagaccgaggagucccaggaccccgcccccuuccucaaccgccucguccgcccccgccgcuccgcccccaagggccgcaagacccgcgcccgccgcgccaucgccgcccacuacgagguccacccccgccccggccaggacggcgcccaggccggcgucgacggcaccgucuccggcugggaggaggcccgcaucaacuccuccuccccccuccgcuacaaccgccagaucggcgaguucaucgucacccgcgccggccucuacuaccucuacugccagguccacuucgacgagggcaaggccgucuaccucaagcucgaccuccucgucgacggcguccucgcccuccgcugccucgaggaguucuccgccaccgccgccuccucccucggcccccagcuccgccucugccaggucuccggccuccucgcccuccgccccggcuccucccuccgcauccgcacccuccccugggcccaccucaaggccgcccccuuccucaccuacuucggccucuuccagguccacuga

SEQ ID NO: 4829 - RNA, 750 nt, Artificial Sequence
  derived and/or modified sequence opt3 from TWEAK__Homo_sapiens__AAI04421
auggccgcuagaaggagccagcggcgccgaggccguagaggggagcccggaaccgcacugcucgugccucuugcccuggguuugggcuuagcgcuggcuugccuagggcuccugcuugccgucguuucccugggaucuagggcaucauugagugcccaagaaccagcucaggaggaacucguggcagaggaagaccaggauccgagcgagcugaacccccagacagaggaaucccaagacccugccccauuccugaaucggcucguacgccccagaaggucugcuccuaagggccggaaaacucgcgccagacgagcgaucgcagcccacuacgaggugcauccaaggcccggucaggauggggcucaggccggagucgacggcacggugucgggcugggaagaggcacggauuaacucaagcaguccuuuacguuauaaucgccagauaggggaguuuaucguuaccagagcuggacuguacuaucuuuacugucaagugcacuucgaugaagguaaggccgucuauuugaaacuggaccuacucguggauggcguacuggcgcuuaggugccuggaggaauuuuccgccacagcagcuucuagcuuggggccacagcuccggcugugucagguuuccggauuacuggcccuccgaccgggcucaagucuucgcauuagaacucugcccugggcucauuugaaggccgcaccuuuccuaaccuacuuuggucuguuccaggugcacuga

SEQ ID NO: 4830 - RNA, 750 nt, Artificial Sequence
  derived and/or modified sequence opt4 from TWEAK__Homo_sapiens__AAI04421
auggccgccagaagaagccagagaagaagaggcagaagaggcgagcccggcaccgcccugcuggugccccuggcccugggccugggccuggcccuggccugccugggccugcugcuggccguggugagccugggcagcagagccagccugagcgcccaggagcccgcccaggaggagcugguggccgaggaggaccaggaccccagcgagcugaacccccagaccgaggagagccaggaccccgcccccuuccugaacagacuggugagacccagaagaagcgcccccaagggcagaaagaccagagccagaagagccaucgccgcccacuacgaggugcaccccagacccggccaggacggcgcccaggccggcguggacggcaccgugagcggcugggaggaggccagaaucaacagcagcagcccccugagauacaacagacagaucggcgaguucaucgugaccagagccggccuguacuaccuguacugccaggugcacuucgacgagggcaaggccguguaccugaagcuggaccugcugguggacggcgugcuggcccugagaugccuggaggaguucagcgccaccgccgccagcagccugggcccccagcugagacugugccaggugagcggccugcuggcccugagacccggcagcagccugagaaucagaacccugcccugggcccaccugaaggccgcccccuuccugaccuacuucggccuguuccaggugcacuga

SEQ ID NO: 4831 - RNA, 750 nt, Artificial Sequence
  derived and/or modified sequence opt5 from TWEAK__Homo_sapiens__AAI04421
auggccgcuagacggagccagcgcagacggggccgcagaggggagcccggaaccgcccugcucgugccucuggcgcuuggccuggggcucgcucuggccugccuuggacugcuccuggccgucguuucccugggcucucgggcuagccucuccgcccaagaaccggcucaggaggaacugguggccgaggaagaccaggaucccucugagcuuaacccucagacagaggaaagccaagaccccgcgccuuuccugaaucgccucgugagaccccggcgcuccgccccuaaggggagaaaaacgcgggcucgcagagccaucgcugcccacuacgagguccauccgcggcccggacaggauggcgcgcaggccggcguggacgggaccguuucuggaugggaagaggcucgcauuaacagcuccagcccucugagauauaaucggcagaucggcgaguuuauugugacaagagccgggcuuuacuaucuguacugucaaguccacuucgaugaaggaaaggcuguguaucucaaacuggaccugcucguugauggcgugcuggcccuucgcugccuggaggaauuuucugccaccgcugcguccagccucgggccccagcugcggcuuugucaggucucuggacugcucgcccugagaccuggcuccagccugcgcauccggacacuccccugggcucaucugaaggccgccccguuccuuaccuacuuuggccuguuccaggugcacuga

SEQ ID NO: 4832 - RNA, 750 nt, Artificial Sequence
  derived and/or modified sequence opt6 from TWEAK__Homo_sapiens__AAI04421
auggcagccagaagaucacaaagaagaagaggaagaagaggagaaccagguacagcacuuuuaguaccauuagcauuaggauuaggauuagcauuggcuugccuaggacuauuacuagcagucguaaguuuaggaucaagagcaagcuuaagugcacaagaaccagcucaagaagaauuaguagcagaagaagaccaagacccaagcgaacuaaauccacaaacagaagaaucgcaagauccagcgccauuuuuaaauagacuagucaggccacgaagaucugcaccuaaaggaagaaaaacaagagcaagaagagcaauagcagcacauuaugaaguacacccaagaccaggacaagauggcgcucaagcagguguagauggaacaguaaguggaugggaagaagcaagaauaaacucaaguucaccauugagauauaacagacaaauuggagaauucauaguaacaagagcuggauuauauuaucuauauugccaaguacauuucgaugaaggaaaagcugucuaucuaaaacuagaucuauuaguugauggcguauuagcuuuaaggugcuuagaagaauucucagcaacugcagcaucaucauuaggaccacaauuaagauuaugucaaguaagcggacuauuagcauuaagaccaggcucaagucuaagaauaagaacacuaccaugggcacauuuaaaagcagcaccauucuuaacauauuuugguuuauuucaaguacacuaa

SEQ ID NO: 4833 - protein, 97 aa, Artificial Sequence
  CCL11__Homo_sapiens__P51671
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 4834 - RNA, 294 nt, Artificial Sequence
  CCL11__Homo_sapiens__AAA98957
augaaggucuccgcagcacuucuguggcugcugcucauagcagcugccuucagcccccaggggcucgcugggccagcuucugucccaaccaccugcugcuuuaaccuggccaauaggaagauaccccuucagcgacuagagagcuacaggagaaucaccaguggcaaauguccccagaaagcugugaucuucaagaccaaacuggccaaggauaucugugccgaccccaagaagaagugggugcaggauuccaugaaguaucuggaccaaaaaucuccaacuccaaagccauaa

SEQ ID NO: 4835 - RNA, 294 nt, Artificial Sequence
  derived and/or modified sequence opt1 from CCL11__Homo_sapiens__AAA98957
augaaggugagcgccgcccugcucuggcugcugcucaucgcggccgccuucagcccccagggccuggccgggccggccagcguccccacgaccugcugcuucaaccuggcgaaccgcaagaucccccuccagcggcuggaguccuaccgccggaucaccagcggcaagugcccccagaaggccgugaucuucaagaccaagcuggccaaggacaucugcgccgacccgaagaagaagugggugcaggacuccaugaaguaccucgaccagaagucccccacccccaagcccuga

SEQ ID NO: 4836 - RNA, 294 nt, Artificial Sequence
  derived and/or modified sequence opt2 from CCL11__Homo_sapiens__AAA98957
augaaggucuccgccgcccuccucuggcuccuccucaucgccgccgccuucuccccccagggccucgccggccccgccuccguccccaccaccugcugcuucaaccucgccaaccgcaagaucccccuccagcgccucgaguccuaccgccgcaucaccuccggcaagugcccccagaaggccgucaucuucaagaccaagcucgccaaggacaucugcgccgaccccaagaagaaguggguccaggacuccaugaaguaccucgaccagaagucccccacccccaagcccuga

SEQ ID NO: 4837 - RNA, 294 nt, Artificial Sequence
  derived and/or modified sequence opt3 from CCL11__Homo_sapiens__AAA98957
augaaggugagcgccgcucugcucuggcuucuguugaucgcagccgcguucaguccccagggcuuagcugggccugccucugucccaaccacaugcuguuuuaaccuggcaaauagaaaaauuccgcuacaaaggcucgagucauaccggcgcauaacuuccggaaagugcccccagaaagccguuaucuucaagacgaaacuggcuaaggacauuugugcagauccuaagaaaaagugggugcaggacagcaugaaauaucuugaucagaaguccccaacccccaaaccuuga

SEQ ID NO: 4838 - RNA, 294 nt, Artificial Sequence
  derived and/or modified sequence opt4 from CCL11__Homo_sapiens__AAA98957
augaaggugagcgccgcccugcuguggcugcugcugaucgccgccgccuucagcccccagggccuggccggccccgccagcgugcccaccaccugcugcuucaaccuggccaacagaaagaucccccugcagagacuggagagcuacagaagaaucaccagcggcaagugcccccagaaggccgugaucuucaagaccaagcuggccaaggacaucugcgccgaccccaagaagaagugggugcaggacagcaugaaguaccuggaccagaagagccccacccccaagcccuga

SEQ ID NO: 4839 - RNA, 294 nt, Artificial Sequence
  derived and/or modified sequence opt5 from CCL11__Homo_sapiens__AAA98957
augaaggugagcgccgcucugcucuggcugcuucugaucgccgcggcuuucagcccccagggccucgccgggccugccucugucccgaccacaugcuguuuuaaccuggcuaauagaaaaauuccccuucaacggcuggagagcuaccgcagaaucacguccggaaagugcccucagaaagccguuauuuucaagaccaaacucgcuaaggacaucugugccgaucccaagaaaaagugggugcaggacucuaugaaauaucuggaucagaaguccccuacacccaaaccuuga

SEQ ID NO: 4840 - RNA, 294 nt, Artificial Sequence
  derived and/or modified sequence opt6 from CCL11__Homo_sapiens__AAA98957
augaaaguaucagcagcacuacuauggcuacuacuaauagcagcagcauucucaccacaaggacuagcaggaccagcaucaguaccaacaacaugcugcuucaaccuagcaaacagaaaaauaccacuacaaagacuagaaucauacagaagaauaacaucaggaaaaugcccacaaaaagcaguaauauucaaaacaaaacuagcaaaagacauaugcgcagacccaaaaaaaaaauggguacaagacucaaugaaauaccuagaccaaaaaucaccaacaccaaaaccauaa

SEQ ID NO: 4841 - protein, 97 aa, Artificial Sequence; identical to SEQ ID NO: 4833
  CCL11__Homo_sapiens__Q6I9T4

SEQ ID NO: 4842 - RNA, 294 nt, Artificial Sequence; identical to SEQ ID NO: 4834
  CCL11__Homo_sapiens__ABK41951

SEQ ID NO: 4843 - RNA, 294 nt, Artificial Sequence; identical to SEQ ID NO: 4835
  derived and/or modified sequence opt1 from CCL11__Homo_sapiens__ABK41951

SEQ ID NO: 4844 - RNA, 294 nt, Artificial Sequence; identical to SEQ ID NO: 4836
  derived and/or modified sequence opt2 from CCL11__Homo_sapiens__ABK41951

SEQ ID NO: 4845 - RNA, 294 nt, Artificial Sequence; identical to SEQ ID NO: 4837
  derived and/or modified sequence opt3 from CCL11__Homo_sapiens__ABK41951

SEQ ID NO: 4846 - RNA, 294 nt, Artificial Sequence; identical to SEQ ID NO: 4838
  derived and/or modified sequence opt4 from CCL11__Homo_sapiens__ABK41951

SEQ ID NO: 4847 - RNA, 294 nt, Artificial Sequence; identical to SEQ ID NO: 4839
  derived and/or modified sequence opt5 from CCL11__Homo_sapiens__ABK41951

SEQ ID NO: 4848 - RNA, 294 nt, Artificial Sequence
  derived and/or modified sequence opt6 from CCL11__Homo_sapiens__ABK41951
augaaaguaucagccgcacuacuauggcuacuacuaauagcagcagcauucucaccacaaggacuagcaggaccagcaucaguaccaacaacaugcugcuucaaccuagcaaacagaaaaauaccauuacaaagacuagaaucauacagaagaauaacaucaggaaaaugcccacaaaaagcaguaauauucaaaacaaaacucgcaaaagacauaugcgcagacccaaaaaaaaaauggguacaagacucaaugaaauaccuagaccaaaaaucaccaacaccaaaaccauaa

SEQ ID NO: 4849 - protein, 104 aa, Artificial Sequence
  CCL12__Mus_musculus__Q62401
MKISTLLCLLLIATTISPQVLAGPDAVSTPVTCCYNVVKQKIHVRKLKSYRRITSSQCPREAVIFRTILDKEICADPKEKWVKNSINHLDKTSQTFILEPSCLG

SEQ ID NO: 4850 - RNA, 315 nt, Artificial Sequence
  CCL12__Mus_musculus__AAB49424
augaagauuuccacacuucuaugccuccugcucauagcuaccaccaucaguccucagguauuggcuggaccagaugcggugagcaccccagucacgugcuguuauaauguuguuaagcagaagauucacguccggaagcugaagagcuacaggagaaucacaagcagccaguguccccgggaagcugugaucuucaggaccauacuggauaaggagaucugugcugaccccaaggagaaguggguuaagaauuccauaaaccacuuggauaagacgucucaaaccuucauccuugaaccuucaugucuaggcuga

SEQ ID NO: 4851 - RNA, 315 nt, Artificial Sequence
  derived and/or modified sequence opt1 from CCL12__Mus_musculus__AAB49424
augaagaucagcacccugcucugccugcugcucaucgccaccacgaucagcccccaggugcuggccggcccggacgcggucuccacccccgugaccugcugcuacaacguggucaagcagaagauccacgugcgcaagcugaaguccuaccggcgcaucaccagcucccagugcccccgggaggccgugaucuuccgcacgauccucgacaaggagaucugcgccgaccccaaggagaagugggucaagaacagcaucaaccaccuggacaagaccucccagaccuucauccuggagccgagcugccucggguga

SEQ ID NO: 4852 - RNA, 315 nt, Artificial Sequence
  derived and/or modified sequence opt2 from CCL12__Mus_musculus__AAB49424
augaagaucuccacccuccucugccuccuccucaucgccaccaccaucuccccccagguccucgccggccccgacgccgucuccacccccgucaccugcugcuacaacgucgucaagcagaagauccacguccgcaagcucaaguccuaccgccgcaucaccuccucccagugcccccgcgaggccgucaucuuccgcaccauccucgacaaggagaucugcgccgaccccaaggagaagugggucaagaacuccaucaaccaccucgacaagaccucccagaccuucauccucgagcccuccugccucggcuga

SEQ ID NO: 4853 - RNA, 315 nt, Artificial Sequence
  derived and/or modified sequence opt3 from CCL12__Mus_musculus__AAB49424
augaagaucagcacccugcucugccuucuguugauugccacaacuauaucuccccagguguuagcuggcccugacgcagucuccacgccaguuaccuguugcuacaacgugguaaaacaaaagauccacgugagaaaacugaagucauauaggcggauuacaaguagccaguguccgcgcgaggccgucaucuuccgaacuauucuagauaaagaaaucugcgcggaccccaaggagaagugggugaaaaauuccauaaaccaucucgauaagaccucucagacauuuauccuggaaccuucgugucuuggguga

SEQ ID NO: 4854 - RNA, 315 nt, Artificial Sequence
  derived and/or modified sequence opt4 from CCL12__Mus_musculus__AAB49424
augaagaucagcacccugcugugccugcugcugaucgccaccaccaucagcccccaggugcuggccggccccgacgccgugagcacccccgugaccugcugcuacaacguggugaagcagaagauccacgugagaaagcugaagagcuacagaagaaucaccagcagccagugccccagagaggccgugaucuucagaaccauccuggacaaggagaucugcgccgaccccaaggagaagugggugaagaacagcaucaaccaccuggacaagaccagccagaccuucauccuggagcccagcugccugggcuga

SEQ ID NO: 4855 - RNA, 315 nt, Artificial Sequence
  derived and/or modified sequence opt5 from CCL12__Mus_musculus__AAB49424
augaagaucagcacccugcucugccugcuucugauugccacaacgaucagcccccaggugcucgcuggcccugacgccgucucuaccccgguuacauguugcuacaacguggugaaacaaaagauucacgucagaaaacugaaguccuaucggcgcaucaccuccucucagugucccagagaggcggugauuuuccggacaauccuugauaaagaaaucugcgcugacccuaaggagaaguggguuaaaaauagcauuaaccaucuggauaagaccucccagacauuuauccucgaacccucuugucugggguga

SEQ ID NO: 4856 - RNA, 315 nt, Artificial Sequence
  derived and/or modified sequence opt6 from CCL12__Mus_musculus__AAB49424
augaaaauaagcacacuacuaugccuacuacuaauagcaacaacaauaucaccacaaguacuagcaggaccagacgcaguaucaacaccaguaacaugcugcuacaacguaguaaaacaaaaaauacacguaagaaaacuaaaaucauacagaagaauaacaucaucacaaugcccaagagaagcaguaauauucagaacaauacuagacaaagaaauaugcgcagacccaaaagaaaaauggguaaaaaacucaauaaaccaccuagacaaaacaucacaaacauucauacuagaaccaucaugccuaggauaa

SEQ ID NO: 4857 - protein, 98 aa, Artificial Sequence
  CCL13__Homo_sapiens__Q99616
MKVSAVLLCLLLMTAAFNPQGLAQPDALNVPSTCCFTFSSKKISLQRLKSYVITTSRCPQKAVIFRTKLGKEICADPKEKWVQNYMKHLGRKAHTLKT

SEQ ID NO: 4858 - RNA, 297 nt, Artificial Sequence
  CCL13__Homo_sapiens__AAB38703
augaaagucucugcagugcuucugugccugcugcucaugacagcagcuuucaacccccagggacuugcucagccagaugcacucaacgucccaucuacuugcugcuucacauuuagcaguaagaagaucuccuugcagaggcugaagagcuaugugaucaccaccagcagguguccccagaaggcugucaucuucagaaccaaacugggcaaggagaucugugcugacccaaaggagaaguggguccagaauuauaugaaacaccugggccggaaagcucacacccugaagacuuga

SEQ ID NO: 4859 - RNA, 297 nt, Artificial Sequence
  derived and/or modified sequence opt1 from CCL13__Homo_sapiens__AAB38703
augaaggugagcgccguccugcucugccugcugcucaugaccgccgcguucaacccccagggccuggcccagccggacgcccugaacgugcccuccacgugcugcuucaccuucagcuccaagaagaucagccuccagcgccugaaguccuacgugaucaccaccagccggugcccccagaaggccgucaucuuccgcaccaagcuggggaaggagaucugcgccgaccccaaggagaagugggugcagaacuacaugaagcaccucggccggaaggcgcacacgcugaagaccuga

SEQ ID NO: 4860 - RNA, 297 nt, Artificial Sequence
  derived and/or modified sequence opt2 from CCL13__Homo_sapiens__AAB38703
augaaggucuccgccguccuccucugccuccuccucaugaccgccgccuucaacccccagggccucgcccagcccgacgcccucaacguccccuccaccugcugcuucaccuucuccuccaagaagaucucccuccagcgccucaaguccuacgucaucaccaccucccgcugcccccagaaggccgucaucuuccgcaccaagcucggcaaggagaucugcgccgaccccaaggagaaguggguccagaacuacaugaagcaccucggccgcaaggcccacacccucaagaccuga

SEQ ID NO: 4861 - RNA, 297 nt, Artificial Sequence
  derived and/or modified sequence opt3 from CCL13__Homo_sapiens__AAB38703
augaaggugagcgccguccugcucugccuucuguugaugaccgcugcauucaacccccagggcuuagcccaaccugacgcgcugaauguuccauccacauguugcuuuacuuucucuaguaaaaagaucucacuacagagacucaaaagcuacgugauuacgaccuccagguguccgcagaaggcuguaauauuucggacaaaacuggggaaggagaucugcgccgaucccaaggaaaaaugggugcagaacuauaugaagcaccuuggacgcaaagcacauacucugaagaccuga

SEQ ID NO: 4862 - RNA, 297 nt, Artificial Sequence
  derived and/or modified sequence opt4 from CCL13__Homo_sapiens__AAB38703
augaaggugagcgccgugcugcugugccugcugcugaugaccgccgccuucaacccccagggccuggcccagcccgacgcccugaacgugcccagcaccugcugcuucaccuucagcagcaagaagaucagccugcagagacugaagagcuacgugaucaccaccagcagaugcccccagaaggccgugaucuucagaaccaagcugggcaaggagaucugcgccgaccccaaggagaagugggugcagaacuacaugaagcaccugggcagaaaggcccacacccugaagaccuga

SEQ ID NO: 4863 - RNA, 297 nt, Artificial Sequence
  derived and/or modified sequence opt5 from CCL13__Homo_sapiens__AAB38703
augaaggugagcgccguccugcucugccugcuucugaugaccgcugccuucaacccccagggccucgcgcaaccugacgcucugaauguuccguccacauguugcuuuacguucucuagcaaaaagaucucccuucagagacugaaaucuuacgugauuaccacaagccgguguccccagaaggccgugaucuuucgcaccaaacucgggaaggagauuugcgccgauccuaaggaaaaauggguccagaacuauaugaagcaccugggaagaaaagcucauacacugaagaccuga

SEQ ID NO: 4864 - RNA, 297 nt, Artificial Sequence
  derived and/or modified sequence opt6 from CCL13__Homo_sapiens__AAB38703
augaaaguaucagcaguacuacuaugccuacuacuaaugacagcagcauucaacccacaaggacuagcacaaccagacgcacuaaacguaccaucaacaugcugcuucacauucucaucaaaaaaaauaucacuacaaagacuaaaaucauacguaauaacaacaucaagaugcccacaaaaagcaguaauauucagaacaaaacuaggaaaagaaauaugcgcagacccaaaagaaaaauggguacaaaacuacaugaaacaccuaggaagaaaagcacacacacuaaaaacauaa

SEQ ID NO: 4865 - protein, 93 aa, Artificial Sequence
  CCL14__Homo_sapiens__Q16627
MKISVAAIPFFLLITIALGTKTESSSRGPYHPSECCFTYTTYKIPRQRIMDYYETNSQCSKPGIVFITKRGHSVCTNPSDKWVQDYIKDMKEN

SEQ ID NO: 4866 - RNA, 282 nt, Artificial Sequence
  CCL14__Homo_sapiens__AAC63329
augaagaucuccguggcugccauucccuucuuccuccucaucaccaucgcccuagggaccaagacugaauccuccucacggggaccuuaccaccccucagagugcugcuucaccuacacuaccuacaagaucccgcgucagcggauuauggauuacuaugagaccaacagccagugcuccaagcccggaauugucuucaucaccaaaaggggccauuccgucuguaccaaccccagugacaaguggguccaggacuauaucaaggacaugaaggagaacuga

SEQ ID NO: 4867 - RNA, 282 nt, Artificial Sequence
  derived and/or modified sequence opt1 from CCL14__Homo_sapiens__AAC63329
augaagaucagcguggccgccauccccuucuuccugcucaucaccaucgcgcugggcaccaagacggaguccagcucccgcgggccguaccaccccagcgagugcugcuucaccuacaccaccuacaagaucccccggcagcgcaucauggacuacuacgagacgaacucccagugcagcaagcccggcaucgucuucaucaccaagcgggggcacuccgugugcaccaacccgagcgacaagugggugcaggacuacaucaaggacaugaaggagaacuga

SEQ ID NO: 4868 - RNA, 282 nt, Artificial Sequence
  derived and/or modified sequence opt2 from CCL14__Homo_sapiens__AAC63329
augaagaucuccgucgccgccauccccuucuuccuccucaucaccaucgcccucggcaccaagaccgaguccuccucccgcggccccuaccaccccuccgagugcugcuucaccuacaccaccuacaagaucccccgccagcgcaucauggacuacuacgagaccaacucccagugcuccaagcccggcaucgucuucaucaccaagcgcggccacuccgucugcaccaaccccuccgacaaguggguccaggacuacaucaaggacaugaaggagaacuga

SEQ ID NO: 4869 - RNA, 282 nt, Artificial Sequence
  derived and/or modified sequence opt3 from CCL14__Homo_sapiens__AAC63329
augaagaucagcguggccgcuauucccuucuuucugcucauaaccaucgcacuuggcacaaaaacugaguccucuucaagagggccuuaccacccaagugaaugcuguuucacguauaccacauacaagauuccgaggcagcggaucauggacuauuacgagacuaacagccaaugcuccaaacccggaauugucuuuaucaccaagcgcggucauucuguuuguacaaauccuucggauaaaugggugcaggacuauauaaaggauaugaaggaaaacuga

SEQ ID NO: 4870 - RNA, 282 nt, Artificial Sequence
  derived and/or modified sequence opt4 from CCL14__Homo_sapiens__AAC63329
augaagaucagcguggccgccauccccuucuuccugcugaucaccaucgcccugggcaccaagaccgagagcagcagcagaggccccuaccaccccagcgagugcugcuucaccuacaccaccuacaagauccccagacagagaaucauggacuacuacgagaccaacagccagugcagcaagcccggcaucguguucaucaccaagagaggccacagcgugugcaccaaccccagcgacaagugggugcaggacuacaucaaggacaugaaggagaacuga

SEQ ID NO: 4871 - RNA, 282 nt, Artificial Sequence
  derived and/or modified sequence opt5 from CCL14__Homo_sapiens__AAC63329
augaagaucagcguggccgcuauucccuucuuucugcucaucaccauugcccugggcacaaaaacggaguccucuagcagagggccuuaccacccguccgaaugcuguuucaccuauacaaccuacaagaucccccggcagcgcauuauggacuauuacgagacaaacucucaaugcagcaaaccuggaaucgucuuuaucaccaagagaggccauuccguuuguacaaaucccucugauaaaugggugcaggacuauauuaaggauaugaaggaaaacuga

SEQ ID NO: 4872 - RNA, 282 nt, Artificial Sequence
  derived and/or modified sequence opt6 from CCL14__Homo_sapiens__AAC63329
augaaaauaucaguagcagcaauaccauucuuccuacuaauaacaauagcacuaggaacaaaaacagaaucaucaucaagaggaccauaccacccaucagaaugcugcuucacauacacaacauacaaaauaccaagacaaagaauaauggacuacuacgaaacaaacucacaaugcucaaaaccaggaauaguauucauaacaaaaagaggacacucaguaugcacaaacccaucagacaaauggguacaagacuacauaaaagacaugaaagaaaacuaa

SEQ ID NO: 4873 - protein, 113 aa, Artificial Sequence
  CCL15__Homo_sapiens__Q16663
MKVSVAALSCLMLVAVLGSQAQFINDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 4874 - RNA, 342 nt, Artificial Sequence
  CCL15__Homo_sapiens__AAB94617
augaaggucuccguggcugcccucuccugccucaugcuuguugcuguccuuggaucccaggcccaguucauaaaugaugcagagacagaguuaaugaugucaaagcuuccacuggaaaauccaguaguucugaacagcuuucacuuugcugcugacugcugcaccuccuacaucucacaaagcaucccguguucacucaugaaaaguuauuuugaaacgagcagcgagugcuccaagccaggugucauauuccucaccaagaaggggaggcaagucugugccaaacccagugguccgggaguucaggauugcaugaaaaagcugaagcccuacucaauauaa

SEQ ID NO: 4875 - RNA, 342 nt, Artificial Sequence
  derived and/or modified sequence opt1 from CCL15__Homo_sapiens__AAB94617
augaaggugagcgucgccgcccuguccugccucaugcugguggcggugcugggcagccaggcccaguucaucaacgacgccgagaccgagcucaugauguccaagcugccccuggagaacccggucgugcucaacagcuuccacuucgccgccgacugcugcaccuccuacaucagccaguccauccccugcagccugaugaaguccuacuucgagacgagcuccgagugcagcaagcccggggugaucuuccugaccaagaagggccgccaggucugcgcgaagcccuccgggccgggcgugcaggacugcaugaagaagcucaagcccuacagcaucuga

SEQ ID NO: 4876 - RNA, 342 nt, Artificial Sequence
  derived and/or modified sequence opt2 from CCL15__Homo_sapiens__AAB94617
augaaggucuccgucgccgcccucuccugccucaugcucgucgccguccucggcucccaggcccaguucaucaacgacgccgagaccgagcucaugauguccaagcucccccucgagaaccccgucguccucaacuccuuccacuucgccgccgacugcugcaccuccuacaucucccaguccauccccugcucccucaugaaguccuacuucgagaccuccuccgagugcuccaagcccggcgucaucuuccucaccaagaagggccgccaggucugcgccaagcccuccggccccggcguccaggacugcaugaagaagcucaagcccuacuccaucuga

SEQ ID NO: 4877 - RNA, 342 nt, Artificial Sequence
  derived and/or modified sequence opt3 from CCL15__Homo_sapiens__AAB94617
augaaggugagcgucgccgcucuguccugccucaugcuuguugcagugcugggcucucaggcccaauucaucaacgacgcggagaccgaauugaugaugucaaaauuaccccuggagaauccuguagugcuaaacaguuuucacuucgcugccgauuguugcacaagcuacauuucccagucuauaccauguucgcucaugaagucauauuuugaaacuagcagugagugcuccaaaccgggggucaucuuccugacgaagaaaggaagacaggugugugcaaagcccucugguccuggcguucaggacugcaugaagaaacuuaagccauacagcauuuga

SEQ ID NO: 4878 - RNA, 342 nt, Artificial Sequence
  derived and/or modified sequence opt4 from CCL15__Homo_sapiens__AAB94617
augaaggugagcguggccgcccugagcugccugaugcugguggccgugcugggcagccaggcccaguucaucaacgacgccgagaccgagcugaugaugagcaagcugccccuggagaaccccguggugcugaacagcuuccacuucgccgccgacugcugcaccagcuacaucagccagagcauccccugcagccugaugaagagcuacuucgagaccagcagcgagugcagcaagcccggcgugaucuuccugaccaagaagggcagacaggugugcgccaagcccagcggccccggcgugcaggacugcaugaagaagcugaagcccuacagcaucuga

SEQ ID NO: 4879 - RNA, 342 nt, Artificial Sequence
  derived and/or modified sequence opt5 from CCL15__Homo_sapiens__AAB94617
augaaggugagcgucgccgcucuguccugccucaugcugguugccgugcuuggcucucaggcgcaauucaucaacgacgcugagaccgaacugaugaugagcaaacucccccuggagaauccugugguccuuaacuccuuucacuucgccgccgauuguugcacaucuuacauuagccaguccaucccguguucucugaugaaaagcuauuuugaaacguccagcgagugcucuaagcccggggugauuuuccucaccaagaaaggaagacagguuugugcuaagccuuccggccccggggugcaggacugcaugaagaaacugaagccuuacagcaucuga

SEQ ID NO: 4880 - RNA, 342 nt, Artificial Sequence
  derived and/or modified sequence opt6 from CCL15__Homo_sapiens__AAB94617
augaaaguaucaguagcagcacuaucaugccuaauguuaguagcaguacuaggaucacaagcacaauucauaaacgacgcagaaacagaacuaaugaugagcaaacuaccacuagaaaacccaguaguacuaaacucauuccacuucgcagcagacugcugcacaucauacauaucacaaucaauaccaugcucacuaaugaaaucauacuucgaaacaucaucagaaugcucaaaaccaggaguaauauuccuaacaaaaaaaggaagacaaguaugcgcaaaaccaucaggaccaggaguacaagacugcaugaaaaaacuaaaaccauacucaauauaa

SEQ ID NO: 4881 - protein, 120 aa, Artificial Sequence
  CCL16__Homo_sapiens__O15467
MKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 4882 - RNA, 363 nt, Artificial Sequence
  CCL16__Homo_sapiens__AAC05587
augaaggucuccgaggcugcccugucucuccuuguccucauccuuaucauuacuucggcuucucgcagccagccaaaaguuccugagugggugaacaccccauccaccugcugccugaaguauuaugagaaaguguugccaaggagacuaguggugggauacagaaaggcccucaacugucaccugccagcaaucaucuucgucaccaagaggaaccgagaagucugcaccaaccccaaugacgacuggguccaagaguacaucaaggaucccaaccuaccuuugcugccuaccaggaacuuguccacgguuaaaauuauuacagcaaagaauggucaaccccagcuccucaacucccaguga

SEQ ID NO: 4883 - RNA, 363 nt, Artificial Sequence
  derived and/or modified sequence opt1 from CCL16__Homo_sapiens__AAC05587
augaaggugagcgaggccgcccugucccuccugguccugauccucaucaucaccagcgcgucccgcagccagcccaaggugccggagugggugaacacccccuccacgugcugccugaaguacuacgagaagguccugccccggcgccucguggugggcuaccggaaggcccugaacugccaccuccccgccaucaucuucgucaccaagcgcaaccgggaggugugcaccaacccgaacgacgacugggugcaggaguacaucaaggaccccaaccugccccugcugcccacccgcaaccucagcacggucaagaucaucaccgccaagaacgggcagccgcagcugcugaacucccaguga

SEQ ID NO: 4884 - RNA, 363 nt, Artificial Sequence
  derived and/or modified sequence opt2 from CCL16__Homo_sapiens__AAC05587
augaaggucuccgaggccgcccucucccuccucguccucauccucaucaucaccuccgccucccgcucccagcccaagguccccgagugggucaacacccccuccaccugcugccucaaguacuacgagaagguccucccccgccgccucgucgucggcuaccgcaaggcccucaacugccaccuccccgccaucaucuucgucaccaagcgcaaccgcgaggucugcaccaaccccaacgacgacuggguccaggaguacaucaaggaccccaaccucccccuccuccccacccgcaaccucuccaccgucaagaucaucaccgccaagaacggccagccccagcuccucaacucccaguga

SEQ ID NO: 4885 - RNA, 363 nt, Artificial Sequence
  derived and/or modified sequence opt3 from CCL16__Homo_sapiens__AAC05587
augaaggugagcgaggccgcucugucccuccuuguccugaucuugauuauaaccucugcaucaagaagucagcccaaaguuccugaaugggugaacacaccaagcacuugcuguuuaaaguacuaugagaaaguacugccgaggcggcuaguggucggcuaccgcaaggcccucaauugccaccuucccgcgaucauuuucgugacgaaacgaaaccgugaaguuuguaccaauccuaacgacgauugggugcaagaguauaucaaggacccaaaucugccccuguugccuacaagaaaccucuccacugucaagauuaucaccgcuaaaaaugggcagccacagcugcugaacucucaguga

SEQ ID NO: 4886 - RNA, 363 nt, Artificial Sequence
  derived and/or modified sequence opt4 from CCL16__Homo_sapiens__AAC05587
augaaggugagcgaggccgcccugagccugcuggugcugauccugaucaucaccagcgccagcagaagccagcccaaggugcccgagugggugaacacccccagcaccugcugccugaaguacuacgagaaggugcugcccagaagacugguggugggcuacagaaaggcccugaacugccaccugcccgccaucaucuucgugaccaagagaaacagagaggugugcaccaaccccaacgacgacugggugcaggaguacaucaaggaccccaaccugccccugcugcccaccagaaaccugagcaccgugaagaucaucaccgccaagaacggccagccccagcugcugaacagccaguga

SEQ ID NO: 4887 - RNA, 363 nt, Artificial Sequence
  derived and/or modified sequence opt5 from CCL16__Homo_sapiens__AAC05587
augaaggugagcgaggccgcucugucccuccugguccuuauccugauuaucaccucugccagcagaucccagcccaaaguuccugaaugggugaacacaccgucuacgugcugucucaaguacuaugagaaagugcugccccggcgccuugucgugggcuacagaaaggcgcugaauugccaccucccugcuauuaucuucguuaccaaacggaaccgcgaaguguguacaaaucccaacgacgauuggguccaagaguauauuaaggacccuaaucugccccugcucccuaccagaaaccugagcacagugaagaucaucaccgccaaaaaugggcagccgcagcuucugaacucccaguga

SEQ ID NO: 4888 - RNA, 363 nt, Artificial Sequence
  derived and/or modified sequence opt6 from CCL16__Homo_sapiens__AAC05587
augaaaguaucagaagcagcacuaucacuacuaguacuaauacuaauaauaacaucagcaucaagaucacaaccaaaagucccagaauggguaaacacaccaucaacaugcugccuaaaauacuacgaaaaaguacuaccaagaagacuaguaguaggauacagaaaagcacuaaacugccaccuaccagcaauaauauucguaacaaaaagaaacagagaaguaugcacaaacccaaacgacgacuggguacaagaauacauaaaagacccaaaccuaccacuacuaccaacaagaaaccuaucaacagucaaaauaauaacagcaaaaaacggacaaccacaacuacuaaacucacaauaa

SEQ ID NO: 4889 - protein, 94 aa, Artificial Sequence
  CCL17__Homo_sapiens__Q92583
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 4890 - RNA, 285 nt, Artificial Sequence
  CCL17__Homo_sapiens__AAH69107
auggccccacugaagaugcuggcccuggucacccuccuccugggggcuucucugcagcacauccacgcagcucgagggaccaaugugggccgggagugcugccuggaguacuucaagggagccauuccccuuagaaagcugaagacgugguaccagacaucugaggacugcuccagggaugccaucguuuuuguaacugugcagggcagggccaucuguucggaccccaacaacaagagagugaagaaugcaguuaaauaccugcaaagccuugagaggucuuga

SEQ ID NO: 4891 - RNA, 285 nt, Artificial Sequence
  derived and/or modified sequence opt1 from CCL17__Homo_sapiens__AAH69107
auggcgccccugaagaugcucgcccuggugacccugcuccugggcgccagccugcagcacauccacgccgcccgcgggaccaacgucggccgggagugcugccucgaguacuucaagggggccaucccgcugcgcaagcugaagacgugguaccagaccuccgaggacugcagccgggacgccaucguguucgugaccguccagggccgcgcgaucugcuccgaccccaacaacaagcgggugaagaacgccgugaaguaccuccagagccuggagcgcuccuga

SEQ ID NO: 4892 - RNA, 285 nt, Artificial Sequence
  derived and/or modified sequence opt2 from CCL17__Homo_sapiens__AAH69107
auggccccccucaagaugcucgcccucgucacccuccuccucggcgccucccuccagcacauccacgccgcccgcggcaccaacgucggccgcgagugcugccucgaguacuucaagggcgccaucccccuccgcaagcucaagaccugguaccagaccuccgaggacugcucccgcgacgccaucgucuucgucaccguccagggccgcgccaucugcuccgaccccaacaacaagcgcgucaagaacgccgucaaguaccuccagucccucgagcgcuccuga

SEQ ID NO: 4893 - RNA, 285 nt, Artificial Sequence
  derived and/or modified sequence opt3 from CCL17__Homo_sapiens__AAH69107
auggcuccccugaagaugcucgcccuugugacccuguuguuaggcgcaagccugcagcacauccaugccgcgagagggacaaacgucggaagggagugcugucuagaauacuucaaaggugcuauuccucuccggaagcugaaaacuugguaucaaacguccgaggacugcucucgcgaugccauaguuuuugugaccguacagggccgagcaaucuguucagacccaaauaacaagcgugugaaaaaugccgucaaguaccuucagagucuggaaagaagcuga

SEQ ID NO: 4894 - RNA, 285 nt, Artificial Sequence
  derived and/or modified sequence opt4 from CCL17__Homo_sapiens__AAH69107
auggccccccugaagaugcuggcccuggugacccugcugcugggcgccagccugcagcacauccacgccgccagaggcaccaacgugggcagagagugcugccuggaguacuucaagggcgccaucccccugagaaagcugaagaccugguaccagaccagcgaggacugcagcagagacgccaucguguucgugaccgugcagggcagagccaucugcagcgaccccaacaacaagagagugaagaacgccgugaaguaccugcagagccuggagagaagcuga

SEQ ID NO: 4895 - RNA, 285 nt, Artificial Sequence
  derived and/or modified sequence opt5 from CCL17__Homo_sapiens__AAH69107
auggcuccccugaagaugcucgcccuggugacccuucugcucggcgccagccugcagcacauccaugcggcuagagggacaaacgucggacgggagugcugucuugaauacuucaaaggcgccauuccucugcgcaagcucaaaacgugguaucaaaccuccgaggacugcucuagagaugccaucguuuuugugacagugcaggggcgggcuauuuguagcgacccgaauaacaagcgcgucaaaaaugccgugaaguaccugcagucccuggaaagaucuuga

SEQ ID NO: 4896 - RNA, 285 nt, Artificial Sequence
  derived and/or modified sequence opt6 from CCL17__Homo_sapiens__AAH69107
auggcaccacuaaaaaugcuagcacuaguaacacuauuauuaggagcaucacuacaacacauacacgcagcaagaggaacaaacguaggaagagaaugcugccuagaauacuucaaaggagcaauaccacuaagaaaacuaaaaacaugguaccaaacaucagaagacugcucaagagacgcaauaguauucguaacaguacaaggaagagcaauaugcucagacccaaacaacaaaagaguaaaaaacgcaguaaaauaccuacaaucacuagaaagaucauaa

SEQ ID NO: 4897 - protein, 89 aa, Artificial Sequence
  CCL18__Homo_sapiens__P55774
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 4898 - RNA, 270 nt, Artificial Sequence
  CCL18__Homo_sapiens__AAC32287
augaagggccuugcagcugcccuccuuguccucgucugcaccauggcccucugcuccugugcacaaguugguaccaacaaagagcucugcugccucgucuauaccuccuggcagauuccacaaaaguucauaguugacuauucugaaaccagcccccagugccccaagccaggugucauccuccuaaccaagagaggccggcagaucugugcugaccccaauaagaaguggguccagaaauacaucagcgaccugaagcugaaugccuga

SEQ ID NO: 4899 - RNA, 270 nt, Artificial Sequence
  derived and/or modified sequence opt1 from CCL18__Homo_sapiens__AAC32287
augaagggccuggccgccgcgcuccuggugcuggucugcaccauggcccucugcagcugcgcccagguggggaccaacaaggagcugugcugccugguguacacguccuggcagaucccccagaaguucaucgucgacuacagcgagaccuccccgcagugccccaagcccggcgugauccuccugaccaagcgcgggcggcagaucugcgccgaccccaacaagaagugggugcagaaguacaucagcgaccugaagcucaacgccuga

SEQ ID NO: 4900 - RNA, 270 nt, Artificial Sequence
  derived and/or modified sequence opt2 from CCL18__Homo_sapiens__AAC32287
augaagggccucgccgccgcccuccucguccucgucugcaccauggcccucugcuccugcgcccaggucggcaccaacaaggagcucugcugccucgucuacaccuccuggcagaucccccagaaguucaucgucgacuacuccgagaccuccccccagugccccaagcccggcgucauccuccucaccaagcgcggccgccagaucugcgccgaccccaacaagaaguggguccagaaguacaucuccgaccucaagcucaacgccuga

SEQ ID NO: 4901 - RNA, 270 nt, Artificial Sequence
  derived and/or modified sequence opt3 from CCL18__Homo_sapiens__AAC32287
augaagggccuggccgcugcacuccuugugcuggucugcaccauggccuuguguagcugcgcgcagguugggacaaacaaagaguuauguugccugguguacacuuccuggcaaaucccccagaaguucauuguagacuauucugaaacgucaccucaguguccaaaaccgggagugauacuacucaccaagagagguaggcagaucugcgcugaucccaauaaaaaguggguccaaaaguacauuagugaccugaaacuuaacgccuga

SEQ ID NO: 4902 - RNA, 270 nt, Artificial Sequence
  derived and/or modified sequence opt4 from CCL18__Homo_sapiens__AAC32287
augaagggccuggccgccgcccugcuggugcuggugugcaccauggcccugugcagcugcgcccaggugggcaccaacaaggagcugugcugccugguguacaccagcuggcagaucccccagaaguucaucguggacuacagcgagaccagcccccagugccccaagcccggcgugauccugcugaccaagagaggcagacagaucugcgccgaccccaacaagaagugggugcagaaguacaucagcgaccugaagcugaacgccuga

SEQ ID NO: 4903 - RNA, 270 nt, Artificial Sequence
  derived and/or modified sequence opt5 from CCL18__Homo_sapiens__AAC32287
augaagggccuggccgcugcccuccuggugcuugucugcaccauggcgcuguguagcugcgcucagguugggacaaacaaagagcucuguugccugguguacacguccuggcaaaucccccagaaguucauuguggacuauucugaaaccagcccucaguguccgaaacccggagucauccuucugacaaagagaggccggcagauuugcgccgauccuaauaaaaagugggugcaaaaguacaucuccgaccucaaacugaacgccuga

SEQ ID NO: 4904 - RNA, 270 nt, Artificial Sequence
  derived and/or modified sequence opt6 from CCL18__Homo_sapiens__AAC32287
augaaaggacuagcagcagcacuacuaguacuaguaugcacaauggcacuaugcucaugcgcacaaguaggaacaaacaaagaacuaugcugccuaguauacacaucauggcaaauaccacaaaaauucauaguagacuacucagaaacaucaccacaaugcccaaaaccaggaguaauacuacuaacaaaaagaggaagacaaauaugcgcagacccaaacaaaaaauggguacaaaaauacauaucagaccuaaaacuaaacgcauaa

SEQ ID NO: 4905 - protein, 98 aa, Artificial Sequence
  CCL19__Homo_sapiens__Q6IBD6
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 4906 - RNA, 297 nt, Artificial Sequence
  CCL19__Homo_sapiens__ABK41949
auggcccugcuacuggcccucagccugcugguucucuggacuuccccagccccaacucugaguggcaccaaugaugcugaagacugcugccugucugugacccagaaacccaucccuggguacaucgugaggaacuuccacuaccuucucaucaaggauggcugcagggugccugcuguaguguucaccacacugaggggccgccagcucugugcacccccagaccagcccuggguagaacgcaucauccagagacugcagaggaccucagccaagaugaagcgccgcagcaguuaa

SEQ ID NO: 4907 - RNA, 297 nt, Artificial Sequence
  derived and/or modified sequence opt1 from CCL19__Homo_sapiens__ABK41949
auggcccugcuccuggcccugagccuccuggugcuguggaccucccccgcgccgacccucagcggcacgaacgacgccgaggacugcugccuguccgucacccagaagcccauccccggguacaucgugcgcaacuuccacuaccugcucaucaaggacggcugccgggugcccgccgucguguucaccacccugcgcgggcggcagcugugcgccccgcccgaccagcccuggguggagcgcaucauccagcggcuccagcgcacgagcgccaagaugaagcggcgcuccagcuga

SEQ ID NO: 4908 - RNA, 297 nt, Artificial Sequence
  derived and/or modified sequence opt2 from CCL19__Homo_sapiens__ABK41949
auggcccuccuccucgcccucucccuccucguccucuggaccucccccgcccccacccucuccggcaccaacgacgccgaggacugcugccucuccgucacccagaagcccauccccggcuacaucguccgcaacuuccacuaccuccucaucaaggacggcugccgcguccccgccgucgucuucaccacccuccgcggccgccagcucugcgccccccccgaccagcccugggucgagcgcaucauccagcgccuccagcgcaccuccgccaagaugaagcgccgcuccuccuga

SEQ ID NO: 4909 - RNA, 297 nt, Artificial Sequence
  derived and/or modified sequence opt3 from CCL19__Homo_sapiens__ABK41949
auggcccugcuccuugcucugagcuuguuagugcuguggacuucccccgcaccuacacuaucuggcacuaacgacgccgaggauugcugucucucagucacgcagaagccaaucccgggguacauuguuagaaauuuccacuaucugcuuauaaaagacggaugcagggugcccgcgguaguguuuaccacacugcggggucgccaauugugugcuccuccagaucagcccugggucgaacgaaucauucagcgucuccagagaaccagugccaagaugaaaaggcggagcuccuga

SEQ ID NO: 4910 - RNA, 297 nt, Artificial Sequence
  derived and/or modified sequence opt4 from CCL19__Homo_sapiens__ABK41949
auggcccugcugcuggcccugagccugcuggugcuguggaccagccccgcccccacccugagcggcaccaacgacgccgaggacugcugccugagcgugacccagaagcccauccccggcuacaucgugagaaacuuccacuaccugcugaucaaggacggcugcagagugcccgccgugguguucaccacccugagaggcagacagcugugcgccccccccgaccagcccuggguggagagaaucauccagagacugcagagaaccagcgccaagaugaagagaagaagcagcuga

SEQ ID NO: 4911 - RNA, 297 nt, Artificial Sequence
  derived and/or modified sequence opt5 from CCL19__Homo_sapiens__ABK41949
auggcccugcuccuggcccuuagccugcucgugcuguggaccucccccgccccuacacuuucuggcacgaacgacgcggaggauugcugucugagcgucacccagaagccgauccccggguacauuguuagaaauuuccacuaucuccugaucaaagacggaugccgggugccugcuguggucuuuacaacccugcgcggcagacaacucugugcucccccugaucagcccuggguggaacggauuauccagcgccugcagagaacauccgccaagaugaaacggcgcucuagcuga

SEQ ID NO: 4912 - RNA, 297 nt, Artificial Sequence
  derived and/or modified sequence opt6 from CCL19__Homo_sapiens__ABK41949
auggcauuacuauuagcauuaagcuuacuaguacuauggacaucaccagcaccaacacuaucaggaacaaacgaugcagaagacuguugcuuaagcguaacacaaaaaccaauaccaggauauauaguaagaaauuuccauuacuuacuaauaaaagauggauguagaguaccagcaguaguauucacaacauuaagaggaagacaacuaugugcaccaccagaucaaccauggguagaaagaauaauacaaagauuacaaagaacaagcgcaaaaaugaaaagaagaucaagcuaa

SEQ ID NO: 4913 - protein, 98 aa, Artificial Sequence; identical to SEQ ID NO: 4905
  CCL19__Homo_sapiens__Q99731

SEQ ID NO: 4914 - RNA, 297 nt, Artificial Sequence; identical to SEQ ID NO: 4906
  CCL19__Homo_sapiens__AAC50944

SEQ ID NO: 4915 - RNA, 297 nt, Artificial Sequence; identical to SEQ ID NO: 4907
  derived and/or modified sequence opt1 from CCL19__Homo_sapiens__AAC50944

SEQ ID NO: 4916 - RNA, 297 nt, Artificial Sequence; identical to SEQ ID NO: 4908
  derived and/or modified sequence opt2 from CCL19__Homo_sapiens__AAC50944

SEQ ID NO: 4917 - RNA, 297 nt, Artificial Sequence; identical to SEQ ID NO: 4909
  derived and/or modified sequence opt3 from CCL19__Homo_sapiens__AAC50944

SEQ ID NO: 4918 - RNA, 297 nt, Artificial Sequence; identical to SEQ ID NO: 4910
  derived and/or modified sequence opt4 from CCL19__Homo_sapiens__AAC50944

SEQ ID NO: 4919 - RNA, 297 nt, Artificial Sequence; identical to SEQ ID NO: 4911
  derived and/or modified sequence opt5 from CCL19__Homo_sapiens__AAC50944

SEQ ID NO: 4920 - RNA, 297 nt, Artificial Sequence
  derived and/or modified sequence opt6 from CCL19__Homo_sapiens__AAC50944
auggcauuacuauuagcauuaucauuacuaguacuauggacaucaccagcaccaacacuaucaggaacaaacgaugcagaagacuguugcuuaagcguaacacaaaaaccaauaccaggauauauaguaagaaauuuccauuacuuacuaauaaaagauggauguagaguaccagcaguaguauucacaacauuaagaggaagacaacuaugugcaccaccagaucaaccauggguagaaagaauaauacaaagacuacaaagaacaagcgcaaaaaugaaaagaagaucaagcuaa

SEQ ID NO: 4921 - protein, 96 aa, Artificial Sequence
  CCL1__Homo_sapiens__P22362
MQIITTALVCLLLAGMWPEDVDSKSMQVPFSRCCFSFAEQEIPLRAILCYRNTSSICSNEGLIFKLKRGKEACALDTVGWVQRHRKMLRHCPSKRK

SEQ ID NO: 4922 - RNA, 291 nt, Artificial Sequence
  CCL1__Homo_sapiens__AAA52705
augcagaucaucaccacagcccuggugugcuugcugcuagcugggauguggccggaagauguggacagcaagagcaugcagguacccuucuccagauguugcuucucauuugcggagcaagagauuccccugagggcaauccuguguuacagaaauaccagcuccaucugcuccaaugagggcuuaauauucaagcugaagagaggcaaagaggccugcgccuuggacacaguuggauggguucagaggcacagaaaaaugcugaggcacugcccgucaaaaagaaaauga

SEQ ID NO: 4923 - RNA, 291 nt, Artificial Sequence
  derived and/or modified sequence opt1 from CCL1__Homo_sapiens__AAA52705
augcagaucaucaccaccgcccuggugugccuccugcuggccggcauguggcccgaggacgucgacagcaaguccaugcaggucccguucagccgcugcugcuucuccuucgcggagcaggagaucccccuccgggccauccugugcuaccgcaacacgagcuccaucugcagcaacgaggggcugaucuucaagcucaagcggggcaaggaggccugcgcccuggacaccguggggugggugcagcgccaccggaagaugcugcgccacugccccuccaagcggaaguga

SEQ ID NO: 4924 - RNA, 291 nt, Artificial Sequence
  derived and/or modified sequence opt2 from CCL1__Homo_sapiens__AAA52705
augcagaucaucaccaccgcccucgucugccuccuccucgccggcauguggcccgaggacgucgacuccaaguccaugcagguccccuucucccgcugcugcuucuccuucgccgagcaggagaucccccuccgcgccauccucugcuaccgcaacaccuccuccaucugcuccaacgagggccucaucuucaagcucaagcgcggcaaggaggccugcgcccucgacaccgucggcuggguccagcgccaccgcaagaugcuccgccacugccccuccaagcgcaaguga

SEQ ID NO: 4925 - RNA, 291 nt, Artificial Sequence
  derived and/or modified sequence opt3 from CCL1__Homo_sapiens__AAA52705
augcagaucauuaccacagcccuggugugccuccuucuggcuggcauguggcccgaggacgucgauagcaaguccaugcaaguuccuuucucuagauguugcuuuucauucgcagaacaggagauaccauugagggccaucuuauguuaccggaacacgaguagcauuugcuccaaugaagggcugaucuuuaaacuaaagcgcggaaaagaggcgugugcucucgacacuguggguuggguacagcgacaccguaagaugcugagacauugcccgucuaaaaggaaguga

SEQ ID NO: 4926 - RNA, 291 nt, Artificial Sequence
  derived and/or modified sequence opt4 from CCL1__Homo_sapiens__AAA52705
augcagaucaucaccaccgcccuggugugccugcugcuggccggcauguggcccgaggacguggacagcaagagcaugcaggugcccuucagcagaugcugcuucagcuucgccgagcaggagaucccccugagagccauccugugcuacagaaacaccagcagcaucugcagcaacgagggccugaucuucaagcugaagagaggcaaggaggccugcgcccuggacaccgugggcugggugcagagacacagaaagaugcugagacacugccccagcaagagaaaguga

SEQ ID NO: 4927 - RNA, 291 nt, Artificial Sequence
  derived and/or modified sequence opt5 from CCL1__Homo_sapiens__AAA52705
augcagaucauuaccacagcccuggugugccuccugcuugcuggcauguggcccgaggacgucgauagcaaguccaugcaaguuccuuucucuagauguugcuuuagcuucgccgaacaggagaucccgcugcgggcgauucucuguuaccgcaacacguccucuaucugcagcaaugaagggcugauuuuuaaacuuaagagaggaaaagaggcuugugcccuggacaccgugggcugggugcagcggcaccgcaagaugcucagacauugccccuccaaacggaaguga

SEQ ID NO: 4928 - RNA, 291 nt, Artificial Sequence
  derived and/or modified sequence opt6 from CCL1__Homo_sapiens__AAA52705
augcaaauaauaacaacagcauuaguaugucuauuacuagcaggaauguggccagaagauguagauagcaaaagcaugcaaguaccauuuagcagaugcuguuucucauucgcagaacaagaaauaccauuaagagcaauauuaugcuauagaaauacaucaagcauaugcucaaacgaaggauuaauauuuaaauuaaaaagaggaaaagaagcaugcgcacuagauacaguaggauggguacaaagacauagaaaaauguuaagacauugcccaagcaaaagaaaauaa

SEQ ID NO: 4929 - protein, 96 aa, Artificial Sequence
  CCL20__Homo_sapiens__P78556
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 4930 - RNA, 291 nt, Artificial Sequence
  CCL20__Homo_sapiens__AAC50943
augugcuguaccaagaguuugcuccuggcugcuuugaugucagugcugcuacuccaccucugcggcgaaucagaagcagcaagcaacuuugacugcugucuuggauacacagaccguauucuucauccuaaauuuauugugggcuucacacggcagcuggccaaugaaggcugugacaucaaugcuaucaucuuucacacaaagaaaaaguugucugugugcgcaaauccaaaacagacuugggugaaauauauugugcgucuccucaguaaaaaagucaagaacauguaa

SEQ ID NO: 4931 - RNA, 291 nt, Artificial Sequence
  derived and/or modified sequence opt1 from CCL20__Homo_sapiens__AAC50943
augugcugcaccaagagccugcuccuggccgcccugauguccgugcuccugcugcaccucugcggcgagagcgaggcggccuccaacuucgacugcugccugggguacaccgaccgcauccugcaccccaaguucaucgucggcuucacgcggcagcucgccaacgaggggugcgacaucaacgccaucaucuuccacaccaagaagaagcugagcgugugcgccaacccgaagcagaccugggugaaguacaucguccgccugcucuccaagaaggugaagaacauguga

SEQ ID NO: 4932 - RNA, 291 nt, Artificial Sequence
  derived and/or modified sequence opt2 from CCL20__Homo_sapiens__AAC50943
augugcugcaccaagucccuccuccucgccgcccucauguccguccuccuccuccaccucugcggcgaguccgaggccgccuccaacuucgacugcugccucggcuacaccgaccgcauccuccaccccaaguucaucgucggcuucacccgccagcucgccaacgagggcugcgacaucaacgccaucaucuuccacaccaagaagaagcucuccgucugcgccaaccccaagcagaccugggucaaguacaucguccgccuccucuccaagaaggucaagaacauguga

SEQ ID NO: 4933 - RNA, 291 nt, Artificial Sequence
  derived and/or modified sequence opt3 from CCL20__Homo_sapiens__AAC50943
augugcuguaccaagagccugcuccuugccgcucugauguccguguuguuacugcaccuaugcggcgagucugaagcagccucaaacuucgacuguugccucggguacacagauagaauccugcaucccaaauuuauugucggauucacuaggcagcuugcgaaugaggguugugacauaaacgcuaucauuuuucacacgaagaaaaagcugaguguuugcgccaauccuaaacaaaccugggugaaguauaucguacgguugcucagcaagaaagugaagaacauguga

SEQ ID NO: 4934 - RNA, 291 nt, Artificial Sequence
  derived and/or modified sequence opt4 from CCL20__Homo_sapiens__AAC50943
augugcugcaccaagagccugcugcuggccgcccugaugagcgugcugcugcugcaccugugcggcgagagcgaggccgccagcaacuucgacugcugccugggcuacaccgacagaauccugcaccccaaguucaucgugggcuucaccagacagcuggccaacgagggcugcgacaucaacgccaucaucuuccacaccaagaagaagcugagcgugugcgccaaccccaagcagaccugggugaaguacaucgugagacugcugagcaagaaggugaagaacauguga

SEQ ID NO: 4935 - RNA, 291 nt, Artificial Sequence
  derived and/or modified sequence opt5 from CCL20__Homo_sapiens__AAC50943
augugcuguaccaagagccugcuccuggccgcucuuauguccgugcugcuccugcaccuuugcggcgagucugaagccgcgagcaacuucgacuguugccugggguacacagauagaauccuccaucccaaauuuauugucggauucacgcggcagcuggcuaaugagggcugugacaucaacgccauuaucuuucacaccaagaaaaagcuguccguuugcgccaauccuaaacaaacaugggugaaguauauugugcgccuccugucuaagaaagucaagaacauguga

SEQ ID NO: 4936 - RNA, 291 nt, Artificial Sequence
  derived and/or modified sequence opt6 from CCL20__Homo_sapiens__AAC50943
augugcugcacaaaaucacuacuacuagcagcacuaaugucaguacuauuacuacaccuaugcggagaaucagaagcagcaucaaacuucgacugcugccuaggauacacagacagaauacuacacccaaaauucauaguaggauucacaagacaacuagcaaacgaaggaugcgacauaaacgcaauaauauuccacacaaaaaaaaaacuaucaguaugcgcaaacccaaaacaaacauggguaaaauacauaguaagacuacuaucaaaaaaaguaaaaaacauguaa

SEQ ID NO: 4937 - protein, 134 aa, Artificial Sequence
  CCL21__Homo_sapiens__O00585
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 4938 - RNA, 405 nt, Artificial Sequence
  CCL21__Homo_sapiens__AAB86594
auggcucagucacuggcucugagccuccuuauccugguucuggccuuuggaauccccaggacccaaggcagugauggaggggcucaggacuguugccucaaguacagccaaaggaagauucccgccaagguuguccgcagcuaccggaagcaggaaccaagcuuaggcugcuccaucccagcuauccuguucuugccccgcaagcgcucucaggcagagcuaugugcagacccaaaggagcucugggugcagcagcugaugcagcaucuggacaagacaccauccccacagaaaccagcccagggcugcaggaaggacaggggggccuccaagacuggcaagaaaggaaagggcuccaaaggcugcaagaggacugagcggucacagaccccuaaagggccauag

SEQ ID NO: 4939 - RNA, 405 nt, Artificial Sequence
  derived and/or modified sequence opt1 from CCL21__Homo_sapiens__AAB86594
auggcccagagccuggcccucucccugcugauccucgugcuggcguucggcaucccccgcacccaggggagcgacggcggggcccaggacugcugccugaaguacucccagcggaagaucccggccaaggucgugcgcagcuaccggaagcaggagcccucccucggcugcagcauccccgccauccuguuccugccccgcaagcggucccaggccgagcucugcgcggacccgaaggagcugugggugcagcagcugaugcagcaccucgacaagacccccagcccccagaagcccgcccaggggugccgcaaggaccggggcgccuccaagacgggcaagaaggggaagggcagcaaggggugcaagcgcaccgagcggucccagaccccgaagggccccuga

SEQ ID NO: 4940 - RNA, 405 nt, Artificial Sequence
  derived and/or modified sequence opt2 from CCL21__Homo_sapiens__AAB86594
auggcccagucccucgcccucucccuccucauccucguccucgccuucggcaucccccgcacccagggcuccgacggcggcgcccaggacugcugccucaaguacucccagcgcaagauccccgccaaggucguccgcuccuaccgcaagcaggagcccucccucggcugcuccauccccgccauccucuuccucccccgcaagcgcucccaggccgagcucugcgccgaccccaaggagcucuggguccagcagcucaugcagcaccucgacaagacccccuccccccagaagcccgcccagggcugccgcaaggaccgcggcgccuccaagaccggcaagaagggcaagggcuccaagggcugcaagcgcaccgagcgcucccagacccccaagggccccuga

SEQ ID NO: 4941 - RNA, 405 nt, Artificial Sequence
  derived and/or modified sequence opt3 from CCL21__Homo_sapiens__AAB86594
auggcccagagccuggcucucucccuucugaucuugguguuagcauucggcauucccagaacccaagggucugacggaggugcccaggauugcugucugaaguacucacagaggaaaauaccugcgaaggucguucggaguuaucgcaaacaggagccaagccuaggcugcuccaucccggcuauucucuuucugccccgaaagcguucucaagccgaacuuugugcagacccuaaagagcugugggugcagcaguugaugcagcaccucgauaagacaccaucgccccaaaagccugcccaggggugcagaaaagacaggggagcuucaaagacuggcaaaaaggguaaagggagcaagggauguaagcggacggaacgcagucagaccccaaaaggccccuga

SEQ ID NO: 4942 - RNA, 405 nt, Artificial Sequence
  derived and/or modified sequence opt4 from CCL21__Homo_sapiens__AAB86594
auggcccagagccuggcccugagccugcugauccuggugcuggccuucggcauccccagaacccagggcagcgacggcggcgcccaggacugcugccugaaguacagccagagaaagauccccgccaagguggugagaagcuacagaaagcaggagcccagccugggcugcagcauccccgccauccuguuccugcccagaaagagaagccaggccgagcugugcgccgaccccaaggagcugugggugcagcagcugaugcagcaccuggacaagacccccagcccccagaagcccgcccagggcugcagaaaggacagaggcgccagcaagaccggcaagaagggcaagggcagcaagggcugcaagagaaccgagagaagccagacccccaagggccccuga

SEQ ID NO: 4943 - RNA, 405 nt, Artificial Sequence
  derived and/or modified sequence opt5 from CCL21__Homo_sapiens__AAB86594
auggcccagagccuggcucucucccugcuuauccuggugcucgccuucggcauucccagaacccaagggucugacggaggcgcgcaggauugcugucugaaguacagccagcggaaaaucccugcuaaggucguucgcuccuauagaaaacaggagccgucucuugggugcagcauucccgccauccuguuucucccucggaagcgcucccaagccgaacugugugcugaccccaaagagcugugggugcagcagcucaugcagcaccuggauaagacaccuucuccccaaaagccugcccagggaugcagaaaagaccggggcgcuagcaagacggggaaaaagggaaaaggcuccaagggcuguaagcgcaccgaaagaagccagacaccgaaagggcccuga

SEQ ID NO: 4944 - RNA, 405 nt, Artificial Sequence
  derived and/or modified sequence opt6 from CCL21__Homo_sapiens__AAB86594
auggcacaaucauuagcacuaucacuacuaauacuaguauuagcauucggaauaccaagaacacaaggaucagacggaggagcacaagacugcugccuaaaauacucacaaagaaaaauaccagcaaaaguaguaagaucauacagaaaacaagaaccaucacuaggaugcucaauaccagcaauacuauuccuaccaagaaaaagaucacaagcagaacuaugcgcagacccaaaagaacuauggguacaacaacucaugcaacacuuagacaaaacaccaagcccacaaaaaccagcacaaggaugcagaaaagacagaggagcaucaaaaacaggaaaaaaaggaaaaggaucaaaaggaugcaaaagaacagaacgaucacaaacaccaaaaggaccauaa

SEQ ID NO: 4945 - protein, 93 aa, Artificial Sequence
  CCL22__Homo_sapiens__O00626
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 4946 - RNA, 282 nt, Artificial Sequence
  CCL22__Homo_sapiens__BAG34909
auggaucgccuacagacugcacuccugguuguccucguccuccuugcuguggcgcuucaagcaacugaggcaggccccuacggcgccaacauggaagacagcgucugcugccgugauuacguccguuaccgucugccccugcgcguggugaaacacuucuacuggaccucagacuccugcccgaggccuggcgugguguugcuaaccuucagggauaaggagaucugugccgaucccagagugcccugggugaagaugauucucaauaagcugagccaauga

SEQ ID NO: 4947 - RNA, 282 nt, Artificial Sequence
  derived and/or modified sequence opt1 from CCL22__Homo_sapiens__BAG34909
auggaccgccugcagaccgcccuccuggugguccuggugcuccuggccguggcgcugcaggccaccgaggccggccccuacggggccaacauggaggacagcgucugcugccgggacuacgugcgcuaccggcucccgcugcgcguggucaagcacuucuacuggacguccgacagcugcccccggcccggcguggugcugcucaccuuccgcgacaaggagaucugcgccgacccccgggucccgugggugaagaugauccugaacaagcugucccaguga

SEQ ID NO: 4948 - RNA, 282 nt, Artificial Sequence
  derived and/or modified sequence opt2 from CCL22__Homo_sapiens__BAG34909
auggaccgccuccagaccgcccuccucgucguccucguccuccucgccgucgcccuccaggccaccgaggccggccccuacggcgccaacauggaggacuccgucugcugccgcgacuacguccgcuaccgccucccccuccgcgucgucaagcacuucuacuggaccuccgacuccugcccccgccccggcgucguccuccucaccuuccgcgacaaggagaucugcgccgacccccgcguccccugggucaagaugauccucaacaagcucucccaguga

SEQ ID NO: 4949 - RNA, 282 nt, Artificial Sequence
  derived and/or modified sequence opt3 from CCL22__Homo_sapiens__BAG34909
auggacagacugcagaccgcccuccuugugguccugguuuuguuagcuguggcacugcaagccacagaggcgggccccuacggggcuaacauggaagauagcguaugcuguagggacuaugugcgguaccgccuaccucuccgagucgugaagcacuucuauuggacuuccgauucuugcccacguccgggaguugugcugcuuacguuuagagacaaagagaucugugccgaucccagggucccuugggugaagaugauucugaauaaauugucacaguga

SEQ ID NO: 4950 - RNA, 282 nt, Artificial Sequence
  derived and/or modified sequence opt4 from CCL22__Homo_sapiens__BAG34909
auggacagacugcagaccgcccugcugguggugcuggugcugcuggccguggcccugcaggccaccgaggccggccccuacggcgccaacauggaggacagcgugugcugcagagacuacgugagauacagacugccccugagaguggugaagcacuucuacuggaccagcgacagcugccccagacccggcguggugcugcugaccuucagagacaaggagaucugcgccgaccccagagugcccugggugaagaugauccugaacaagcugagccaguga

SEQ ID NO: 4951 - RNA, 282 nt, Artificial Sequence
  derived and/or modified sequence opt5 from CCL22__Homo_sapiens__BAG34909
auggacagacugcagaccgcccuccuggugguccuuguucugcucgcuguggcccugcaagcgacagaggcuggccccuacggggccaacauggaagauagcgugugcugucgggacuauguccgcuacagacuuccucugcgggugguuaagcacuucuauuggacguccgauucuugcccgcgccccggagugguccuccugaccuuuagagacaaagagaucugugccgauccucgggugcccuggguuaagaugauucugaauaaacucagccaguga

SEQ ID NO: 4952 - RNA, 282 nt, Artificial Sequence
  derived and/or modified sequence opt6 from CCL22__Homo_sapiens__BAG34909
auggacagacuacaaacagcacuauuaguaguacuaguacuauuagcaguagcauuacaagcaacagaagcaggaccauauggagcaaacauggaagauagcguaugcuguagagauuacguaagauauagauuaccauuaagaguaguaaaacacuuuuacuggacaucagacucaugcccaagaccaggaguaguauuacuaacauucagagacaaagaaauaugcgcagacccaagaguaccauggguaaaaaugauacuaaauaaauuaagccaauaa

SEQ ID NO: 4953 - protein, 119 aa, Artificial Sequence
  CCL24__Homo_sapiens__O00175
MAGLMTIVTSLLFLGVCAHHIIPTGSVVIPSPCCMFFVSKRIPENRVVSYQLSSRSTCLKAGVIFTTKKGQQFCGDPKQEWVQRYMKNLDAKQKKASPRARAVAVKGPVQRYPGNQTTC

SEQ ID NO: 4954 - RNA, 360 nt, Artificial Sequence
  CCL24__Homo_sapiens__AAD15410
auggcaggccugaugaccauaguaaccagccuucuguuccuuggugucugugcccaccacaucaucccuacgggcucuguggucauccccucucccugcugcauguucuuuguuuccaagagaauuccugagaaccgaguggucagcuaccagcuguccagcaggagcacaugccucaaggcaggagugaucuucaccaccaagaagggccagcaguucuguggcgaccccaagcaggaguggguccagagguacaugaagaaccuggacgccaagcagaagaaggcuuccccuagggccagggcaguggcugucaagggcccuguccagagauauccuggcaaccaaaccaccugcuaa

SEQ ID NO: 4955 - RNA, 360 nt, Artificial Sequence
  derived and/or modified sequence opt1 from CCL24__Homo_sapiens__AAD15410
auggccggccugaugaccaucgugaccagccuccuguuccugggggucugcgcccaccacaucauccccacgggcuccguggugaucccgagccccugcugcauguucuucgucuccaagcgcauccccgagaaccggguggugagcuaccagcucuccagccgcuccaccugccugaaggcgggggucaucuucaccaccaagaagggccagcaguucugcggggaccccaagcaggagugggugcagcgguacaugaagaaccuggacgccaagcagaagaaggccagcccgcgcgcccgggccguggcggucaagggccccgugcagcgcuaccccggcaaccagacgaccugcuga

SEQ ID NO: 4956 - RNA, 360 nt, Artificial Sequence
  derived and/or modified sequence opt2 from CCL24__Homo_sapiens__AAD15410
auggccggccucaugaccaucgucaccucccuccucuuccucggcgucugcgcccaccacaucauccccaccggcuccgucgucauccccucccccugcugcauguucuucgucuccaagcgcauccccgagaaccgcgucgucuccuaccagcucuccucccgcuccaccugccucaaggccggcgucaucuucaccaccaagaagggccagcaguucugcggcgaccccaagcaggaguggguccagcgcuacaugaagaaccucgacgccaagcagaagaaggccuccccccgcgcccgcgccgucgccgucaagggccccguccagcgcuaccccggcaaccagaccaccugcuga

SEQ ID NO: 4957 - RNA, 360 nt, Artificial Sequence
  derived and/or modified sequence opt3 from CCL24__Homo_sapiens__AAD15410
auggccggccugaugaccaucgugacaagccuccuuuuccugggggucugcgcucaccauauuauacccacuggauccguugugaucccuucuccauguugcauguuuuucguaucaaagaggauuccggagaacagaguggucaguuaccaguugagcucccggucuacguguuuaaaagccggugugaucuuuaccacaaagaaaggccaacaguucugcggggaccccaagcaggaauggguucagcgcuauaugaaaaaucuggaugcaaagcaaaagaaagcgucgccucgagcucgugccguggcagucaagggaccagugcagagauaccccggcaaccagacuaccuguuga

SEQ ID NO: 4958 - RNA, 360 nt, Artificial Sequence
  derived and/or modified sequence opt4 from CCL24__Homo_sapiens__AAD15410
auggccggccugaugaccaucgugaccagccugcuguuccugggcgugugcgcccaccacaucauccccaccggcagcguggugauccccagccccugcugcauguucuucgugagcaagagaauccccgagaacagaguggugagcuaccagcugagcagcagaagcaccugccugaaggccggcgugaucuucaccaccaagaagggccagcaguucugcggcgaccccaagcaggagugggugcagagauacaugaagaaccuggacgccaagcagaagaaggccagccccagagccagagccguggccgugaagggccccgugcagagauaccccggcaaccagaccaccugcuga

SEQ ID NO: 4959 - RNA, 360 nt, Artificial Sequence
  derived and/or modified sequence opt5 from CCL24__Homo_sapiens__AAD15410
auggccggccugaugaccaucgugacaagccuccuguuccuuggggucugcgcucaccauauuauccccacgggauccguugugauuccuucuccguguugcauguuuuucgugagcaagagaauccccgagaaccgggucguguccuaccagcugucuagccgcuccaccugucucaaagccggcguuauuuuuacaaccaagaaagggcaacaguucugcggagacccuaagcaggaaugggugcagagauauaugaaaaaucuggaugcgaagcaaaagaaggcuucuccccgggcccgcgccgucgcugugaaaggcccuguucagagauaccccgggaaccagacaaccuguuga

SEQ ID NO: 4960 - RNA, 360 nt, Artificial Sequence
  derived and/or modified sequence opt6 from CCL24__Homo_sapiens__AAD15410
auggcaggauuaaugacaauaguaacaucacuauuauucuuaggaguaugcgcacaccauauaauaccaacaggaucaguaguaauaccaagcccaugcuguauguuuuucguaagcaaaagaauaccagaaaacagaguaguaagcuaucaauuaagcucaagaucaacaugucuaaaagcaggaguaauauucacaacaaaaaaaggacaacaauucuguggagacccaaaacaagaauggguacaaagauacaugaaaaaucuagacgcaaaacaaaaaaaagcaagcccaagagcaagagcaguagcaguaaaaggaccaguacaaagauauccaggaaaccaaacaacaugcuaa

SEQ ID NO: 4961 - protein, 150 aa, Artificial Sequence
  CCL25__Homo_sapiens__O15444
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 4962 - RNA, 453 nt, Artificial Sequence
  CCL25__Homo_sapiens__AAI30562
augaaccuguggcuccuggccugccugguggccggcuuccugggagccugggcccccgcuguccacacccaaggugucuuugaggacugcugccuggccuaccacuaccccauugggugggcugugcuccggcgcgccuggacuuaccggauccaggaggugagcgggagcugcaaucugccugcugcgauauucuaccuccccaagagacacaggaaggugugugggaaccccaaaagcagggaggugcagagagccaugaagcuccuggaugcucgaaauaagguuuuugcaaagcuccaccacaacacgcagaccuuccaagcaggcccucaugcuguaaagaaguugaguucuggaaacuccaaguuaucaucauccaaguuuagcaaucccaucagcagcagcaagaggaaugucucccuccugauaucagcuaauucaggacuguga

SEQ ID NO: 4963 - RNA, 453 nt, Artificial Sequence
  derived and/or modified sequence opt1 from CCL25__Homo_sapiens__AAI30562
augaaccuguggcuccuggccugccugguggccggcuuccucggggcgugggcccccgccguccacacccagggcguguucgaggacugcugccuggccuaccacuacccgaucgggugggccgugcugcgccgggcguggaccuaccgcauccaggaggucagcggcuccugcaaccuccccgccgccaucuucuaccugcccaagcggcaccgcaaggugugcgggaaccccaagagccgggaggugcagcgcgccaugaagcugcucgacgcgcggaacaaggucuucgccaagcugcaccacaacacgcagaccuuccaggccggcccgcacgccgugaagaagcuguccagcggcaacuccaagcucagcuccagcaaguucuccaaccccaucagcuccagcaagcgcaacgugucccugcugaucagcgccaacuccgggcucuga

SEQ ID NO: 4964 - RNA, 453 nt, Artificial Sequence
  derived and/or modified sequence opt2 from CCL25__Homo_sapiens__AAI30562
augaaccucuggcuccucgccugccucgucgccggcuuccucggcgccugggcccccgccguccacacccagggcgucuucgaggacugcugccucgccuaccacuaccccaucggcugggccguccuccgccgcgccuggaccuaccgcauccaggaggucuccggcuccugcaaccuccccgccgccaucuucuaccuccccaagcgccaccgcaaggucugcggcaaccccaagucccgcgagguccagcgcgccaugaagcuccucgacgcccgcaacaaggucuucgccaagcuccaccacaacacccagaccuuccaggccggcccccacgccgucaagaagcucuccuccggcaacuccaagcucuccuccuccaaguucuccaaccccaucuccuccuccaagcgcaacgucucccuccucaucuccgccaacuccggccucuga

SEQ ID NO: 4965 - RNA, 453 nt, Artificial Sequence
  derived and/or modified sequence opt3 from CCL25__Homo_sapiens__AAI30562
augaaccuguggcuccuugccugccugguggcuggcuucuugggggcaugggcccccgcgguccacacccagggaguuuuugaggacuguugcuuagcuuaccauuauccuaucgguugggccgugcugagaagggcauggacauaccggauucaagaaguaagcggcuccuguaaucuaccagccgcuauauucuaucucccgaagcgccaccgaaaagugugcgggaaccccaagucucgugagguccagagagcaaugaaacugcuugaugccaggaauaagguguuugcuaaacugcaucacaacacucagacguuccaggccggaccucaugcgguuaagaaguugucaaguggcaauagcaaacucuccucuucgaaguuuucaaacccaaucagcaguuccaaacggaaugugucucugcugauuagcgcaaacuccggucucuga

SEQ ID NO: 4966 - RNA, 453 nt, Artificial Sequence
  derived and/or modified sequence opt4 from CCL25__Homo_sapiens__AAI30562
augaaccuguggcugcuggccugccugguggccggcuuccugggcgccugggcccccgccgugcacacccagggcguguucgaggacugcugccuggccuaccacuaccccaucggcugggccgugcugagaagagccuggaccuacagaauccaggaggugagcggcagcugcaaccugcccgccgccaucuucuaccugcccaagagacacagaaaggugugcggcaaccccaagagcagagaggugcagagagccaugaagcugcuggacgccagaaacaagguguucgccaagcugcaccacaacacccagaccuuccaggccggcccccacgccgugaagaagcugagcagcggcaacagcaagcugagcagcagcaaguucagcaaccccaucagcagcagcaagagaaacgugagccugcugaucagcgccaacagcggccuguga

SEQ ID NO: 4967 - RNA, 453 nt, Artificial Sequence
  derived and/or modified sequence opt5 from CCL25__Homo_sapiens__AAI30562
augaaccuguggcuccuggccugccuuguggcuggcuuccugggggccugggcgcccgcuguccacacccagggaguuuuugaggacuguugccucgccuaccauuauccuaucggcugggccgugcugagacgggcuuggacauaccgcauucaagaagugagcggguccuguaaucuuccggccgcuaucuucuaucugcccaagagacaccggaaagucugcggaaacccuaagucucgcgaggugcagagagccaugaaacuccuggaugcgcggaauaagguuuuugccaaacugcaucacaacacgcagaccuuccaggcuggcccccaugccgugaagaagcucagcuccggaaauucuaaacugagcuccucuaaguuuagcaacccuauuuccagcucuaaacgcaaugucucccuucugaucagcgcuaacucugggcucuga

SEQ ID NO: 4968 - RNA, 453 nt, Artificial Sequence
  derived and/or modified sequence opt6 from CCL25__Homo_sapiens__AAI30562
augaaucuauggcuacuagccugccuaguagcaggauuccuaggagcaugggcaccagcaguacacacacaaggaguauucgaagacugcugccuagcauaccacuacccaauaggaugggcaguacuaagaagagcauggacauacagaauacaagaaguaucaggaucaugcaacuuaccagcagcaauauucuaccuaccaaaaagacacagaaaaguaugcggaaacccaaaaucaagagaaguacaaagagcaaugaaacuacuagacgcaagaaacaaaguauucgcaaaacuacaccacaacacacaaacauuccaagcaggaccacacgcaguaaaaaaauuaucaucaggcaacuccaaacuaucaucaucaaaauucucaaacccaauaucaucaucaaaaagaaacguaucacuacuaauaucagcaaacucaggacuauaa

SEQ ID NO: 4969 - protein, 94 aa, Artificial Sequence
  CCL26__Homo_sapiens__Q9Y258
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 4970 - RNA, 285 nt, Artificial Sequence
  CCL26__Homo_sapiens__AAD15411
augaugggccucuccuuggccucugcugugcuccuggccucccuccugagucuccaccuuggaacugccacacgugggagugacauauccaagaccugcugcuuccaauacagccacaagccccuucccuggaccugggugcgaagcuaugaauucaccaguaacagcugcucccagcgggcugugauauucacuaccaaaagaggcaagaaagucuguacccauccaaggaaaaaaugggugcaaaaauacauuucuuuacugaaaacuccgaaacaauuguga

SEQ ID NO: 4971 - RNA, 285 nt, Artificial Sequence
  derived and/or modified sequence opt1 from CCL26__Homo_sapiens__AAD15411
augaugggccugagccucgccuccgccgugcugcuggcgagccuccugucccugcaccucgggaccgccacccgcggcagcgacaucuccaagacgugcugcuuccaguacagccacaagccccugccguggaccuggguccgguccuacgaguucaccagcaacuccugcagccagcgcgccgugaucuucaccacgaagcgggggaagaaggugugcacccacccccgcaagaaguggguccagaaguacaucucccugcucaagacccccaagcagcuguga

SEQ ID NO: 4972 - RNA, 285 nt, Artificial Sequence
  derived and/or modified sequence opt2 from CCL26__Homo_sapiens__AAD15411
augaugggccucucccucgccuccgccguccuccucgccucccuccucucccuccaccucggcaccgccacccgcggcuccgacaucuccaagaccugcugcuuccaguacucccacaagccccuccccuggaccuggguccgcuccuacgaguucaccuccaacuccugcucccagcgcgccgucaucuucaccaccaagcgcggcaagaaggucugcacccacccccgcaagaaguggguccagaaguacaucucccuccucaagacccccaagcagcucuga

SEQ ID NO: 4973 - RNA, 285 nt, Artificial Sequence
  derived and/or modified sequence opt3 from CCL26__Homo_sapiens__AAD15411
augaugggccugagccucgccuccgcugugcuucuggcaucuuuguuaucacugcaccuagggaccgccacaagaggaagugacaucagcaagacuugcuguuuccaguacucccauaaaccccucccuuggacgugggucaggucuuaugaguuuaccucgaacucaugcagccaacgggcgguuauuuucacaacuaagcgcgguaaaaagguguguacccacccacgaaagaaauggguacagaaguacauaagucugcuuaaaacaccgaagcagcuguga

SEQ ID NO: 4974 - RNA, 285 nt, Artificial Sequence
  derived and/or modified sequence opt4 from CCL26__Homo_sapiens__AAD15411
augaugggccugagccuggccagcgccgugcugcuggccagccugcugagccugcaccugggcaccgccaccagaggcagcgacaucagcaagaccugcugcuuccaguacagccacaagccccugcccuggaccugggugagaagcuacgaguucaccagcaacagcugcagccagagagccgugaucuucaccaccaagagaggcaagaaggugugcacccaccccagaaagaagugggugcagaaguacaucagccugcugaagacccccaagcagcuguga

SEQ ID NO: 4975 - RNA, 285 nt, Artificial Sequence
  derived and/or modified sequence opt5 from CCL26__Homo_sapiens__AAD15411
augaugggccugagccucgccuccgcugugcugcuugccucucugcucagccugcaccuugggaccgcgacaagaggauccgacaucucuaagacgugcuguuuccaguacagccauaaaccccugccuuggaccuggguccgguccuaugaguuuacaucuaacagcugcucccaacgcgcuguuauuuucaccacaaagagaggcaaaaagguguguacccacccgcggaaaaagugggugcagaaguacaucagccuccugaaaacacccaagcagcuguga

SEQ ID NO: 4976 - RNA, 285 nt, Artificial Sequence
  derived and/or modified sequence opt6 from CCL26__Homo_sapiens__AAD15411
augaugggacuaucacuagcaucagcaguacuacuagcaucacuacuaucacuacaccuaggaacagcaacaagaggaucagacauaucaaaaacaugcugcuuccaauacucacacaaaccacuaccauggacauggguaagaucauacgaauucacaucaaacucaugcucacaaagagcaguaauauucacaacaaaaagaggaaaaaaaguaugcacacacccaagaaaaaaauggguacaaaaauacauaucacuacuaaaaacaccaaaacaacuauaa

SEQ ID NO: 4977 - protein, 112 aa, Artificial Sequence
  CCL27__Homo_sapiens__Q5VZ77
MKGPPTFCSLLLLSLLLSPDPTAAFLLPPSTACCTQLYRKPLSDKLLRKVIQVELQEADGDCHLQAFVLHLAQRSICIHPQNPSLSQWFEHQERKLHGTLPKLNFGMLRKMG

SEQ ID NO: 4978 - RNA, 339 nt, Artificial Sequence
  CCL27__Homo_sapiens__AAI48264
augaaggggcccccaaccuucugcagccuccugcugcugucauugcuccugagcccagacccuacagcagcauuccuacugccacccagcacugccugcuguacucagcucuaccgaaagccacucucagacaagcuacugaggaaggucauccagguggaacugcaggaggcugacggggacugucaccuccaggcuuucgugcuucaccuggcucaacgcagcaucugcauccacccccagaaccccagccugucacagugguuugagcaccaagagagaaagcuccaugggacucugcccaagcugaauuuugggaugcuaaggaaaaugggcuag

SEQ ID NO: 4979 - RNA, 339 nt, Artificial Sequence
  derived and/or modified sequence opt1 from CCL27__Homo_sapiens__AAI48264
augaaggggcccccgaccuucugcagccugcuccugcugucccuccugcugagccccgaccccaccgccgccuuccuccugcccccguccacggcgugcugcacccagcuguaccgcaagccccucagcgacaagcugcugcggaaggugauccaggucgagcuccaggaggccgacggcgacugccaccuccaggccuucgugcugcaccuggcccagcgcuccaucugcauccacccccagaaccccagccugucccagugguucgagcaccaggagcggaagcugcacggcacccucccgaagcugaacuucgggaugcugcgcaagaugggcuga

SEQ ID NO: 4980 - RNA, 339 nt, Artificial Sequence
  derived and/or modified sequence opt2 from CCL27__Homo_sapiens__AAI48264
augaagggcccccccaccuucugcucccuccuccuccucucccuccuccucucccccgaccccaccgccgccuuccuccucccccccuccaccgccugcugcacccagcucuaccgcaagccccucuccgacaagcuccuccgcaaggucauccaggucgagcuccaggaggccgacggcgacugccaccuccaggccuucguccuccaccucgcccagcgcuccaucugcauccacccccagaaccccucccucucccagugguucgagcaccaggagcgcaagcuccacggcacccuccccaagcucaacuucggcaugcuccgcaagaugggcuga

SEQ ID NO: 4981 - RNA, 339 nt, Artificial Sequence
  derived and/or modified sequence opt3 from CCL27__Homo_sapiens__AAI48264
augaaggggcccccuaccuucugcagccugcuccuucuguccuuguuacugucuccagacccgacagccgcuuuucuacugcccccuucaacugcauguugcacgcagcuguacagaaaaccacuuagugauaagcuguugaggaaagugauccaagucgagcuccaggaagccgacggcgauugucaccuccaggcguucguucugcaucucgcucagcggagcauuugcauacacccccaaaacccuuccuuaucucagugguuugagcaucaggaacgcaagcugcacggaacccuuccaaaauugaauuucgguaugcugcgaaagaugggcuga

SEQ ID NO: 4982 - RNA, 339 nt, Artificial Sequence
  derived and/or modified sequence opt4 from CCL27__Homo_sapiens__AAI48264
augaagggcccccccaccuucugcagccugcugcugcugagccugcugcugagccccgaccccaccgccgccuuccugcugccccccagcaccgccugcugcacccagcuguacagaaagccccugagcgacaagcugcugagaaaggugauccagguggagcugcaggaggccgacggcgacugccaccugcaggccuucgugcugcaccuggcccagagaagcaucugcauccacccccagaaccccagccugagccagugguucgagcaccaggagagaaagcugcacggcacccugcccaagcugaacuucggcaugcugagaaagaugggcuga

SEQ ID NO: 4983 - RNA, 339 nt, Artificial Sequence
  derived and/or modified sequence opt5 from CCL27__Homo_sapiens__AAI48264
augaaggggcccccuaccuucugcagccugcuccugcuuucccugcuccugucuccggaccccacagccgcuuuucuucugccucccagcacggccuguugcacccagcucuacagaaaaccucuguccgauaagcugcuccggaaagugauccaagucgagcugcaggaagcggacggcgauugucaccuucaggcuuucguucugcaucucgcccagcgcucuauuugcauccacccccaaaacccuagccugucccagugguuugagcaucaggaaagaaaacuucacggaacacugccgaagcucaauuucggcaugcugcggaagaugggguga

SEQ ID NO: 4984 - RNA, 339 nt, Artificial Sequence
  derived and/or modified sequence opt6 from CCL27__Homo_sapiens__AAI48264
augaaaggaccaccaacauucugcucacuacuacuacuaucacuacuacuaucacccgacccaacagcagcauuccuauuaccaccaucaacagcaugcugcacacaacuauacagaaaaccacuaucagacaaacuacuaagaaaaguaauacaaguagaacuacaagaagcagacggagacugccaccuacaagcauucguacuacaccuagcacaaagaucaauaugcauacacccacaaaacccaucacuaucacaaugguucgaacaccaagaaagaaaacuacacggaacacuaccaaaacuaaacuucggaaugcuaagaaaaaugggauaa

SEQ ID NO: 4985 - protein, 127 aa, Artificial Sequence
  CCL28__Homo_sapiens__A0N0Q3
MQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 4986 - RNA, 384 nt, Artificial Sequence
  CCL28__Homo_sapiens__ABK41944
augcagcagagaggacucgccaucguggccuuggcugucugugcggcccuacaugccucagaagccauacuucccauugccuccagcuguugcacggagguuucacaucauauuuccagaaggcuccuggaaagagugaauaugugucgcauccagagagcugauggggauugugacuuggcugcugucauccuucaugucaagcgcagaagaaucugugucagcccgcacaaccauacuguuaagcaguggaugaaagugcaagcugccaagaaaaaugguaaaggaaauguuugccacaggaagaaacaccauggcaagaggaacaguaacagggcacaucaggggaaacacgaaacauacggccauaaaacuccuuauuag

SEQ ID NO: 4987 - RNA, 384 nt, Artificial Sequence
  derived and/or modified sequence opt1 from CCL28__Homo_sapiens__ABK41944
augcagcagcgcggccuggccaucguggcccucgcggucugcgccgcccugcacgccagcgaggccauccugcccaucgcguccagcugcugcaccgaggugucccaccacaucagccggcgccuccuggagcgggugaacaugugccgcauccagcgggccgacggggacugcgaccuggccgccgucauccuccacgugaagcgccggcgcaucugcguguccccgcacaaccacaccgucaagcaguggaugaaggugcaggcggccaagaagaacggcaaggggaacgugugccaccggaagaagcaccacggcaagcgcaacagcaaccgggcccaccaggggaagcacgagacguacggccacaagacccccuacuga

SEQ ID NO: 4988 - RNA, 384 nt, Artificial Sequence
  derived and/or modified sequence opt2 from CCL28__Homo_sapiens__ABK41944
augcagcagcgcggccucgccaucgucgcccucgccgucugcgccgcccuccacgccuccgaggccauccuccccaucgccuccuccugcugcaccgaggucucccaccacaucucccgccgccuccucgagcgcgucaacaugugccgcauccagcgcgccgacggcgacugcgaccucgccgccgucauccuccacgucaagcgccgccgcaucugcgucuccccccacaaccacaccgucaagcaguggaugaagguccaggccgccaagaagaacggcaagggcaacgucugccaccgcaagaagcaccacggcaagcgcaacuccaaccgcgcccaccagggcaagcacgagaccuacggccacaagacccccuacuga

SEQ ID NO: 4989 - RNA, 384 nt, Artificial Sequence
  derived and/or modified sequence opt3 from CCL28__Homo_sapiens__ABK41944
augcagcaaagaggccuggccaucguggcucucgcagucugcgccgcgcuucacgcuagcgaggccauucugcccauagcauccucuuguugcaccgaaguuucacaucacaucaguaggcgguuguuagagcgcgugaacaugugucguauucagcgagccgacggggauugcgaccuggcugcaguaauccuacaugugaagagaaggcggauuugugucagcccucacaaucauacagugaaacaguggaugaagguucaggccgcuaaaaagaacggaaaagguaaugugugccaccgcaagaagcaccauggcaaaagaaacuccaauagggcccaccaagggaagcaugaaacuuacggacacaaaacgccauauuga

SEQ ID NO: 4990 - RNA, 384 nt, Artificial Sequence
  derived and/or modified sequence opt4 from CCL28__Homo_sapiens__ABK41944
augcagcagagaggccuggccaucguggcccuggccgugugcgccgcccugcacgccagcgaggccauccugcccaucgccagcagcugcugcaccgaggugagccaccacaucagcagaagacugcuggagagagugaacaugugcagaauccagagagccgacggcgacugcgaccuggccgccgugauccugcacgugaagagaagaagaaucugcgugagcccccacaaccacaccgugaagcaguggaugaaggugcaggccgccaagaagaacggcaagggcaacgugugccacagaaagaagcaccacggcaagagaaacagcaacagagcccaccagggcaagcacgagaccuacggccacaagacccccuacuga

SEQ ID NO: 4991 - RNA, 384 nt, Artificial Sequence
  derived and/or modified sequence opt5 from CCL28__Homo_sapiens__ABK41944
augcagcaaagaggccuggccaucguggcucucgccgucugcgcggcucugcacgccagcgaggccauucuucccaucgcuuccucuuguugcaccgaaguuagccaucacauuucccggcgccugcucgagagagugaacaugugucggauccagcgcgccgacggggauugcgaccuggcugccgugauucuucaugucaagagacggcgcaucugugugucuccucacaaucauacaguuaaacaguggaugaaggugcaggcggccaaaaagaacggaaaaggcaaugucugccacagaaagaagcaccaugggaaacggaacagcaaucgcgcucaccaaggaaagcaugaaacguacggccacaaaaccccguauuga

SEQ ID NO: 4992 - RNA, 384 nt, Artificial Sequence
  derived and/or modified sequence opt6 from CCL28__Homo_sapiens__ABK41944
augcaacaaagaggacuagcaauaguagcauuagcaguaugcgcagcauuacacgcgagcgaagcaauacuaccaauagcaagcaguugcuguacagaaguaucacaccauauaucaagaagacuauuagaaagaguaaauauguguagaauacaaagagcagauggagauugcgaucuagcagcaguaauauuacacguaaaaagaagaagaauauguguaucaccacauaaccauacaguaaaacaauggaugaaaguacaagcagcaaaaaaaaauggaaaaggaaauguaugucacagaaaaaaacaccauggaaaaagaaauagcaauagagcacaccaaggaaaacacgaaacauacggacauaaaacaccauauuaa

SEQ ID NO: 4993 - protein, 127 aa, Artificial Sequence; identical to SEQ ID NO: 4985
  CCL28__Homo_sapiens__Q9NRJ3

SEQ ID NO: 4994 - RNA, 384 nt, Artificial Sequence; identical to SEQ ID NO: 4986
  CCL28__Homo_sapiens__AAF87205

SEQ ID NO: 4995 - RNA, 384 nt, Artificial Sequence; identical to SEQ ID NO: 4987
  derived and/or modified sequence opt1 from CCL28__Homo_sapiens__AAF87205

SEQ ID NO: 4996 - RNA, 384 nt, Artificial Sequence; identical to SEQ ID NO: 4988
  derived and/or modified sequence opt2 from CCL28__Homo_sapiens__AAF87205

SEQ ID NO: 4997 - RNA, 384 nt, Artificial Sequence; identical to SEQ ID NO: 4989
  derived and/or modified sequence opt3 from CCL28__Homo_sapiens__AAF87205

SEQ ID NO: 4998 - RNA, 384 nt, Artificial Sequence; identical to SEQ ID NO: 4990
  derived and/or modified sequence opt4 from CCL28__Homo_sapiens__AAF87205

SEQ ID NO: 4999 - RNA, 384 nt, Artificial Sequence; identical to SEQ ID NO: 4991
  derived and/or modified sequence opt5 from CCL28__Homo_sapiens__AAF87205

SEQ ID NO: 5000 - RNA, 384 nt, Artificial Sequence
  derived and/or modified sequence opt6 from CCL28__Homo_sapiens__AAF87205
augcaacaaagaggacuagcaauaguagcauuagcaguaugcgcagcauuacacgcaagcgaagcaauacuaccaauagcaagcucaugcuguacagaaguaucacaccauauaucaagaagacuauuagaaagaguaaauaugugcagaauacaaagagcagauggagacugcgaccucgcagcaguaauauuacacguaaaaagaagaagaauauguguaucaccacauaaccauacaguaaaacaauggaugaaaguacaagcagcaaaaaaaaauggaaaaggaaauguaugucacagaaaaaaacaccauggaaaaagaaauagcaauagagcacaccaaggaaaacacgaaacauacggacauaaaacaccauauuaa

SEQ ID NO: 5001 - protein, 99 aa, Artificial Sequence
  CCL2__Homo_sapiens__P13500
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 5002 - RNA, 300 nt, Artificial Sequence
  CCL2__Homo_sapiens__AAA18102
augaaagucucugccgcccuucugugccugcugcucauagcagccaccuucauuccccaagggcucgcucagccagaugcaaucaaugccccagucaccugcugcuauaacuucaccaauaggaagaucucagugcagaggcucgcgagcuauagaagaaucaccagcagcaagugucccaaagaagcugugaucuucaagaccauuguggccaaggagaucugugcugaccccaagcagaaguggguucaggauuccauggaccaccuggacaagcaaacccaaacuccgaagacuuga

SEQ ID NO: 5003 - RNA, 300 nt, Artificial Sequence
  derived and/or modified sequence opt1 from CCL2__Homo_sapiens__AAA18102
augaaggugagcgccgcccugcucugccugcugcucaucgcggccaccuucaucccccagggccuggcccagccggacgccaucaacgcccccgugaccugcugcuacaacuucacgaaccgcaagaucuccguccagcggcuggcgagcuaccgccggaucaccuccagcaagugccccaaggaggccgugaucuucaagaccaucgucgccaaggagaucugcgccgaccccaagcagaagugggugcaggacuccauggaccaccucgacaagcagacccagacgccgaagaccuga

SEQ ID NO: 5004 - RNA, 300 nt, Artificial Sequence
  derived and/or modified sequence opt2 from CCL2__Homo_sapiens__AAA18102
augaaggucuccgccgcccuccucugccuccuccucaucgccgccaccuucaucccccagggccucgcccagcccgacgccaucaacgcccccgucaccugcugcuacaacuucaccaaccgcaagaucuccguccagcgccucgccuccuaccgccgcaucaccuccuccaagugccccaaggaggccgucaucuucaagaccaucgucgccaaggagaucugcgccgaccccaagcagaaguggguccaggacuccauggaccaccucgacaagcagacccagacccccaagaccuga

SEQ ID NO: 5005 - RNA, 300 nt, Artificial Sequence
  derived and/or modified sequence opt3 from CCL2__Homo_sapiens__AAA18102
augaaggugagcgccgcucugcucugccuucuguugaucgcagccaccuucauuccccagggcuuagcgcaaccugacgcuauaaacgccccagucacauguugcuacaauuuuacuaacagaaaaaucuccguucagaggcuggcaucuuaucggcgcauuacgucaaguaaguguccgaaagaggccgugaucuucaagaccauuguagcuaaagaaaucugcgcagaucccaagcagaagugggugcaggacagcauggaucaccuagacaaacaaacacagacuccuaagaccuga

SEQ ID NO: 5006 - RNA, 300 nt, Artificial Sequence
  derived and/or modified sequence opt4 from CCL2__Homo_sapiens__AAA18102
augaaggugagcgccgcccugcugugccugcugcugaucgccgccaccuucaucccccagggccuggcccagcccgacgccaucaacgcccccgugaccugcugcuacaacuucaccaacagaaagaucagcgugcagagacuggccagcuacagaagaaucaccagcagcaagugccccaaggaggccgugaucuucaagaccaucguggccaaggagaucugcgccgaccccaagcagaagugggugcaggacagcauggaccaccuggacaagcagacccagacccccaagaccuga

SEQ ID NO: 5007 - RNA, 300 nt, Artificial Sequence
  derived and/or modified sequence opt5 from CCL2__Homo_sapiens__AAA18102
augaaggugagcgccgcucugcucugccugcuucugaucgccgcgaccuucauuccccagggccucgcucaaccugacgccaucaacgccccggucacauguugcuacaauuuuacgaacagaaaaauuuccguucagcggcuggcuucuuaucgcagaaucaccagcuccaagugucccaaagaggccgugauuuucaagacaaucguggcuaaagaaaucugcgccgauccuaagcagaaguggguccaggacucuauggaucaccuugacaaacaaacccagacacccaagaccuga

SEQ ID NO: 5008 - RNA, 300 nt, Artificial Sequence
  derived and/or modified sequence opt6 from CCL2__Homo_sapiens__AAA18102
augaaaguaucagcagcacuacuaugccuacuacuaauagcagcaacauucauaccacaaggauuagcacaaccagacgcaauaaacgcaccaguaacaugcugcuacaacuucacaaacagaaaaauaucaguacaaagacuagcaucauacagaagaauaacaucaucaaaaugcccaaaagaagcaguaauauucaaaacaauaguagcaaaagaaauaugcgcagacccaaaacaaaaauggguacaagacucaauggaccaccuagacaaacaaacacaaacaccaaaaacauaa

SEQ ID NO: 5009 - protein, 92 aa, Artificial Sequence
  CCL3__Homo_sapiens__A0N0R1
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 5010 - RNA, 279 nt, Artificial Sequence
  CCL3__Homo_sapiens__AAI71831
augcaggucuccacugcugcccuugcuguccuccucugcaccauggcucucugcaaccaguucucugcaucacuugcugcugacacgccgaccgccugcugcuucagcuacaccucccggcagauuccacagaauuucauagcugacuacuuugagacgagcagccagugcuccaagccuggugucaucuuccuaaccaagcgaagccggcaggucugugcugaccccagugaggaguggguccagaaauaugucagcgaccuggagcugagugccuga

SEQ ID NO: 5011 - RNA, 279 nt, Artificial Sequence
  derived and/or modified sequence opt1 from CCL3__Homo_sapiens__AAI71831
augcaggucagcaccgccgcccuggcggugcuccugugcaccauggcccugugcaaccaguucuccgccagccucgccgccgacacgcccaccgcgugcugcuucuccuacaccagccgccagaucccgcagaacuucaucgccgacuacuucgagaccuccagccagugcuccaagcccggcgugaucuuccugacgaagcggagccgccaggugugcgccgaccccuccgaggaguggguccagaaguacgugagcgaccuggagcucuccgccuga

SEQ ID NO: 5012 - RNA, 279 nt, Artificial Sequence
  derived and/or modified sequence opt2 from CCL3__Homo_sapiens__AAI71831
augcaggucuccaccgccgcccucgccguccuccucugcaccauggcccucugcaaccaguucuccgccucccucgccgccgacacccccaccgccugcugcuucuccuacaccucccgccagaucccccagaacuucaucgccgacuacuucgagaccuccucccagugcuccaagcccggcgucaucuuccucaccaagcgcucccgccaggucugcgccgaccccuccgaggaguggguccagaaguacgucuccgaccucgagcucuccgccuga

SEQ ID NO: 5013 - RNA, 279 nt, Artificial Sequence
  derived and/or modified sequence opt3 from CCL3__Homo_sapiens__AAI71831
augcaagugagcaccgccgcucuggcaguccuccuuugcacaauggcccuguguaaccaguucuccgcgucuuuggcugccgacacucccacggcaugcuguuuuucauacaccaguagacagaucccucagaauuucauugccgauuauuuugagacaagcucccagugcucuaagccaggcguuauauucuuaacuaaaaggucgcggcaagugugugcugacccgucagaagaguggguacagaaguacgugagcgaucuggaacuaagugcauga

SEQ ID NO: 5014 - RNA, 279 nt, Artificial Sequence
  derived and/or modified sequence opt4 from CCL3__Homo_sapiens__AAI71831
augcaggugagcaccgccgcccuggccgugcugcugugcaccauggcccugugcaaccaguucagcgccagccuggccgccgacacccccaccgccugcugcuucagcuacaccagcagacagaucccccagaacuucaucgccgacuacuucgagaccagcagccagugcagcaagcccggcgugaucuuccugaccaagagaagcagacaggugugcgccgaccccagcgaggagugggugcagaaguacgugagcgaccuggagcugagcgccuga

SEQ ID NO: 5015 - RNA, 279 nt, Artificial Sequence
  derived and/or modified sequence opt5 from CCL3__Homo_sapiens__AAI71831
augcaagugagcaccgccgcucuggccguccuccugugcacaauggcgcuuuguaaccaguucuccgcuucucuggccgccgacacgcccaccgcuugcuguuuuagcuacacauccagacagaucccucagaauuucauugccgauuauuuugagaccucuagccagugcuccaagccgggcguuaucuuccucacaaaacggucucgccaagugugugcugaccccagcgaagagugggugcagaaguacgucuccgaucuggaacuuagcgccuga

SEQ ID NO: 5016 - RNA, 279 nt, Artificial Sequence
  derived and/or modified sequence opt6 from CCL3__Homo_sapiens__AAI71831
augcaaguaucaacagcagcacuagcaguacuacuaugcacaauggcacuaugcaaccaauucucagcaucacuagcagcagacacaccaacagcaugcugcuucucauacacaucaagacaaauaccacaaaacuucauagcagacuacuucgaaacaucaucacaaugcucaaaaccaggaguaauauuccuaacaaaaagaucaagacaaguaugcgcagacccaucagaagaauggguacaaaaauacguaucagaccuagaacuaucagcauaa

SEQ ID NO: 5017 - protein, 92 aa, Artificial Sequence; identical to SEQ ID NO: 5009
  CCL3__Homo_sapiens__P10147

SEQ ID NO: 5018 - RNA, 279 nt, Artificial Sequence
  CCL3__Homo_sapiens__AAA35858
augcaggucuccacugcugcccuugcuguccuccucugcaccauggcucucugcaaccaguucucugcaucacuugcugcugacacgccgaccgccugcugcuucagcuacaccucccggcagauuccacagaauuucauagcugacuacuuugagacgagcagccagugcuccaagcccggugucaucuuccuaaccaagcgaagccggcaggucugugcugaccccagugaggaguggguccagaaauaugucagcgaccuggagcugagugccuga

SEQ ID NO: 5019 - RNA, 279 nt, Artificial Sequence; identical to SEQ ID NO: 5011
  derived and/or modified sequence opt1 from CCL3__Homo_sapiens__AAA35858

SEQ ID NO: 5020 - RNA, 279 nt, Artificial Sequence; identical to SEQ ID NO: 5012
  derived and/or modified sequence opt2 from CCL3__Homo_sapiens__AAA35858

SEQ ID NO: 5021 - RNA, 279 nt, Artificial Sequence; identical to SEQ ID NO: 5013
  derived and/or modified sequence opt3 from CCL3__Homo_sapiens__AAA35858

SEQ ID NO: 5022 - RNA, 279 nt, Artificial Sequence; identical to SEQ ID NO: 5014
  derived and/or modified sequence opt4 from CCL3__Homo_sapiens__AAA35858

SEQ ID NO: 5023 - RNA, 279 nt, Artificial Sequence; identical to SEQ ID NO: 5015
  derived and/or modified sequence opt5 from CCL3__Homo_sapiens__AAA35858

SEQ ID NO: 5024 - RNA, 279 nt, Artificial Sequence
  derived and/or modified sequence opt6 from CCL3__Homo_sapiens__AAA35858
augcaaguaucaacagcagcacuagcaguacuacuaugcacaauggcacuaugcaaccaauucucagcaucacuagcagcagacacaccaacagcaugcugcuucucauacacaucaagacaaauaccacaaaacuucauagcagacuacuucgaaacaucaucacaaugcucaaaaccaggaguaauauucuuaacaaaaagaucaagacaaguaugcgcagacccaucagaagaauggguacaaaaauacguaucagaccuagaacuaucagcauaa

SEQ ID NO: 5025 - protein, 92 aa, Artificial Sequence
  CCL4__Homo_sapiens__P13236
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 5026 - RNA, 279 nt, Artificial Sequence
  CCL4__Homo_sapiens__AAA51576
augaagcucugcgugacuguccugucucuccucaugcuaguagcugccuucugcucuccagcgcucucagcaccaaugggcucagacccucccaccgccugcugcuuuucuuacaccgcgaggaagcuuccucgcaacuuugugguagauuacuaugagaccagcagccucugcucccagccagcugugguauuccaaaccaaaagaagcaagcaagucugugcugaucccagugaauccuggguccaggaguacguguaugaccuggaacugaacuga

SEQ ID NO: 5027 - RNA, 279 nt, Artificial Sequence
  derived and/or modified sequence opt1 from CCL4__Homo_sapiens__AAA51576
augaagcugugcgugaccguccucagccugcugaugcucguggccgccuucugcucccccgcgcugagcgccccgaugggcuccgacccgcccaccgccugcugcuucagcuacacggcccgcaagcugccccggaacuucguggucgacuacuacgagaccuccagccucugcucccagcccgccgugguguuccagaccaagcgcagcaagcaggucugcgcggaccccuccgagagcugggugcaggaguacguguacgaccuggagcugaacuga

SEQ ID NO: 5028 - RNA, 279 nt, Artificial Sequence
  derived and/or modified sequence opt2 from CCL4__Homo_sapiens__AAA51576
augaagcucugcgucaccguccucucccuccucaugcucgucgccgccuucugcucccccgcccucuccgcccccaugggcuccgacccccccaccgccugcugcuucuccuacaccgcccgcaagcucccccgcaacuucgucgucgacuacuacgagaccuccucccucugcucccagcccgccgucgucuuccagaccaagcgcuccaagcaggucugcgccgaccccuccgaguccuggguccaggaguacgucuacgaccucgagcucaacuga

SEQ ID NO: 5029 - RNA, 279 nt, Artificial Sequence
  derived and/or modified sequence opt3 from CCL4__Homo_sapiens__AAA51576
augaagcugugcgugaccguccucagccuucugauguugguugccgcuuucuguucccccgcauuaucugccccuaugggcucagacccaccgacagcgugcuguuuuaguuacacugcuagaaaacugcccaggaacuucgugguagauuauuacgagacgagcucccuaugcucucagccugccguggucuuucaaaccaagcggucgaaacaggugugugcagacccaucagaaagcuggguucaggaguauguguacgaucucgaacugaauuga

SEQ ID NO: 5030 - RNA, 279 nt, Artificial Sequence
  derived and/or modified sequence opt4 from CCL4__Homo_sapiens__AAA51576
augaagcugugcgugaccgugcugagccugcugaugcugguggccgccuucugcagccccgcccugagcgcccccaugggcagcgacccccccaccgccugcugcuucagcuacaccgccagaaagcugcccagaaacuucgugguggacuacuacgagaccagcagccugugcagccagcccgccgugguguuccagaccaagagaagcaagcaggugugcgccgaccccagcgagagcugggugcaggaguacguguacgaccuggagcugaacuga

SEQ ID NO: 5031 - RNA, 279 nt, Artificial Sequence
  derived and/or modified sequence opt5 from CCL4__Homo_sapiens__AAA51576
augaagcugugcgugaccguccucagccugcuuaugcugguugccgcuuucuguucccccgcccucucugcgccuaugggcagcgacccgcccacagcuugcuguuuuuccuacacggccagaaaacugccucggaacuucgugguggauuauuacgagaccucuagccuuugcucccagcccgccgucguguuucaaacaaagcgcucuaaacagguuugugcugacccuagcgaauccugggugcaggaguaugucuacgaucuggaacucaauuga

SEQ ID NO: 5032 - RNA, 279 nt, Artificial Sequence
  derived and/or modified sequence opt6 from CCL4__Homo_sapiens__AAA51576
augaaacuaugcguaacaguacuaucacuacuaaugcuaguagcagcauucugcucaccagcacuaucagcaccaaugggaucagacccaccaacagcaugcugcuucucauacacagcaagaaaacuaccaagaaacuucguaguagacuacuacgaaacaucaucacuaugcucacaaccagcaguaguauuccaaacaaaaagaucaaaacaaguaugcgcagacccaucagaaucauggguacaagaauacguauacgaccuagaacuaaacuaa

SEQ ID NO: 5033 - protein, 52 aa, Artificial Sequence
  CCL4__Homo_sapiens__Q7M4M2
MKLCVTVLSLLMLVAAFCSPALSAPNSKPKEASKSVLIPVNPGSRSTCMTWN

SEQ ID NO: 5034 - RNA, 159 nt, Artificial Sequence
  CCL4__Homo_sapiens__AAX07293
augaagcucugcgugacuguccugucucuccucaugcuaguagcugccuucugcucuccagcgcucucagcaccaaauuccaaaccaaaagaagcaagcaagucugugcugaucccagugaauccuggguccaggaguacguguaugaccuggaacuga

SEQ ID NO: 5035 - RNA, 159 nt, Artificial Sequence
  derived and/or modified sequence opt1 from CCL4__Homo_sapiens__AAX07293
augaagcugugcgugaccguccucagccugcugaugcucguggccgccuucugcucccccgcgcugagcgccccgaacuccaagcccaaggaggccagcaaguccgugcugauccccgucaaccccggcagccgcuccacgugcaugaccuggaacuga

SEQ ID NO: 5036 - RNA, 159 nt, Artificial Sequence
  derived and/or modified sequence opt2 from CCL4__Homo_sapiens__AAX07293
augaagcucugcgucaccguccucucccuccucaugcucgucgccgccuucugcucccccgcccucuccgcccccaacuccaagcccaaggaggccuccaaguccguccucauccccgucaaccccggcucccgcuccaccugcaugaccuggaacuga

SEQ ID NO: 5037 - RNA, 159 nt, Artificial Sequence
  derived and/or modified sequence opt3 from CCL4__Homo_sapiens__AAX07293
augaagcugugcgugaccguccucagccuucugauguugguugccgcuuucuguucccccgcauuaucugccccuaacucaaaaccaaaggaggcgaguaaaagcgugcugaucccgguaaaucccggcuccagaucuacaugcaugacuuggaacuga

SEQ ID NO: 5038 - RNA, 159 nt, Artificial Sequence
  derived and/or modified sequence opt4 from CCL4__Homo_sapiens__AAX07293
augaagcugugcgugaccgugcugagccugcugaugcugguggccgccuucugcagccccgcccugagcgcccccaacagcaagcccaaggaggccagcaagagcgugcugauccccgugaaccccggcagcagaagcaccugcaugaccuggaacuga

SEQ ID NO: 5039 - RNA, 159 nt, Artificial Sequence
  derived and/or modified sequence opt5 from CCL4__Homo_sapiens__AAX07293
augaagcugugcgugaccguccucagccugcuuaugcugguugccgcuuucuguucccccgcccucucugcgccuaacagcaaaccgaaggaggcuuccaaaucugugcugauccccgugaauccuggcagcagauccacaugcaugacguggaacuga

SEQ ID NO: 5040 - RNA, 159 nt, Artificial Sequence
  derived and/or modified sequence opt6 from CCL4__Homo_sapiens__AAX07293
augaaacuaugcguaacaguacuaucacuacuaaugcuaguagcagcauucugcucaccagcacuaucagcaccaaacucaaaaccaaaagaagcaucaaaaucaguacuaauaccaguaaacccaggaucaagaucaacaugcaugacauggaacuaa

SEQ ID NO: 5041 - protein, 91 aa, Artificial Sequence
  CCL5__Homo_sapiens__D0EI67
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 5042 - RNA, 276 nt, Artificial Sequence
  CCL5__Homo_sapiens__ACW84342
augaaggucuccgcggcagcccucgcugucauccucauugcuacugcccucugcgcuccugcaucugccuccccauauuccucggacaccacacccugcugcuuugccuacauugcccgcccacugccccgugcccacaucaaggaguauuucuacaccaguggcaagugcuccaacccagcagucgucuuugucacccgaaagaaccgccaagugugugccaacccagagaagaaauggguucgggaguacaucaacucuuuggagaugagcuag

SEQ ID NO: 5043 - RNA, 276 nt, Artificial Sequence
  derived and/or modified sequence opt1 from CCL5__Homo_sapiens__ACW84342
augaaggugagcgccgccgcgcuggccgucauccucaucgccaccgcccugugcgcccccgcguccgccagcccguacuccagcgacaccacgcccugcugcuucgccuacaucgcccgcccccugccccgggcgcacaucaaggaguacuucuacaccuccggcaagugcagcaacccggccgugguguucgucacccgcaagaaccgccaggugugcgccaaccccgagaagaagugggugcgggaguacaucaacucccucgagaugagcuga

SEQ ID NO: 5044 - RNA, 276 nt, Artificial Sequence
  derived and/or modified sequence opt2 from CCL5__Homo_sapiens__ACW84342
augaaggucuccgccgccgcccucgccgucauccucaucgccaccgcccucugcgcccccgccuccgccucccccuacuccuccgacaccacccccugcugcuucgccuacaucgcccgcccccucccccgcgcccacaucaaggaguacuucuacaccuccggcaagugcuccaaccccgccgucgucuucgucacccgcaagaaccgccaggucugcgccaaccccgagaagaaguggguccgcgaguacaucaacucccucgagauguccuga

SEQ ID NO: 5045 - RNA, 276 nt, Artificial Sequence
  derived and/or modified sequence opt3 from CCL5__Homo_sapiens__ACW84342
augaaggugagcgccgcugcacuggccgucauccucauugcgaccgcucuuugcgcccccgcauccgccucuccuuacucaagugacacaacuccauguugcuucgcuuauauagcaagaccgcugcccagggcccacaucaaagaguacuuuuauacgagcggcaaguguuccaacccugcuguuguguucguaacccggaaaaaucgccaggugugcgccaacccagaaaagaaauggguccgagaguacauuaauucuuuggaaaugucguga

SEQ ID NO: 5046 - RNA, 276 nt, Artificial Sequence
  derived and/or modified sequence opt4 from CCL5__Homo_sapiens__ACW84342
augaaggugagcgccgccgcccuggccgugauccugaucgccaccgcccugugcgcccccgccagcgccagccccuacagcagcgacaccacccccugcugcuucgccuacaucgccagaccccugcccagagcccacaucaaggaguacuucuacaccagcggcaagugcagcaaccccgccgugguguucgugaccagaaagaacagacaggugugcgccaaccccgagaagaagugggugagagaguacaucaacagccuggagaugagcuga

SEQ ID NO: 5047 - RNA, 276 nt, Artificial Sequence
  derived and/or modified sequence opt5 from CCL5__Homo_sapiens__ACW84342
augaaggugagcgccgcugcccuggcggucauccucauugcuaccgcccugugcgcccccgcuuccgccucuccuuacagcuccgacacaacgccguguugcuucgcuuauaucgccagaccccuuccucgggcgcacauuaaagaguacuuuuauaccucuggcaaguguagcaaccccgccguuguguucgugacacgcaaaaauagacaggucugcgcuaacccugaaaagaaaugggugcgggaguacaucaauucccuggaaaugucuuga

SEQ ID NO: 5048 - RNA, 276 nt, Artificial Sequence
  derived and/or modified sequence opt6 from CCL5__Homo_sapiens__ACW84342
augaaaguaagcgcagcagcacuagcaguaauacuaauagcaacagcauuaugcgcaccagcaagcgcaagcccauacucaagcgauacaacaccauguugcuuugcauauauagcaagaccacuaccaagagcacacauaaaagaauacuuuuacacaagcggaaaauguagcaauccagcaguaguauucguaacaagaaaaaauagacaaguaugugcaaauccagaaaaaaaauggguaagagaauacauaaacucacuagaaaugucauaa

SEQ ID NO: 5049 - protein, 91 aa, Artificial Sequence; identical to SEQ ID NO: 5041
  CCL5__Homo_sapiens__P13501

SEQ ID NO: 5050 - RNA, 276 nt, Artificial Sequence; identical to SEQ ID NO: 5042
  CCL5__Homo_sapiens__AAC03541

SEQ ID NO: 5051 - RNA, 276 nt, Artificial Sequence; identical to SEQ ID NO: 5043
  derived and/or modified sequence opt1 from CCL5__Homo_sapiens__AAC03541

SEQ ID NO: 5052 - RNA, 276 nt, Artificial Sequence; identical to SEQ ID NO: 5044
  derived and/or modified sequence opt2 from CCL5__Homo_sapiens__AAC03541

SEQ ID NO: 5053 - RNA, 276 nt, Artificial Sequence; identical to SEQ ID NO: 5045
  derived and/or modified sequence opt3 from CCL5__Homo_sapiens__AAC03541

SEQ ID NO: 5054 - RNA, 276 nt, Artificial Sequence; identical to SEQ ID NO: 5046
  derived and/or modified sequence opt4 from CCL5__Homo_sapiens__AAC03541

SEQ ID NO: 5055 - RNA, 276 nt, Artificial Sequence; identical to SEQ ID NO: 5047
  derived and/or modified sequence opt5 from CCL5__Homo_sapiens__AAC03541

SEQ ID NO: 5056 - RNA, 276 nt, Artificial Sequence
  derived and/or modified sequence opt6 from CCL5__Homo_sapiens__AAC03541
augaaaguaagcgcagcagcacucgcaguaauacuaauagcaacagcauuaugcgcaccagcaagcgcaagcccauacucaagcgauacaacaccauguugcuuugcauauauagcaagaccacuaccaagagcacacauaaaagaauacuuuuacacaagcggaaaauguagcaauccagcaguaguauucguaacaagaaaaaauagacaaguaugugcaaauccagaaaaaaaauggguaagagaauacauaaacucacuagaaaugucauaa

SEQ ID NO: 5057 - protein, 116 aa, Artificial Sequence
  CCL6__Mus_musculus__P27784
MRNSKTAISFFILVAVLGSQAGLIQEMEKEDRRYNPPIIHQGFQDTSSDCCFSYATQIPCKRFIYYFPTSGGCIKPGIIFISRRGTQVCADPSDRRVQRCLSTLKQGPRSGNKVIA

SEQ ID NO: 5058 - RNA, 351 nt, Artificial Sequence
  CCL6__Mus_musculus__AAA37329
augagaaacuccaagacugccauuucauucuuuauccuuguggcuguccuugggucccaggcuggccucauacaagaaauggaaaaagaagaucgucgcuauaacccuccaauaauucaucaaggcuuucaagacacuucuucagacugcugcuucucuuaugccacacagaucccauguaaaagauuuauauauuauuuccccaccaguggugggugcaucaagccgggcaucaucuuuaucagcaggaggggaacccaggucugugccgaccccagcgaucggagaguucagaggugccuaagcacccugaagcaaggcccaagaucugggaacaaggucauugcuuga

SEQ ID NO: 5059 - RNA, 351 nt, Artificial Sequence
  derived and/or modified sequence opt1 from CCL6__Mus_musculus__AAA37329
augcgcaacagcaagaccgccaucuccuucuucauccugguggccguccucggcagccaggcggggcugauccaggagauggagaaggaggaccggcgcuacaacccgcccaucauccaccagggcuuccaggacaccuccagcgacugcugcuucuccuacgccacgcagauccccugcaagcgguucaucuacuacuuccccaccagcgggggcugcaucaagcccgggaucaucuucaucucccgccggggcacccaggugugcgccgacccgagcgaccgccgggugcagcgcugccuguccacccucaagcagggcccccggagcgggaacaaggucaucgccuga

SEQ ID NO: 5060 - RNA, 351 nt, Artificial Sequence
  derived and/or modified sequence opt2 from CCL6__Mus_musculus__AAA37329
augcgcaacuccaagaccgccaucuccuucuucauccucgucgccguccucggcucccaggccggccucauccaggagauggagaaggaggaccgccgcuacaacccccccaucauccaccagggcuuccaggacaccuccuccgacugcugcuucuccuacgccacccagauccccugcaagcgcuucaucuacuacuuccccaccuccggcggcugcaucaagcccggcaucaucuucaucucccgccgcggcacccaggucugcgccgaccccuccgaccgccgcguccagcgcugccucuccacccucaagcagggcccccgcuccggcaacaaggucaucgccuga

SEQ ID NO: 5061 - RNA, 351 nt, Artificial Sequence
  derived and/or modified sequence opt3 from CCL6__Mus_musculus__AAA37329
augagaaacagcaagaccgccaucuccuucuuuauucugguggcuguccucggcucucaggcagggcuuauacaagagauggaaaaagaggacaggcgguacaaucccccuaucauucaccagggauuccaggauacaucaagugacugcuguuuuagcuaugccacucagaucccaugcaagcgcuucauuuacuauuuuccgacguccgguggcuguaucaaacccgggauaaucuucauuucucgacguggaacccaaguuugcgcggauccuucggacagaagggugcagcggugucugucaacauugaagcagggcccacgcagcgguaacaaaguaaucgcuuga

SEQ ID NO: 5062 - RNA, 351 nt, Artificial Sequence
  derived and/or modified sequence opt4 from CCL6__Mus_musculus__AAA37329
augagaaacagcaagaccgccaucagcuucuucauccugguggccgugcugggcagccaggccggccugauccaggagauggagaaggaggacagaagauacaacccccccaucauccaccagggcuuccaggacaccagcagcgacugcugcuucagcuacgccacccagauccccugcaagagauucaucuacuacuuccccaccagcggcggcugcaucaagcccggcaucaucuucaucagcagaagaggcacccaggugugcgccgaccccagcgacagaagagugcagagaugccugagcacccugaagcagggccccagaagcggcaacaaggugaucgccuga

SEQ ID NO: 5063 - RNA, 351 nt, Artificial Sequence
  derived and/or modified sequence opt5 from CCL6__Mus_musculus__AAA37329
augagaaacagcaagaccgccaucuccuucuuuauucugguggcuguccucggcucucaggccgggcugauccaagagauggaaaaagaggaccggcgcuacaaucccccuauuauccaccagggauuccaggauacaagcuccgacugcuguuuuucuuaugcgacgcagauuccgugcaagagauucaucuacuauuuucccaccagcggcggguguaucaaaccuggaauuaucuucauuucccggcgcggcacacaaguuugcgcugaucccucugacagacgggugcagcgcugucuuagcacccugaagcaggggccuagauccggaaacaaagugaucgccuga

SEQ ID NO: 5064 - RNA, 351 nt, Artificial Sequence
  derived and/or modified sequence opt6 from CCL6__Mus_musculus__AAA37329
augagaaacucaaaaacagcaauaucauucuucauacuaguagcaguacuaggaucacaagcaggacuaauacaagaaauggaaaaagaagacagaagauacaacccaccaauaauacaccaaggauuccaagacacaucaucagacugcugcuucucauacgcaacacaaauaccaugcaaaagauucauauacuacuucccaacaucaggaggaugcauaaaaccaggaauaauauucauaucaagaagaggaacacaaguaugcgcagacccaucagacagaagaguacaaagaugccuaucaacacuaaaacaaggaccaagaucaggaaacaaaguaauagcauaa

SEQ ID NO: 5065 - protein, 99 aa, Artificial Sequence
  CCL7__Homo_sapiens__P80098
MKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 5066 - RNA, 300 nt, Artificial Sequence
  CCL7__Homo_sapiens__AAH92436
augaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcuuuga

SEQ ID NO: 5067 - RNA, 300 nt, Artificial Sequence
  derived and/or modified sequence opt1 from CCL7__Homo_sapiens__AAH92436
augaaggccagcgccgcgcugcucugccugcugcucaccgccgccgccuucagcccccagggccuggcccagccgguggggaucaacaccuccacgaccugcugcuaccgcuucaucaacaagaagauccccaagcagcggcuggaguccuaccgccggaccaccagcucccacugcccccgcgaggcggucaucuucaagacgaagcucgacaaggagaucugcgccgaccccacccagaagugggugcaggacuucaugaagcaccuggacaagaagacccagaccccgaagcuguga

SEQ ID NO: 5068 - RNA, 300 nt, Artificial Sequence
  derived and/or modified sequence opt2 from CCL7__Homo_sapiens__AAH92436
augaaggccuccgccgcccuccucugccuccuccucaccgccgccgccuucuccccccagggccucgcccagcccgucggcaucaacaccuccaccaccugcugcuaccgcuucaucaacaagaagauccccaagcagcgccucgaguccuaccgccgcaccaccuccucccacugcccccgcgaggccgucaucuucaagaccaagcucgacaaggagaucugcgccgaccccacccagaaguggguccaggacuucaugaagcaccucgacaagaagacccagacccccaagcucuga

SEQ ID NO: 5069 - RNA, 300 nt, Artificial Sequence
  derived and/or modified sequence opt3 from CCL7__Homo_sapiens__AAH92436
augaaggccagcgcugcacugcucugccuucuguugaccgccgcggcuuucucuccccagggcuuagcccaaccuguggggaucaacacauccacuacguguugcuacagauuuauuaauaaaaagauaccaaaacagaggcuggagucauaucggcgcaccacaaguagccacuguccgcgagaagcagucaucuucaagacuaaacuagacaaggagauuugcgccgaucccacccagaaguggguucaggacuuuaugaaacaucucgauaagaaaacacaaaccccuaagcuguga

SEQ ID NO: 5070 - RNA, 300 nt, Artificial Sequence
  derived and/or modified sequence opt4 from CCL7__Homo_sapiens__AAH92436
augaaggccagcgccgcccugcugugccugcugcugaccgccgccgccuucagcccccagggccuggcccagcccgugggcaucaacaccagcaccaccugcugcuacagauucaucaacaagaagauccccaagcagagacuggagagcuacagaagaaccaccagcagccacugccccagagaggccgugaucuucaagaccaagcuggacaaggagaucugcgccgaccccacccagaagugggugcaggacuucaugaagcaccuggacaagaagacccagacccccaagcuguga

SEQ ID NO: 5071 - RNA, 300 nt, Artificial Sequence
  derived and/or modified sequence opt5 from CCL7__Homo_sapiens__AAH92436
augaaggccagcgcugcccugcucugccugcuucugaccgcggcugccuucucuccccagggccucgcccaaccuguggggaucaacacauccacgaccuguugcuacagauuuauuaauaaaaagaucccgaaacagcggcuggagagcuaucgcagaacaaccuccucucacuguccccgggaagcugucauuuucaagacaaaacuugacaaggagaucugcgccgauccuacccagaaguggguucaggacuuuaugaaacaucuggauaagaaaacacaaacccccaagcucuga

SEQ ID NO: 5072 - RNA, 300 nt, Artificial Sequence
  derived and/or modified sequence opt6 from CCL7__Homo_sapiens__AAH92436
augaaagcaucagcagcacuacuaugccuauuacuaacagcagcagcauucucaccacaaggacuagcacaaccaguaggaauaaacacaucaacaacaugcugcuacagauucauaaacaaaaaaauaccaaaacaaagacuagaaucauacagaagaacaacaucaucacacugcccaagagaagcaguaauauucaaaacaaaacuagacaaagaaauaugcgcagacccaacacaaaaauggguacaagacuucaugaaacaccuagacaaaaaaacacaaacaccaaaacuauaa

SEQ ID NO: 5073 - protein, 109 aa, Artificial Sequence
  CCL7__Homo_sapiens__Q7Z7Q8
MWKPMPSPSNMKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 5074 - RNA, 330 nt, Artificial Sequence
  CCL7__Homo_sapiens__EAW80210
auguggaagcccaugcccucacccuccaacaugaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcuuuga

SEQ ID NO: 5075 - RNA, 330 nt, Artificial Sequence
  derived and/or modified sequence opt1 from CCL7__Homo_sapiens__EAW80210
auguggaagcccaugccgagccccuccaacaugaaggccagcgccgcgcugcucugccugcugcucaccgccgccgccuucagcccccagggccuggcccagcccguggggaucaacaccuccacgaccugcugcuaccgcuucaucaacaagaagaucccgaagcagcggcuggaguccuaccgccggaccaccagcucccacugcccccgcgaggcggucaucuucaagacgaagcucgacaaggagaucugcgccgaccccacccagaagugggugcaggacuucaugaagcaccuggacaagaagacccagacccccaagcuguga

SEQ ID NO: 5076 - RNA, 330 nt, Artificial Sequence
  derived and/or modified sequence opt2 from CCL7__Homo_sapiens__EAW80210
auguggaagcccaugcccucccccuccaacaugaaggccuccgccgcccuccucugccuccuccucaccgccgccgccuucuccccccagggccucgcccagcccgucggcaucaacaccuccaccaccugcugcuaccgcuucaucaacaagaagauccccaagcagcgccucgaguccuaccgccgcaccaccuccucccacugcccccgcgaggccgucaucuucaagaccaagcucgacaaggagaucugcgccgaccccacccagaaguggguccaggacuucaugaagcaccucgacaagaagacccagacccccaagcucuga

SEQ ID NO: 5077 - RNA, 330 nt, Artificial Sequence
  derived and/or modified sequence opt3 from CCL7__Homo_sapiens__EAW80210
auguggaagcccaugccuagcccauccaacaugaaagccucugcugcacugcucugccuucuguugaccgccgcggcuuucucaccgcagggcuuagcccaacccguggggaucaauacaaguacuacguguugcuacagauuuauuaacaagaaaauaccuaagcagaggcuggagagcuaucggcgcaccacauccucucacuguccacgagaagcagucaucuucaaaacuaagcuagacaaggagauuugcgccgaucccacccagaaauggguucaggacuuuaugaagcaucucgauaaaaagacacaaaccccuaaacuguga

SEQ ID NO: 5078 - RNA, 330 nt, Artificial Sequence
  derived and/or modified sequence opt4 from CCL7__Homo_sapiens__EAW80210
auguggaagcccaugcccagccccagcaacaugaaggccagcgccgcccugcugugccugcugcugaccgccgccgccuucagcccccagggccuggcccagcccgugggcaucaacaccagcaccaccugcugcuacagauucaucaacaagaagauccccaagcagagacuggagagcuacagaagaaccaccagcagccacugccccagagaggccgugaucuucaagaccaagcuggacaaggagaucugcgccgaccccacccagaagugggugcaggacuucaugaagcaccuggacaagaagacccagacccccaagcuguga

SEQ ID NO: 5079 - RNA, 330 nt, Artificial Sequence
  derived and/or modified sequence opt5 from CCL7__Homo_sapiens__EAW80210
auguggaagcccaugccuagcccguccaacaugaaagccucugcugcccugcucugccugcuucugaccgcggcugccuucagcccccagggccucgcccaaccuguggggaucaauacauccacgaccuguugcuacagauuuauuaacaagaaaauccccaagcagcggcuggagucuuaucgcagaacaaccagcucccacuguccucgggaagcugucauuuucaaaacaaaacuugacaaggagaucugcgccgaucccacccagaaguggguucaggacuuuaugaagcaucuggauaaaaagacacaaaccccuaaacucuga

SEQ ID NO: 5080 - RNA, 330 nt, Artificial Sequence
  derived and/or modified sequence opt6 from CCL7__Homo_sapiens__EAW80210
auguggaaaccaaugccaucaccaucaaacaugaaagcaucagcagcacuacuaugccuacuacuaacagcagcagcauucucaccacaaggacuagcacaaccaguaggaauaaacacaucaacaacaugcugcuacagauucauaaacaaaaaaauaccaaaacaaagacuagaaucauacagaagaacaacaucaucacacugccccagagaagcaguaauauucaaaacaaaacuagacaaagaaauaugcgcagacccaacacaaaaauggguacaagacuucaugaaacaccuagacaaaaaaacacaaacaccaaaacuauaa

SEQ ID NO: 5081 - protein, 109 aa, Artificial Sequence
  CCL8__Homo_sapiens__H0UIC7
MLKLTPLPSKMKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 5082 - RNA, 330 nt, Artificial Sequence
  CCL8__Homo_sapiens__EAW80207
augcugaagcucacacccuugcccuccaagaugaagguuucugcagcgcuucugugccugcugcucauggcagccacuuucagcccucagggacuugcucagccagauucaguuuccauuccaaucaccugcugcuuuaacgugaucaauaggaaaauuccuauccagaggcuggagagcuacacaagaaucaccaacauccaaugucccaaggaagcugugaucuucaagaccaaacggggcaaggaggucugugcugaccccaaggagagaugggucagggauuccaugaagcaucuggaccaaauauuucaaaaucugaagccauga

SEQ ID NO: 5083 - RNA, 330 nt, Artificial Sequence
  derived and/or modified sequence opt1 from CCL8__Homo_sapiens__EAW80207
augcugaagcucaccccgcugcccagcaagaugaagguguccgccgcccugcucugccugcugcucauggcggccaccuucagcccccagggccuggcccagcccgacuccgucagcauccccaucacgugcugcuucaacgugaucaaccgcaagaucccgauccagcggcuggaguccuacacccgcaucaccaacauccagugccccaaggaggccgugaucuucaagaccaagcgggggaaggaggucugcgccgaccccaaggagcgcugggugcgggacagcaugaagcaccucgaccagaucuuccagaaccugaagcccuga

SEQ ID NO: 5084 - RNA, 330 nt, Artificial Sequence
  derived and/or modified sequence opt2 from CCL8__Homo_sapiens__EAW80207
augcucaagcucaccccccuccccuccaagaugaaggucuccgccgcccuccucugccuccuccucauggccgccaccuucuccccccagggccucgcccagcccgacuccgucuccauccccaucaccugcugcuucaacgucaucaaccgcaagauccccauccagcgccucgaguccuacacccgcaucaccaacauccagugccccaaggaggccgucaucuucaagaccaagcgcggcaaggaggucugcgccgaccccaaggagcgcuggguccgcgacuccaugaagcaccucgaccagaucuuccagaaccucaagcccuga

SEQ ID NO: 5085 - RNA, 330 nt, Artificial Sequence
  derived and/or modified sequence opt3 from CCL8__Homo_sapiens__EAW80207
augcugaagcucacaccccuuccuagcaaaaugaagguguccgccgcucuguugugcuuacugcuaauggcagccaccuucucuccacagggccucgcgcaaccggacucagucaguauccccauuacuuguugcuuuaacguuauaaauagaaaaaucccuauucagaggcuggagagcuacacgcggaucaccaacauucaguguccaaaggaagcugugaucuucaaaacaaagcgcgggaaggagguaugcgccgaucccaaagaacgaugggugcgugacuccaugaagcaccuugaucagauauuucaaaaucugaaaccuuga

SEQ ID NO: 5086 - RNA, 330 nt, Artificial Sequence
  derived and/or modified sequence opt4 from CCL8__Homo_sapiens__EAW80207
augcugaagcugaccccccugcccagcaagaugaaggugagcgccgcccugcugugccugcugcugauggccgccaccuucagcccccagggccuggcccagcccgacagcgugagcauccccaucaccugcugcuucaacgugaucaacagaaagauccccauccagagacuggagagcuacaccagaaucaccaacauccagugccccaaggaggccgugaucuucaagaccaagagaggcaaggaggugugcgccgaccccaaggagagaugggugagagacagcaugaagcaccuggaccagaucuuccagaaccugaagcccuga

SEQ ID NO: 5087 - RNA, 330 nt, Artificial Sequence
  derived and/or modified sequence opt5 from CCL8__Homo_sapiens__EAW80207
augcugaagcucacaccccugccuagcaaaaugaagguguccgccgcccuucugugccuccugcuuauggcugcgaccuucucuccgcagggccuggcucaacccgacagcgucuccaucccuauuacguguugcuuuaacguuaucaauagaaaaauucccauccagcggcucgagucuuacacccgcauuacaaacauccaguguccuaaggaagccgugaucuucaaaaccaagagagggaaggaggugugcgccgaucccaaagaacgguggguccgcgacagcaugaagcaccuggaucagauuuuucaaaaucugaaaccuuga

SEQ ID NO: 5088 - RNA, 330 nt, Artificial Sequence
  derived and/or modified sequence opt6 from CCL8__Homo_sapiens__EAW80207
augcuaaaacuaacaccacuaccaucaaaaaugaaaguaucagcagcacuacuaugccuacuacuaauggcagcaacauucucaccacaaggacuagcacaaccagacucaguaucaauaccaauaacaugcugcuucaacguaauaaacagaaaaauaccaauacaaagacuagaaucauacacaagaauaacaaacauacaaugcccaaaagaagcaguaauauucaaaacaaaaagaggaaaagaaguaugcgcagacccaaaagaaagauggguaagagacucaaugaaacaccuagaccaaauauuccaaaaccuaaaaccauaa

SEQ ID NO: 5089 - protein, 99 aa, Artificial Sequence
  CCL8__Homo_sapiens__P80075
MKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 5090 - RNA, 300 nt, Artificial Sequence
  CCL8__Homo_sapiens__CAA76341
augaagguuucugcagcgcuucugugccugcugcucauggcagccacuuucagcccucagggacuugcucagccagauucaguuuccauuccaaucaccugcugcuuuaacgugaucaauaggaaaauuccuauccagaggcuggagagcuacacaagaaucaccaacauccaaugucccaaggaagcugugaucuucaagaccaaacggggcaaggaggucugugcugaccccaaggagagaugggucagggauuccaugaagcaucuggaccaaauauuucaaaaucugaagccauga

SEQ ID NO: 5091 - RNA, 300 nt, Artificial Sequence
  derived and/or modified sequence opt1 from CCL8__Homo_sapiens__CAA76341
augaaggugagcgccgcccugcucugccugcugcucauggcggccaccuucagcccccagggccuggcccagccggacuccgucuccauccccaucacgugcugcuucaacgugaucaaccgcaagauccccauccagcggcuggagagcuacacccgcaucaccaacauccagugccccaaggaggccgugaucuucaagaccaagcgggggaaggaggucugcgccgacccgaaggagcgcugggugcgggacuccaugaagcaccucgaccagaucuuccagaaccugaagcccuga

SEQ ID NO: 5092 - RNA, 300 nt, Artificial Sequence
  derived and/or modified sequence opt2 from CCL8__Homo_sapiens__CAA76341
augaaggucuccgccgcccuccucugccuccuccucauggccgccaccuucuccccccagggccucgcccagcccgacuccgucuccauccccaucaccugcugcuucaacgucaucaaccgcaagauccccauccagcgccucgaguccuacacccgcaucaccaacauccagugccccaaggaggccgucaucuucaagaccaagcgcggcaaggaggucugcgccgaccccaaggagcgcuggguccgcgacuccaugaagcaccucgaccagaucuuccagaaccucaagcccuga

SEQ ID NO: 5093 - RNA, 300 nt, Artificial Sequence
  derived and/or modified sequence opt3 from CCL8__Homo_sapiens__CAA76341
augaaggugagcgccgcucugcucugccuucuguugauggcagccaccuucucuccccagggcuuagcgcaaccugacuccgucucaaucccaauuacauguugcuuuaacguuauaaauagaaaaaucccgauucagaggcuggagaguuacacucggaucacgaacauucagugucccaaggaagcugugaucuucaaaaccaagcgcgggaaagagguaugcgccgauccuaaggaacgaugggugcgugacagcaugaagcaccuagaucagauauuucaaaaucucaaaccauga

SEQ ID NO: 5094 - RNA, 300 nt, Artificial Sequence
  derived and/or modified sequence opt4 from CCL8__Homo_sapiens__CAA76341
augaaggugagcgccgcccugcugugccugcugcugauggccgccaccuucagcccccagggccuggcccagcccgacagcgugagcauccccaucaccugcugcuucaacgugaucaacagaaagauccccauccagagacuggagagcuacaccagaaucaccaacauccagugccccaaggaggccgugaucuucaagaccaagagaggcaaggaggugugcgccgaccccaaggagagaugggugagagacagcaugaagcaccuggaccagaucuuccagaaccugaagcccuga

SEQ ID NO: 5095 - RNA, 300 nt, Artificial Sequence
  derived and/or modified sequence opt5 from CCL8__Homo_sapiens__CAA76341
augaaggugagcgccgcucugcucugccugcuucugauggccgcgaccuucucuccccagggccucgcucaaccugacuccgucagcaucccgauuacauguugcuuuaacguuaucaauagaaaaauucccauccagcggcuggaguccuacacgcgcauuaccaacauccaguguccuaaggaagccgugaucuucaaaacaaagagagggaaagaggugugcgccgaucccaaggaacgguggguccgcgacucuaugaagcaccuugaucagauuuuucaaaaucugaaaccuuga

SEQ ID NO: 5096 - RNA, 300 nt, Artificial Sequence
  derived and/or modified sequence opt6 from CCL8__Homo_sapiens__CAA76341
augaaaguaucagcagcacuacuaugccuacuacuaauggcagcaacauucucaccacaaggacuagcacaaccagacucaguaucaauaccaauaacaugcugcuucaacguaauaaacagaaaaauaccaauacaaagauuagaaucauacacaagaauaacaaacauacaaugcccaaaagaagcaguaauauucaaaacaaaaagaggaaaagaaguaugcgcagacccaaaagaaagauggguaagagacucaaugaaacaccuagaccaaauauuccaaaacuuaaaaccauaa

SEQ ID NO: 5097 - protein, 122 aa, Artificial Sequence
  CCL9__Mus_musculus__P51670
MKPFHTALSFLILTTALGIWAQITHATETKEVQSSLKAQQGLEIEMFHMGFQDSSDCCLSYNSRIQCSRFIGYFPTSGGCTRPGIIFISKRGFQVCANPSDRRVQRCIERLEQNSQPRTYKQ

SEQ ID NO: 5098 - RNA, 369 nt, Artificial Sequence
  CCL9__Mus_musculus__AAA92583
augaagccuuuucauacugcccucuccuuccucauucuuacaacugcucuuggaaucugggcccagaucacacaugcaacagagacaaaagaaguccagagcagucugaaggcacagcaagggcuugaaauugaaauguuucacaugggcuuucaagacucuucagauugcugccuguccuauaacucacggauucaguguucaagauuuauagguuauuuucccaccagugguggguguaccaggccgggcaucaucuuuaucagcaagaggggguuccaggucugugccaaccccagugaucggagaguucagagaugcauugaaagauuggagcaaaacucacaaccacggaccuacaaacaauaa

SEQ ID NO: 5099 - RNA, 369 nt, Artificial Sequence
  derived and/or modified sequence opt1 from CCL9__Mus_musculus__AAA92583
augaagcccuuccacaccgcccugagcuuccucauccugaccacggcccugggcaucugggcgcagaucacccacgccaccgagaccaaggaggugcaguccagccucaaggcccagcaggggcuggagaucgagauguuccacaugggcuuccaggacuccagcgacugcugccuguccuacaacagccgcauccagugcucccgguucaucggguacuucccgacgagcggcgggugcacccgccccggcaucaucuucaucuccaagcggggcuuccaggucugcgccaaccccagcgaccgccgggugcagcgcugcaucgagcggcucgagcagaacucccagccccgcaccuacaagcaguga

SEQ ID NO: 5100 - RNA, 369 nt, Artificial Sequence
  derived and/or modified sequence opt2 from CCL9__Mus_musculus__AAA92583
augaagcccuuccacaccgcccucuccuuccucauccucaccaccgcccucggcaucugggcccagaucacccacgccaccgagaccaaggagguccaguccucccucaaggcccagcagggccucgagaucgagauguuccacaugggcuuccaggacuccuccgacugcugccucuccuacaacucccgcauccagugcucccgcuucaucggcuacuuccccaccuccggcggcugcacccgccccggcaucaucuucaucuccaagcgcggcuuccaggucugcgccaaccccuccgaccgccgcguccagcgcugcaucgagcgccucgagcagaacucccagccccgcaccuacaagcaguga

SEQ ID NO: 5101 - RNA, 369 nt, Artificial Sequence
  derived and/or modified sequence opt3 from CCL9__Mus_musculus__AAA92583
augaagcccuuccacaccgcccugagcuuucucauccuuacaacugcucugggcauuugggcacagauaacgcaugccaccgagacaaaagaagugcaauccucuuugaaggcgcagcagggguuagagaucgaaauguuccacaugggauuucaggacucaagugauugcugucugagcuacaacuccaggauucaaugcucuagauucaucgguuauuuuccuacuucgggcggguguacccggccaggaauuaucuucauaucaaaacgcggcuuucaggucugcgcuaauccgagcgaccgacguguucagagauguaucgagaggcuagaacagaacagucaaccccggacauacaagcaguga

SEQ ID NO: 5102 - RNA, 369 nt, Artificial Sequence
  derived and/or modified sequence opt4 from CCL9__Mus_musculus__AAA92583
augaagcccuuccacaccgcccugagcuuccugauccugaccaccgcccugggcaucugggcccagaucacccacgccaccgagaccaaggaggugcagagcagccugaaggcccagcagggccuggagaucgagauguuccacaugggcuuccaggacagcagcgacugcugccugagcuacaacagcagaauccagugcagcagauucaucggcuacuuccccaccagcggcggcugcaccagacccggcaucaucuucaucagcaagagaggcuuccaggugugcgccaaccccagcgacagaagagugcagagaugcaucgagagacuggagcagaacagccagcccagaaccuacaagcaguga

SEQ ID NO: 5103 - RNA, 369 nt, Artificial Sequence
  derived and/or modified sequence opt5 from CCL9__Mus_musculus__AAA92583
augaagcccuuccacaccgcccugagcuuucucauccugacaacggcucuuggcauuugggcccagaucacccaugcgacagagaccaaagaagugcaauccucucugaaggcucagcaggggcucgagauugaaauguuccacaugggauuucaggacagcuccgauugcugucugucuuacaacagcagaauccaaugcucccgguucauuggcuauuuuccuacaucugggggauguacccgcccgggcaucaucuucauuagcaaaagaggguuucaggucugcgccaaucccuccgaccggcgcguucagagauguaucgagcggcuugaacagaacagccaaccucgcacauacaagcaguga

SEQ ID NO: 5104 - RNA, 369 nt, Artificial Sequence
  derived and/or modified sequence opt6 from CCL9__Mus_musculus__AAA92583
augaaaccauuccacacagcacuaucauuccuaauacuaacaacagcacuaggaauaugggcacaaauaacacacgcaacagaaacaaaagaaguacaaucaucacuaaaagcacaacaaggacuagaaauagaaauguuccacaugggauuccaagacucaucagacugcugcuuaucauacaacucaagaauacaaugcucaagauucauaggauacuucccaacaucaggaggaugcacaagaccaggaauaauauucauaucaaaaagaggauuccaaguaugcgcaaaccccucagacagaagaguacaaagaugcauagaaagacuagaacaaaacucacaaccaagaacauacaaacaauaa

SEQ ID NO: 5105 - protein, 397 aa, Artificial Sequence
  CX3CL1__Homo_sapiens__A0N0N7
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 5106 - RNA, 1194 nt, Artificial Sequence
  CX3CL1__Homo_sapiens__ABK41928
auggcuccgauaucucugucguggcugcuccgcuuggccaccuucugccaucugacuguccugcuggcuggacagcaccacggugugacgaaaugcaacaucacgugcagcaagaugacaucaaagauaccuguagcuuugcucauccacuaucaacagaaccaggcaucaugcggcaaacgcgcaaucaucuuggagacgagacagcacaggcuguucugugccgacccgaaggagcaaugggucaaggacgcgaugcagcaucuggaccgccaggcugcugcccuaacucgaaauggcggcaccuucgagaagcagaucggcgaggugaagcccaggaccaccccugccgccgggggaauggacgagucugugguccuggagcccgaagccacaggcgaaagcaguagccuggagccgacuccuucuucccaggaagcacagagggcccuggggaccuccccagagcugccgacgggcgugacugguuccucagggaccaggcuccccccgacgccaaaggcucaggauggagggccugugggcacggagcuuuuccgagugccucccgucuccacugccgccacguggcagaguucugcuccccaccaaccugggcccagccucugggcugaggcaaagaccucugaggccccguccacccaggaccccuccacccaggccuccacugcguccuccccagccccagaggagaaugcuccgucugaaggccagcguguguggggucagggacagagccccaggccagagaacucucuggagcgggaggagaugggucccgugccagcgcacacggaugccuuccaggacugggggccuggcagcauggcccacgucucuguggucccugucuccucagaagggacccccagcagggagccaguggcuucaggcagcuggaccccuaaggcugaggaacccauccaugccaccauggacccccagaggcugggcguccuuaucacuccugucccugacgcccaggcugccacccggaggcaggcgguggggcugcuggccuuccuuggccuccucuucugccuggggguggccauguucaccuaccagagccuccagggcugcccucgaaagauggcaggagagauggcggagggccuucgcuacaucccccggagcugugguaguaauucauauguccuggugcccguguga

SEQ ID NO: 5107 - RNA, 1194 nt, Artificial Sequence
  derived and/or modified sequence opt1 from CX3CL1__Homo_sapiens__ABK41928
auggcccccaucagccuguccuggcuccugcgccuggccaccuucugccaccucaccgugcugcuggcgggccagcaccacggggucacgaagugcaacaucacgugcagcaagaugaccuccaagaucccgguggcccuccugauccacuaccagcagaaccaggccagcugcggcaagcgggccaucauccuggagacccgccagcaccgccucuucugcgccgaccccaaggagcagugggugaaggacgcgaugcagcaccuggaccggcaggccgccgcccugacccggaacgggggcaccuucgagaagcagaucggggaggucaagccccgcaccacccccgcggccggcggcauggacgaguccguggugcucgagccggaggccacgggggagagcuccagccuggagcccacccccuccagccaggaggcccagcgggcccugggcaccucccccgagcucccgaccggggucacgggcagcuccgggacccgccugccgcccacccccaaggcgcaggacggcggccccguggggaccgagcuguuccgggugccgcccgucagcacggccgccaccuggcaguccagcgcgccccaccagcccggccccucccucugggccgaggccaagaccagcgaggcccccuccacccaggaccccagcacgcaggccagcaccgccuccagcccggcccccgaggagaacgcgcccuccgaggggcagcgcguguggggccagggccagagcccccggccggagaacucccuggagcgcgaggagauggggcccgugcccgcccacaccgacgccuuccaggacuggggccccgggagcauggcccacgucuccguggugccggucagcuccgagggcacccccagccgggagcccguggccuccgggagcuggacgccgaaggcggaggagcccauccacgccaccauggacccccagcgccugggcgugcucaucacccccgucccggacgcccaggccgcgacccggcgccaggccgugggccugcuggccuuccucgggcugcuguucugccucggcguggccauguucacguaccagucccugcaggggugcccccggaagauggccggcgagauggcggaggggcugcgcuacaucccccggagcugcggcuccaacagcuacguccucgugcccguguga

SEQ ID NO: 5108 - RNA, 1194 nt, Artificial Sequence
  derived and/or modified sequence opt2 from CX3CL1__Homo_sapiens__ABK41928
auggcccccaucucccucuccuggcuccuccgccucgccaccuucugccaccucaccguccuccucgccggccagcaccacggcgucaccaagugcaacaucaccugcuccaagaugaccuccaagauccccgucgcccuccucauccacuaccagcagaaccaggccuccugcggcaagcgcgccaucauccucgagacccgccagcaccgccucuucugcgccgaccccaaggagcagugggucaaggacgccaugcagcaccucgaccgccaggccgccgcccucacccgcaacggcggcaccuucgagaagcagaucggcgaggucaagccccgcaccacccccgccgccggcggcauggacgaguccgucguccucgagcccgaggccaccggcgaguccuccucccucgagcccacccccuccucccaggaggcccagcgcgcccucggcaccucccccgagcuccccaccggcgucaccggcuccuccggcacccgccucccccccacccccaaggcccaggacggcggccccgucggcaccgagcucuuccgcgucccccccgucuccaccgccgccaccuggcaguccuccgccccccaccagcccggccccucccucugggccgaggccaagaccuccgaggcccccuccacccaggaccccuccacccaggccuccaccgccuccucccccgcccccgaggagaacgcccccuccgagggccagcgcgucuggggccagggccaguccccccgccccgagaacucccucgagcgcgaggagaugggccccguccccgcccacaccgacgccuuccaggacuggggccccggcuccauggcccacgucuccgucguccccgucuccuccgagggcacccccucccgcgagcccgucgccuccggcuccuggacccccaaggccgaggagcccauccacgccaccauggacccccagcgccucggcguccucaucacccccguccccgacgcccaggccgccacccgccgccaggccgucggccuccucgccuuccucggccuccucuucugccucggcgucgccauguucaccuaccagucccuccagggcugcccccgcaagauggccggcgagauggccgagggccuccgcuacaucccccgcuccugcggcuccaacuccuacguccucguccccgucuga

SEQ ID NO: 5109 - RNA, 1194 nt, Artificial Sequence
  derived and/or modified sequence opt3 from CX3CL1__Homo_sapiens__ABK41928
auggcccccaucagccuguccuggcuccuuagacuggcuaccuucugccacuugacaguguuacuggcaggccagcaucacggggucacuaaguguaacauuacgugcucuaaaaugaccucaaagauaccuguugcccuacucauccauuaccaacagaaucaggcgaguuguggaaaaagggcuauuauccuggagacacggcagcaccgccuguuuugcgccgacccaaaggaacaaugggugaaagaugcaaugcagcaucuugaccgacaggccgcugcauugacucguaacgguggcaccuucgagaagcagauuggggaaguaaagccgagaacaacccccgccgcuggaggcauggaugagagcgugguccucgaaccugaggccacuggugaguccucuucgcuggaaccaacacccucaagccaagaggcgcagagggcacuggggaccaguccugaacucccaacgggagugacuggcuccucuggcacccgguuacccccuacaccaaaagcccaggacgggggaccgguugguacugagcuguuucgcgugcccccugucagcaccgcugccacauggcaguccucagcaccacaccaacccggcccuagucuuugggcugaggccaagaccagcgaagcgccaucuacgcaggaucccuccacucaggccucaacagcaagcaguccggcuccugaggaaaaugcccccucugaggggcaaagaguguggggacagggccaguccccaaggccugaaaacagcuuggagcgggaggaaaugggucccguaccagcucacaccgacgccuuccaggauugggggcccggaucgauggcacauguuucuguggucccuguguccucagagggcacuccaagucgcgaaccgguggccagcggcuccuggacacccaaagcugaggaaccuauccacgcgaccauggacccacaacgacuggggguccuaauaacgcccguuccugaugcacaggccgcuaccagaaggcaggccgugggacuccuggcauuucuuggucuguuguucugucucggcguagccauguuuacauaucagucucugcaagggugcccacggaagauggcuggagagauggccgagggcuuacguuacaucccccgcagcugugguucaaauaguuaugugcuggucccgguguga

SEQ ID NO: 5110 - RNA, 1194 nt, Artificial Sequence
  derived and/or modified sequence opt4 from CX3CL1__Homo_sapiens__ABK41928
auggcccccaucagccugagcuggcugcugagacuggccaccuucugccaccugaccgugcugcuggccggccagcaccacggcgugaccaagugcaacaucaccugcagcaagaugaccagcaagauccccguggcccugcugauccacuaccagcagaaccaggccagcugcggcaagagagccaucauccuggagaccagacagcacagacuguucugcgccgaccccaaggagcagugggugaaggacgccaugcagcaccuggacagacaggccgccgcccugaccagaaacggcggcaccuucgagaagcagaucggcgaggugaagcccagaaccacccccgccgccggcggcauggacgagagcguggugcuggagcccgaggccaccggcgagagcagcagccuggagcccacccccagcagccaggaggcccagagagcccugggcaccagccccgagcugcccaccggcgugaccggcagcagcggcaccagacugccccccacccccaaggcccaggacggcggccccgugggcaccgagcuguucagagugccccccgugagcaccgccgccaccuggcagagcagcgccccccaccagcccggccccagccugugggccgaggccaagaccagcgaggcccccagcacccaggaccccagcacccaggccagcaccgccagcagccccgcccccgaggagaacgcccccagcgagggccagagaguguggggccagggccagagccccagacccgagaacagccuggagagagaggagaugggccccgugcccgcccacaccgacgccuuccaggacuggggccccggcagcauggcccacgugagcguggugcccgugagcagcgagggcacccccagcagagagcccguggccagcggcagcuggacccccaaggccgaggagcccauccacgccaccauggacccccagagacugggcgugcugaucacccccgugcccgacgcccaggccgccaccagaagacaggccgugggccugcuggccuuccugggccugcuguucugccugggcguggccauguucaccuaccagagccugcagggcugccccagaaagauggccggcgagauggccgagggccugagauacauccccagaagcugcggcagcaacagcuacgugcuggugcccguguga

SEQ ID NO: 5111 - RNA, 1194 nt, Artificial Sequence
  derived and/or modified sequence opt5 from CX3CL1__Homo_sapiens__ABK41928
auggcccccaucagccuguccuggcuccugagacuugcuaccuucugccaccugacagugcuccuggccggccagcaucacggggucacgaaguguaacauuaccugcucuaaaaugacaagcaagaucccuguugcgcuucugauucauuaccaacagaaucaggcuuccuguggaaaacgggccaucauucucgagacccgccagcacagacuguuuugcgccgacccgaaggaacaaugggugaaagaugcuaugcagcaucuggaccggcaggccgcugcccucacacgcaacggcgggaccuucgagaagcagaucggagaagugaagcccagaacaaccccugcggccggcgggauggaugagucugucgugcuggaacccgaggcuacgggagagagcuccucucuugaaccuacccccagcucccaagaggcccagcgggcucugggcacaagcccugaacucccgaccggcguuacagggucuuccggaacccgccugcccccuacgcccaaagcccaggacggcgggccugugggaacagagcuuuuuagagugcccccggucagcaccgcggccacauggcagucuuccgcuccucaccaacccggcccuagccugugggccgaggcuaagaccucugaagcccccuccacccaggaucccagcacacaggccuccacggcuucuagcccugcgccggaggaaaaugcccccuccgaggggcaacggguuuggggacagggccagagcccucgccccgaaaacucucucgagagagaggaaaugggcccugugcccgcucacaccgacgccuuccaggauugggggccgggauccauggcccaugucagcguggugccugucucuagcgagggcacacccucccgggaaccuguugcuucugggagcuggacccccaaagccgaggaaccuauccacgcgacaauggacccccaacgccugggagugcugauuaccccggugccugaugcucaggccgccacgagacggcaggcugucggccuccuggccuuucuugggcuccuguucugucugggaguggcuauguuuacauaucagucccuucaaggcugcccccgcaagauggccggcgagauggcggaggggcugagauacaucccccggagcuguggaucuaauuccuauguucucgugccugucuga

SEQ ID NO: 5112 - RNA, 1194 nt, Artificial Sequence
  derived and/or modified sequence opt6 from CX3CL1__Homo_sapiens__ABK41928
auggcaccuauaagucucaguuggcuacuacgacucgccacauuuugucauuuaacaguacuacuagcaggacaacaucauggaguaacaaaauguaacauaacaugcucaaaaaugacaucaaaaauaccaguagcauuauuaauacauuaccaacaaaaucaggcuucauguggaaaacgagcaauaauacuagaaacacgucaacauagacuuuuuugugcagauccaaaagaacaaugggucaaagacgcaaugcaacauuuagauagacaagcagcagcacuaacaagaaacggcggaacauuugaaaaacaaauaggagaaguaaaaccuagaacaacaccagcagcagguggcauggaugaaucuguaguacuagaaccagaagcaacaggagaaucaucaaguuuagaaccaacaccaaguucucaagaagcacaaagagcccuaggaacaaguccagaacuaccaacaggaguaacaggaaguucaggaacaagacuuccaccaacuccuaaagcacaagauggaggaccaguagguacagaacuauucagaguaccaccaguaucaacagcugcaacauggcaaucaagugccccucaccaaccagggccaucacuaugggcugaagcgaaaacuucagaagcaccuucuacacaagacccuucuacucaagcaucaaccgcauccagcccagcaccagaagaaaacgcaccaucggaaggucaaagaguauggggacaaggacaaucaccaagacccgaaaacucacuagaaagagaagaaaugggaccagucccagcacauacugaugcuuuucaagauuggggaccaggaagcauggcccauguaucagucguaccaguaucaagugaaggaacaccaagcagagaaccaguagcaaguggaucauggaccccuaaagcugaagaaccaauacaugcuacaauggacccacaaagauuaggaguauuaauuacaccuguucccgaugcacaagccgcaacuagaagacaagcaguuggacucuuagcauuuuugggauuacucuucuguuuaggaguagcuauguuuacauaucaaucauuacaaggauguccacgaaaaauggcaggcgaaauggcagaaggauuaagauauauacccagaucaugugguucaaauucauacguauuaguaccaguauaa

SEQ ID NO: 5113 - protein, 397 aa, Artificial Sequence; identical to SEQ ID NO: 5105
  CX3CL1__Homo_sapiens__P78423

SEQ ID NO: 5114 - RNA, 1194 nt, Artificial Sequence; identical to SEQ ID NO: 5106
  CX3CL1__Homo_sapiens__AAB49679

SEQ ID NO: 5115 - RNA, 1194 nt, Artificial Sequence; identical to SEQ ID NO: 5107
  derived and/or modified sequence opt1 from CX3CL1__Homo_sapiens__AAB49679

SEQ ID NO: 5116 - RNA, 1194 nt, Artificial Sequence; identical to SEQ ID NO: 5108
  derived and/or modified sequence opt2 from CX3CL1__Homo_sapiens__AAB49679

SEQ ID NO: 5117 - RNA, 1194 nt, Artificial Sequence; identical to SEQ ID NO: 5109
  derived and/or modified sequence opt3 from CX3CL1__Homo_sapiens__AAB49679

SEQ ID NO: 5118 - RNA, 1194 nt, Artificial Sequence; identical to SEQ ID NO: 5110
  derived and/or modified sequence opt4 from CX3CL1__Homo_sapiens__AAB49679

SEQ ID NO: 5119 - RNA, 1194 nt, Artificial Sequence; identical to SEQ ID NO: 5111
  derived and/or modified sequence opt5 from CX3CL1__Homo_sapiens__AAB49679

SEQ ID NO: 5120 - RNA, 1194 nt, Artificial Sequence
  derived and/or modified sequence opt6 from CX3CL1__Homo_sapiens__AAB49679
auggcaccaauuucacuaagcuggcuauuaagauuagcaacauuuugucauuuaaccguacuacucgcaggacaacaucacggaguaacaaaaugcaacauaacauguucuaaaaugacaucuaaaauaccaguagcacuuuuaauacacuaucaacaaaaucaagcaucauguggaaaacgcgcaauaauacuagaaaccagacaacaucguuuauuuugcgcagacccaaaagaacaauggguaaaagaugcaaugcaacauuuagauagacaagcagcagcauuaacaagaaauggagguacauuugaaaaacaaauaggagaaguaaaaccuagaacaacaccugcagcaggaggcauggaugaaucaguaguauuagaaccagaagcaacaggcgaaaguaguucauuagaaccaacaccaaguagucaagaagcacaaagagcauuaggaacaucaccagaauuaccaaccggcguaacgggaucgucaggaacacguuuaccaccaacaccaaaagcacaagauggcggaccaguaggcacagaauuauucagaguuccaccaguuaguacugcagcaaccuggcaaucuagcgccccacaucaaccagguccaucccuaugggcagaagccaaaacaagcgaagcuccaucaacacaagaucccucaacacaagcaucaacagcaaguucucccgcaccagaagaaaaugcuccaagugaaggacagcgaguauggggacaaggacaauccccaagaccagaaaauucuuuagaaagagaagaaaugggaccaguaccagcucauacagaugcauuccaagacuggggaccaggaucaauggcucaugucucuguagucccuguaaguucagaaggaacaccaucaagagaaccaguagcauccggaagcuggacaccaaaagcagaagagccaauacaugcuacaauggauccgcaacgccuaggaguucuaauuacaccuguaccagaugcacaagcagcuacaagacgacaagcaguuggauuacuagcauuuuuaggacuacuauuuugucuaggaguagcaauguucacauaucaaucuuuacaaggauguccaagaaagauggcaggagaaauggcagaaggauuaagauacauacccagauccuguggaaguaacucauauguauuaguaccaguauaa

SEQ ID NO: 5121 - protein, 397 aa, Artificial Sequence [sequence omitted]

SEQ ID NO: 5122 - RNA, 1194 nt, Artificial Sequence
  CX3CL1__Homo_sapiens__CAG33707
auggcuccgauaucucugucguggcugcuccgcuuggccaccuucugccaucugacuguccugcuggcuggacagcaccacggugugacgaaaugcaacaucacgugcagcaagaugacaucaaagauaccuguagcuuugcucauccacuaucaacagaaccaggcaucaugcggcaaacgcgcaaucaucuuggagacgagacagcacaggcuguucugugccgacccgaaggagcaaugggucaaggacgcgaugcagcaucuggaccgccaggcugcugcccuaacucgaaauggcggcaccuucgagaagcagaucggcgaggugaagcccaggaccaccccugccgccgggggaauggacgagucugugguccuggagcccgaagccacaggcgaaagcaguagcccggagccgacuccuucuucccaggaagcacagagggcccuggggaccuccccagagcugccgacgggcgugacugguuccucagggaccaggcuccccccgacgccaaaggcucaggauggagggccugugggcacggagcuuuuccgagugccucccgucuccacugccgccacguggcagaguucugcuccccaccaaccugggcccagccucugggcugaggcaaagaccucugaggccccguccacccaggaccccuccacccaggccuccacugcguccuccccagccccagaggagaaugcuccgucugaaggccagcguguguggggucagggacagagccccaggccagagaacucucuggagcgggaggagaugggucccgugccagcgcacacggaugccuuccaggacugggggccuggcagcauggcccacgucucuguggucccugucuccucagaagggacccccagcagggagccaguggcuucaggcagcuggaccccuaaggcugaggaacccauccaugccaccauggacccccagaggcugggcguccuuaucacuccugucccugacgcccaggcugccacccggaggcaggcgguggggcugcuggccuuccuuggccuccucuucugccuggggguggccauguucaccuaccagagccuccagggcugcccucgaaagauggcaggagagauggcggagggccuucgcuacaucccccggagcugugguaguaauucauauguccuggugcccguuuaa

SEQ ID NO: 5123 - RNA, 1194 nt, Artificial Sequence
  derived and/or modified sequence opt1 from CX3CL1__Homo_sapiens__CAG33707
auggcccccaucagccuguccuggcuccugcgccuggccaccuucugccaccucaccgugcugcuggcgggccagcaccacggggucacgaagugcaacaucacgugcagcaagaugaccuccaagaucccgguggcccuccugauccacuaccagcagaaccaggccagcugcggcaagcgggccaucauccuggagacccgccagcaccgccucuucugcgccgaccccaaggagcagugggugaaggacgcgaugcagcaccuggaccggcaggccgccgcccugacccggaacgggggcaccuucgagaagcagaucggggaggucaagccccgcaccacccccgcggccggcggcauggacgaguccguggugcucgagccggaggccacgggggagagcuccagccccgagcccacccccuccagccaggaggcccagcgggcccugggcaccuccccggagcugcccaccggggucacgggcagcuccgggacccgccucccgcccacccccaaggcgcaggacggcggccccguggggaccgagcuguuccgggugccgcccgucagcacggccgccaccuggcaguccagcgcgccccaccagcccggccccucccugugggccgaggccaagaccagcgaggcccccuccacccaggacccgagcacgcaggccagcaccgccuccagccccgcccccgaggagaacgcgcccuccgaggggcagcgcguguggggccagggccagagcccgcggcccgagaacucccucgagcgcgaggagauggggcccgugcccgcccacaccgacgccuuccaggacuggggcccggggagcauggcccacgucuccguggugcccgucagcuccgagggcacccccagccgggagccgguggccuccgggagcuggacgcccaaggcggaggagcccauccacgccaccauggacccccagcgccugggcgugcugaucaccccgguccccgacgcccaggccgcgacccggcgccaggccgugggccuccuggccuuccuggggcuccuguucugccugggcguggccauguucacguaccagucccuccaggggugcccccggaagauggccggcgagauggcggaggggcugcgcuacaucccccggagcugcggcuccaacagcuacguccuggugccgguguga

SEQ ID NO: 5124 - RNA, 1194 nt, Artificial Sequence
  derived and/or modified sequence opt2 from CX3CL1__Homo_sapiens__CAG33707
auggcccccaucucccucuccuggcuccuccgccucgccaccuucugccaccucaccguccuccucgccggccagcaccacggcgucaccaagugcaacaucaccugcuccaagaugaccuccaagauccccgucgcccuccucauccacuaccagcagaaccaggccuccugcggcaagcgcgccaucauccucgagacccgccagcaccgccucuucugcgccgaccccaaggagcagugggucaaggacgccaugcagcaccucgaccgccaggccgccgcccucacccgcaacggcggcaccuucgagaagcagaucggcgaggucaagccccgcaccacccccgccgccggcggcauggacgaguccgucguccucgagcccgaggccaccggcgaguccuccucccccgagcccacccccuccucccaggaggcccagcgcgcccucggcaccucccccgagcuccccaccggcgucaccggcuccuccggcacccgccucccccccacccccaaggcccaggacggcggccccgucggcaccgagcucuuccgcgucccccccgucuccaccgccgccaccuggcaguccuccgccccccaccagcccggccccucccucugggccgaggccaagaccuccgaggcccccuccacccaggaccccuccacccaggccuccaccgccuccucccccgcccccgaggagaacgcccccuccgagggccagcgcgucuggggccagggccaguccccccgccccgagaacucccucgagcgcgaggagaugggccccguccccgcccacaccgacgccuuccaggacuggggccccggcuccauggcccacgucuccgucguccccgucuccuccgagggcacccccucccgcgagcccgucgccuccggcuccuggacccccaaggccgaggagcccauccacgccaccauggacccccagcgccucggcguccucaucacccccguccccgacgcccaggccgccacccgccgccaggccgucggccuccucgccuuccucggccuccucuucugccucggcgucgccauguucaccuaccagucccuccagggcugcccccgcaagauggccggcgagauggccgagggccuccgcuacaucccccgcuccugcggcuccaacuccuacguccucguccccgucuga

SEQ ID NO: 5125 - RNA, 1194 nt, Artificial Sequence
  derived and/or modified sequence opt3 from CX3CL1__Homo_sapiens__CAG33707
auggcccccaucagccuguccuggcuccuuagacuggcuaccuucugccacuugacaguguuacuggcaggccagcaucacggggucacuaaguguaacauuacgugcucuaaaaugaccucaaagauaccuguugcccuacucauccauuaccaacagaaucaggcgaguuguggaaaaagggcuauuauccuggagacacggcagcaccgccuguuuugcgccgacccaaaggaacaaugggugaaagaugcaaugcagcaucuugaccgacaggccgcugcauugacucguaacgguggcaccuucgagaagcagauuggggaaguaaagccgagaacaacccccgccgcuggaggcauggaugagagcgugguccucgaaccugaggccacuggugaguccucuucgccagaacccacaccuucaagccaagaggcgcagagggcacuggggaccaguccagaacugcccacgggagugacuggcuccucuggcacccggcucccuccaacaccgaaagcccaggacgggggacccguugguacugaguuauuucgcgugccuccagucagcaccgcugccacauggcaguccucagcaccccaccaaccuggcccaagucugugggcugaggccaagaccagcgaagcgcccucuacgcaggauccguccacucaggccucaacagcaagcaguccugcucccgaggaaaaugccccaucugaggggcaaagaguguggggacagggccaguccccuaggcccgaaaacagccuugagcgggaggaaauggguccaguacccgcucacaccgacgccuuccaggauugggggccuggaucgauggcacauguuucuguggucccaguguccucagagggcacuccgagucgcgaacccguggccagcggcuccuggacaccuaaagcugaggaaccaauccacgcgaccauggacccccaacgauuggggguccugauaacgccuguuccagaugcacaggccgcuaccagaaggcaggccgugggacuacucgcauuucugggucuucuguucuguuugggcguagccauguuuacauaucagucucuccaagggugcccccggaagauggcuggagagauggccgagggccugcguuacaucccgcgcagcugugguucaaauaguuauguguuagucccuguguga

SEQ ID NO: 5126 - RNA, 1194 nt, Artificial Sequence
  derived and/or modified sequence opt4 from CX3CL1__Homo_sapiens__CAG33707
auggcccccaucagccugagcuggcugcugagacuggccaccuucugccaccugaccgugcugcuggccggccagcaccacggcgugaccaagugcaacaucaccugcagcaagaugaccagcaagauccccguggcccugcugauccacuaccagcagaaccaggccagcugcggcaagagagccaucauccuggagaccagacagcacagacuguucugcgccgaccccaaggagcagugggugaaggacgccaugcagcaccuggacagacaggccgccgcccugaccagaaacggcggcaccuucgagaagcagaucggcgaggugaagcccagaaccacccccgccgccggcggcauggacgagagcguggugcuggagcccgaggccaccggcgagagcagcagccccgagcccacccccagcagccaggaggcccagagagcccugggcaccagccccgagcugcccaccggcgugaccggcagcagcggcaccagacugccccccacccccaaggcccaggacggcggccccgugggcaccgagcuguucagagugccccccgugagcaccgccgccaccuggcagagcagcgccccccaccagcccggccccagccugugggccgaggccaagaccagcgaggcccccagcacccaggaccccagcacccaggccagcaccgccagcagccccgcccccgaggagaacgcccccagcgagggccagagaguguggggccagggccagagccccagacccgagaacagccuggagagagaggagaugggccccgugcccgcccacaccgacgccuuccaggacuggggccccggcagcauggcccacgugagcguggugcccgugagcagcgagggcacccccagcagagagcccguggccagcggcagcuggacccccaaggccgaggagcccauccacgccaccauggacccccagagacugggcgugcugaucacccccgugcccgacgcccaggccgccaccagaagacaggccgugggccugcuggccuuccugggccugcuguucugccugggcguggccauguucaccuaccagagccugcagggcugccccagaaagauggccggcgagauggccgagggccugagauacauccccagaagcugcggcagcaacagcuacgugcuggugcccguguga

SEQ ID NO: 5127 - RNA, 1194 nt, Artificial Sequence
  derived and/or modified sequence opt5 from CX3CL1__Homo_sapiens__CAG33707
auggcccccaucagccuguccuggcuccugagacuugcuaccuucugccaccugacagugcuccuggccggccagcaucacggggucacgaaguguaacauuaccugcucuaaaaugacaagcaagaucccuguugcgcuucugauucauuaccaacagaaucaggcuuccuguggaaaacgggccaucauucucgagacccgccagcacagacuguuuugcgccgacccgaaggaacaaugggugaaagaugcuaugcagcaucuggaccggcaggccgcugcccucacacgcaacggcgggaccuucgagaagcagaucggagaagugaagcccagaacaaccccugcggccggcgggauggaugagucugucgugcuggaacccgaggcuacgggagagagcuccucuccugaacccaccccuagcucccaagaggcccagcgggcucuuggcacaagcccggaacugcccaccggcguuacagggucuuccggaacccgccucccucccacgccuaaagcccaggacggcgggcccgugggaacagagcuguuuagagucccgccugugagcaccgcggccacauggcagucuuccgcuccccaccaaccuggccccagccuuugggccgaggcuaagaccucugaagcccccuccacccaggauccuagcacacaggccuccacggcuucuagcccggcgcccgaggaaaaugccccuuccgaggggcaacggguuuggggacagggccagagcccccgcccugaaaacucucuggagagagaggaaaugggccccgugccggcucacaccgacgccuuccaggauugggggccuggauccauggcccaugucagcguggugcccgucucuagcgagggcacaccuucccgggaacccguugcuucugggagcuggaccccuaaagccgaggaacccauccacgcgacaauggacccgcaacgccucggagugcugauuaccccugugcccgaugcucaggccgccacgagacggcaggcugucggccugcucgccuuucuggggcuucuguucugucucggaguggcuauguuuacauaucagucccugcaaggcugcccccgcaagauggccggcgagauggcggaggggcuuagauacaucccucggagcuguggaucuaauuccuauguucuggugccggucuga

SEQ ID NO: 5128 - RNA, 1194 nt, Artificial Sequence
  derived and/or modified sequence opt6 from CX3CL1__Homo_sapiens__CAG33707
auggcaccuauaagcuuaagcugguuacuaagauuagcaaccuucugucaucuaacaguuuuacuagcaggacaacaucauggaguaacuaaauguaacauaacauguucaaaaaugacuaguaaaauaccaguagcuuuauuaauacacuaucaacaaaaucaagcaaguuguggcaaaagagcaauaauccuagaaacaagacaacauagauuauucugugcagauccaaaagaacaauggguaaaagaugcaaugcaacauuuagauagacaagcagcagccuuaacuagaaauggagguacauuugaaaaacaaauaggagaaguaaaaccaaggacaacaccugcagcaggaggaauggaugaaucaguaguuuuagaaccagaagccacaggugaaucuucaucaccagaaccaacaccauccucacaagaagcacaaagagcauuaggaacaucaccagaauuacccacaggaguuacagggaguagugguacaagguuaccuccuacaccaaaagcccaagaugguggacccguugguacagaacuuuuuagaguacccccuguaucaacagcagcaacauggcaaucaucagcaccacaucaaccaggaccaucauuaugggcagaagcaaaaacaucagaagcaccuucuacacaagacccaucaacacaagcuucaacagcaucaucuccagcucccgaagaaaacgcuccuucagaaggacaaagaguauggggacaaggacaaucaccaagaccagaaaauucacuugaacgagaagaaaugggaccaguaccagcacacaccgaugcauuucaagauuggggaccaggaaguauggcacauguaaguguaguaccaguaaguucagaagguacaccaucaagagaaccagucgcaucaggaagcuggacaccaaaagcagaagaaccaauacacgcgacaauggacccccaaagacuaggaguauuaauaacaccaguccccgaugcccaagcagcuacaagaagacaagcuguaggccuucuagcuuuucuaggauuauuauuuuguuuggguguugcaauguuuacauaucaauccuuacaaggaugcccacgaaaaauggcaggagaaauggcagaaggacuaagauauauaccccgaucaugcggaucaaauucauacguacuuguaccaguauaa

SEQ ID NO: 5129 - protein, 98 aa, Artificial Sequence
  CXCL10__Homo_sapiens__A0A024RDA4
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 5130 - RNA, 297 nt, Artificial Sequence
  CXCL10__Homo_sapiens__EAX05772
augaaucaaacugccauucugauuugcugccuuaucuuucugacucuaaguggcauucaaggaguaccucucucuagaacuguacgcuguaccugcaucagcauuaguaaucaaccuguuaauccaaggucuuuagaaaaacuugaaauuauuccugcaagccaauuuuguccacguguugagaucauugcuacaaugaaaaagaagggugagaagagaugucugaauccagaaucgaaggccaucaagaauuuacugaaagcaguuagcaaggaaaggucuaaaagaucuccuuaa

SEQ ID NO: 5131 - RNA, 297 nt, Artificial Sequence
  derived and/or modified sequence opt1 from CXCL10__Homo_sapiens__EAX05772
augaaccagaccgccauccugaucugcugccucaucuuccugacccugagcggcauccagggggugccccucucccgcaccguccggugcacgugcaucagcaucuccaaccagccggugaacccccgcagccuggagaagcuggagaucauccccgccucccaguucugcccccggguggagaucaucgcgaccaugaagaagaagggcgagaagcgcugccucaacccggagagcaaggccaucaagaaccugcugaaggccgucuccaaggagcggagcaagcgcucccccuga

SEQ ID NO: 5132 - RNA, 297 nt, Artificial Sequence
  derived and/or modified sequence opt2 from CXCL10__Homo_sapiens__EAX05772
augaaccagaccgccauccucaucugcugccucaucuuccucacccucuccggcauccagggcgucccccucucccgcaccguccgcugcaccugcaucuccaucuccaaccagcccgucaacccccgcucccucgagaagcucgagaucauccccgccucccaguucugcccccgcgucgagaucaucgccaccaugaagaagaagggcgagaagcgcugccucaaccccgaguccaaggccaucaagaaccuccucaaggccgucuccaaggagcgcuccaagcgcucccccuga

SEQ ID NO: 5133 - RNA, 297 nt, Artificial Sequence
  derived and/or modified sequence opt3 from CXCL10__Homo_sapiens__EAX05772
augaaccagaccgccauccugauuugcugucucauauuccuuacacugagcggcauccaaggggugcccuuguccagaacugucaggugcacguguauuucuaucucaaaucagccuguuaacccacggaguuuagagaagcuggaaauuaucccggcuagccaguuuugcccccgcguggagauaaucgcaaccaugaaaaagaaaggagaaaagcgaugucuaaauccugaguccaaagccauuaagaaccuccugaaggcgguaucuaaagaacguucgaagagaucaccauga

SEQ ID NO: 5134 - RNA, 297 nt, Artificial Sequence
  derived and/or modified sequence opt4 from CXCL10__Homo_sapiens__EAX05772
augaaccagaccgccauccugaucugcugccugaucuuccugacccugagcggcauccagggcgugccccugagcagaaccgugagaugcaccugcaucagcaucagcaaccagcccgugaaccccagaagccuggagaagcuggagaucauccccgccagccaguucugccccagaguggagaucaucgccaccaugaagaagaagggcgagaagagaugccugaaccccgagagcaaggccaucaagaaccugcugaaggccgugagcaaggagagaagcaagagaagccccuga

SEQ ID NO: 5135 - RNA, 297 nt, Artificial Sequence
  derived and/or modified sequence opt5 from CXCL10__Homo_sapiens__EAX05772
augaaccagaccgccauccugauuugcugucucaucuuccugacacuuagcggcauucaaggggugccccuguccagaacgguccggugcaccuguaucucuauuagcaaucagccuguuaacccgcgcucccucgagaagcuggaaaucauccccgcuucucaguuuugcccuagaguggagauuaucgccacaaugaaaaagaaaggagaaaagcggugucuuaaucccgagagcaaagcgauuaagaaccugcucaaggcuguguccaaagaacgcucuaagagaagcccuuga

SEQ ID NO: 5136 - RNA, 297 nt, Artificial Sequence
  derived and/or modified sequence opt6 from CXCL10__Homo_sapiens__EAX05772
augaaccaaacagcaauacuaauaugcugccuaauauuccuaacacuaucaggaauacaaggaguaccacuaucaagaacaguaagaugcacaugcauaucaauaucaaaccaaccaguaaacccaagaucacuagaaaaacuagaaauaauaccagcaucacaauucugcccaagaguagaaauaauagcaacaaugaaaaaaaaaggagaaaaaagaugccuaaacccagaaucaaaagcaauaaaaaaccuacuaaaagcaguaucaaaagaaagaucaaaaagaucaccauaa

SEQ ID NO: 5137 - protein, 98 aa, Artificial Sequence; identical to SEQ ID NO: 5129
  CXCL10__Homo_sapiens__P02778

SEQ ID NO: 5138 - RNA, 297 nt, Artificial Sequence; identical to SEQ ID NO: 5130
  CXCL10__Homo_sapiens__AAH10954

SEQ ID NO: 5139 - RNA, 297 nt, Artificial Sequence; identical to SEQ ID NO: 5131
  derived and/or modified sequence opt1 from CXCL10__Homo_sapiens__AAH10954

SEQ ID NO: 5140 - RNA, 297 nt, Artificial Sequence; identical to SEQ ID NO: 5132
  derived and/or modified sequence opt2 from CXCL10__Homo_sapiens__AAH10954

SEQ ID NO: 5141 - RNA, 297 nt, Artificial Sequence; identical to SEQ ID NO: 5133
  derived and/or modified sequence opt3 from CXCL10__Homo_sapiens__AAH10954

SEQ ID NO: 5142 - RNA, 297 nt, Artificial Sequence; identical to SEQ ID NO: 5134
  derived and/or modified sequence opt4 from CXCL10__Homo_sapiens__AAH10954

SEQ ID NO: 5143 - RNA, 297 nt, Artificial Sequence; identical to SEQ ID NO: 5135
  derived and/or modified sequence opt5 from CXCL10__Homo_sapiens__AAH10954

SEQ ID NO: 5144 - RNA, 297 nt, Artificial Sequence
  derived and/or modified sequence opt6 from CXCL10__Homo_sapiens__AAH10954
augaaccaaacagcaauacucauaugcugccuaauauuccuaacacuaucaggaauacaaggaguaccacuaucaagaacaguaagaugcacaugcauaucaauaucaaaccaaccaguaaacccaagaucacuagaaaaacuagaaauaauaccagcaucacaauucugcccacgaguagaaauaauagcaacaaugaaaaaaaaaggagaaaaaagaugccuaaacccagaaucaaaagcaauaaaaaaccuacuaaaagcaguaucaaaagaaagaucaaaacgaucaccauaa

SEQ ID NO: 5145 - protein, 94 aa, Artificial Sequence
  CXCL11__Homo_sapiens__O14625
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 5146 - RNA, 285 nt, Artificial Sequence
  CXCL11__Homo_sapiens__AAC39775
augagugugaagggcauggcuauagccuuggcugugauauugugugcuacaguuguucaaggcuuccccauguucaaaagaggacgcugucuuugcauaggcccugggguaaaagcagugaaaguggcagauauugagaaagccuccauaauguacccaaguaacaacugugacaaaauagaagugauuauuacccugaaagaaaauaaaggacaacgaugccuaaaucccaaaucgaagcaagcaaggcuuauaaucaaaaaaguugaaagaaagaauuuuuaa

SEQ ID NO: 5147 - RNA, 285 nt, Artificial Sequence
  derived and/or modified sequence opt1 from CXCL11__Homo_sapiens__AAC39775
augagcgugaagggcauggccaucgcccuggcggucauccucugcgccaccguggugcagggguuccccauguucaagcgcggccggugccugugcaucgggccgggcgucaaggccgugaagguggccgacaucgagaaggccuccaucauguaccccagcaacaacugcgacaagaucgaggucaucaucacccugaaggagaacaaggggcagcgcugccucaaccccaaguccaagcaggcgcggcugaucaucaagaagguggagcgcaagaacuucuga

SEQ ID NO: 5148 - RNA, 285 nt, Artificial Sequence
  derived and/or modified sequence opt2 from CXCL11__Homo_sapiens__AAC39775
auguccgucaagggcauggccaucgcccucgccgucauccucugcgccaccgucguccagggcuuccccauguucaagcgcggccgcugccucugcaucggccccggcgucaaggccgucaaggucgccgacaucgagaaggccuccaucauguaccccuccaacaacugcgacaagaucgaggucaucaucacccucaaggagaacaagggccagcgcugccucaaccccaaguccaagcaggcccgccucaucaucaagaaggucgagcgcaagaacuucuga

SEQ ID NO: 5149 - RNA, 285 nt, Artificial Sequence
  derived and/or modified sequence opt3 from CXCL11__Homo_sapiens__AAC39775
augagcgugaaaggcauggccaucgcucuggcagucauucucugcgccaccguugugcagggguuccccauguuuaaaagaggaaggugucuuugcauagguccuggcguaaaggcggugaaagucgcugacaucgagaaggccuccauuauguacccaucuaacaauugugauaaaaucgaagugauuaucacacugaaggagaacaaggggcaacggugcuugaauccgaaaucaaagcaggcacgcuuaauaaucaaaaagguugaacgaaagaacuucuga

SEQ ID NO: 5150 - RNA, 285 nt, Artificial Sequence
  derived and/or modified sequence opt4 from CXCL11__Homo_sapiens__AAC39775
augagcgugaagggcauggccaucgcccuggccgugauccugugcgccaccguggugcagggcuuccccauguucaagagaggcagaugccugugcaucggccccggcgugaaggccgugaagguggccgacaucgagaaggccagcaucauguaccccagcaacaacugcgacaagaucgaggugaucaucacccugaaggagaacaagggccagagaugccugaaccccaagagcaagcaggccagacugaucaucaagaagguggagagaaagaacuucuga

SEQ ID NO: 5151 - RNA, 285 nt, Artificial Sequence
  derived and/or modified sequence opt5 from CXCL11__Homo_sapiens__AAC39775
augagcgugaagggcauggccaucgcucuggccgucauucucugcgcgaccguugugcagggguuccccauguuuaaaagaggacggugucugugcaucggcccuggggugaaggcugucaaaguggccgacauugagaaggccuccaucauguacccgucuaacaauugugauaaaauugaaguuaucaucacacuuaaggagaacaagggacaacgcugccugaaucccaaaagcaagcaggcuagacucauuaucaaaaagguggaacggaaaaacuucuga

SEQ ID NO: 5152 - RNA, 285 nt, Artificial Sequence
  derived and/or modified sequence opt6 from CXCL11__Homo_sapiens__AAC39775
augucaguaaaaggaauggcaauagcacuagcaguaauacuaugcgcaacaguaguacaaggauucccaauguucaaaagaggaagaugccuaugcauaggaccaggaguaaaagcaguaaaaguagcagacauagaaaaagcaagcauaauguauccaucaaacaauugcgacaaaauagaaguaauaauaacauuaaaagaaaacaaaggacaaagaugccuaaauccaaaaagcaaacaagcaagacuaauaauaaaaaaaguagaaagaaaaaacuuuuaa

SEQ ID NO: 5153 - protein, 93 aa, Artificial Sequence
  CXCL12__Homo_sapiens__P48061
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 5154 - RNA, 282 nt, Artificial Sequence
  CXCL12__Homo_sapiens__AAA97434
augaacgccaaggucguggucgugcugguccucgugcugaccgcgcucugccucagcgacgggaagcccgucagccugagcuacagaugcccaugccgauucuucgaaagccauguugccagagccaacgucaagcaucucaaaauucucaacacuccaaacugugcccuucagauuguagcccggcugaagaacaacaacagacaagugugcauugacccgaagcuaaaguggauucaggaguaccuggagaaagcuuuaaacaagagguucaagauguga

SEQ ID NO: 5155 - RNA, 282 nt, Artificial Sequence
  derived and/or modified sequence opt1 from CXCL12__Homo_sapiens__AAA97434
augaacgccaagguggucguggugcugguccucgugcugaccgcccugugccucagcgacggcaagcccgugucccugagcuaccgcugcccgugccgguucuucgagucccacgucgcgcgcgccaacgugaagcaccugaagauccucaacacccccaacugcgcccugcagaucguggcccggcugaagaacaacaaccgccaggucugcaucgaccccaagcucaaguggauccaggaguaccuggagaaggcccugaacaagcgguucaagauguga

SEQ ID NO: 5156 - RNA, 282 nt, Artificial Sequence
  derived and/or modified sequence opt2 from CXCL12__Homo_sapiens__AAA97434
augaacgccaaggucgucgucguccucguccucguccucaccgcccucugccucuccgacggcaagcccgucucccucuccuaccgcugccccugccgcuucuucgagucccacgucgcccgcgccaacgucaagcaccucaagauccucaacacccccaacugcgcccuccagaucgucgcccgccucaagaacaacaaccgccaggucugcaucgaccccaagcucaaguggauccaggaguaccucgagaaggcccucaacaagcgcuucaagauguga

SEQ ID NO: 5157 - RNA, 282 nt, Artificial Sequence
  derived and/or modified sequence opt3 from CXCL12__Homo_sapiens__AAA97434
augaacgccaagguggucguugugcugguacucgugcuuaccgcucugugcuugagcgacggcaaacccgucuccuuaucuuacagauguccuugcagguucuuugagucacacguggcacgggccaauguuaagcaucugaaaauccuaaacacaccaaauugugcgcuccagauuguggcucgccugaagaacaauaaccgacaagucugcauagauccgaaacuuaaguggauccaggaauaucuggagaaggccuugaauaaacguuucaagauguga

SEQ ID NO: 5158 - RNA, 282 nt, Artificial Sequence
  derived and/or modified sequence opt4 from CXCL12__Homo_sapiens__AAA97434
augaacgccaagguggugguggugcuggugcuggugcugaccgcccugugccugagcgacggcaagcccgugagccugagcuacagaugccccugcagauucuucgagagccacguggccagagccaacgugaagcaccugaagauccugaacacccccaacugcgcccugcagaucguggccagacugaagaacaacaacagacaggugugcaucgaccccaagcugaaguggauccaggaguaccuggagaaggcccugaacaagagauucaagauguga

SEQ ID NO: 5159 - RNA, 282 nt, Artificial Sequence
  derived and/or modified sequence opt5 from CXCL12__Homo_sapiens__AAA97434
augaacgccaagguggucguugugcuggugcucguccugaccgcucuuugccugagcgacggcaaacccgugucccucucuuacagauguccuugccgguucuuugagagccacguugcccgcgcgaaugugaagcaucugaaaauccuuaacacaccgaauugugcucugcagauugucgccagacucaagaacaauaaccggcaagugugcaucgaucccaaacugaaguggauucaggaauaucuggagaaggcccucaauaaacgcuucaagauguga

SEQ ID NO: 5160 - RNA, 282 nt, Artificial Sequence
  derived and/or modified sequence opt6 from CXCL12__Homo_sapiens__AAA97434
augaacgcaaaaguaguaguaguacuaguacuaguacuaacagcacuaugcuuaagcgacggaaaaccaguaagccuaagcuacagaugcccaugcagauucuucgaaagccacguagcaagagcaaacguaaaacaccuaaaaauacuaaacacaccaaacugcgcacuacaaauaguagcaagacuaaaaaacaacaacagacaaguaugcauagacccaaaacuaaaauggauacaagaauaccuagaaaaagcacuaaacaaaagauucaaaauguaa

SEQ ID NO: 5161 - protein, 62 aa, Artificial Sequence [sequence omitted]

SEQ ID NO: 5162 - RNA, 189 nt, Artificial Sequence
  CXCL13__Homo_sapiens__CCQ42936
auguacacauguauccuuucacacauuugccuugacaaacuucuuucacucacaucuuuuucacugacuuuuuuuguggggggcggggccggggggacucugguaucuaauucuuuaaugauuccuauaaaucuaaugacauucaauaaaguugagcaaacauuuuacuuaaaaaaaaaaaaaaaauaa

SEQ ID NO: 5163 - RNA, 189 nt, Artificial Sequence
  derived and/or modified sequence opt1 from CXCL13__Homo_sapiens__CCQ42936
auguacacgugcauccugagccacaucugccucgacaagcugcugucccucaccagcuucucccugaccuucuucgugggcgggggcgccgggggcacccuggucagcaacucccucaugauccccaucaaccugaugaccuucaacaagguggagcagaccuucuaccugaagaagaagaagaaguga

SEQ ID NO: 5164 - RNA, 189 nt, Artificial Sequence
  derived and/or modified sequence opt2 from CXCL13__Homo_sapiens__CCQ42936
auguacaccugcauccucucccacaucugccucgacaagcuccucucccucaccuccuucucccucaccuucuucgucggcggcggcgccggcggcacccucgucuccaacucccucaugauccccaucaaccucaugaccuucaacaaggucgagcagaccuucuaccucaagaagaagaagaaguga

SEQ ID NO: 5165 - RNA, 189 nt, Artificial Sequence
  derived and/or modified sequence opt3 from CXCL13__Homo_sapiens__CCQ42936
auguacacuugcauccugagccacauuugucucgacaaacuucuguccuugacaucuuucucauuaaccuuuuucgugggcgggggagccgguggcacgcuggucaguaacagccuaaugauacccaucaaucucaugaccuuuaacaagguugagcagacauucuaucugaagaaaaagaaaaaguga

SEQ ID NO: 5166 - RNA, 189 nt, Artificial Sequence
  derived and/or modified sequence opt4 from CXCL13__Homo_sapiens__CCQ42936
auguacaccugcauccugagccacaucugccuggacaagcugcugagccugaccagcuucagccugaccuucuucgugggcggcggcgccggcggcacccuggugagcaacagccugaugauccccaucaaccugaugaccuucaacaagguggagcagaccuucuaccugaagaagaagaagaaguga

SEQ ID NO: 5167 - RNA, 189 nt, Artificial Sequence
  derived and/or modified sequence opt5 from CXCL13__Homo_sapiens__CCQ42936
auguauaccugcauccugagccacauuugucucgacaagcugcuuucccugacaucuuucagccucacguuuuucgugggcgggggagccggcgggacccuggucuccaacucucuuaugauccccauuaaucugaugacauuuaacaaaguugagcagaccuucuaccucaagaaaaagaaaaaguga

SEQ ID NO: 5168 - RNA, 189 nt, Artificial Sequence
  derived and/or modified sequence opt6 from CXCL13__Homo_sapiens__CCQ42936
auguacacaugcauacuaucacacauaugccuagacaaacuacuaucacuaacaucauucucacuaacauucuucguaggaggaggagcaggaggaacacuaguaucaaacucacuaaugauaccaauaaaccuaaugacauucaacaaaguagaacaaacauucuaccuaaaaaaaaaaaaaaaauaa

SEQ ID NO: 5169 - protein, 109 aa, Artificial Sequence
  CXCL13__Homo_sapiens__O43927
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 5170 - RNA, 330 nt, Artificial Sequence
  CXCL13__Homo_sapiens__AAC14402
augaaguucaucucgacaucucugcuucucaugcugcuggucagcagccucucuccaguccaagguguucuggaggucuauuacacaagcuugagguguagauguguccaagagagcucagucuuuaucccuagacgcuucauugaucgaauucaaaucuugccccgugggaaugguuguccaagaaaagaaaucauagucuggaagaagaacaagucaauuguguguguggacccucaagcugaauggauacaaagaaugauggaaguauugagaaaaagaaguucuucaacucuaccaguuccaguguuuaagagaaagauucccuga

SEQ ID NO: 5171 - RNA, 330 nt, Artificial Sequence
  derived and/or modified sequence opt1 from CXCL13__Homo_sapiens__AAC14402
augaaguucaucagcaccucccugcuccugaugcugcucgugagcucccugagccccguccagggcgugcuggagguguacuacaccucccuccgcugccggugcguccaggagagcuccguguucaucccgcgccgguucaucgaccgcauccagauccugccccgggggaacggcugcccccgcaaggagaucaucguguggaagaagaacaagagcaucgucugcguggacccccaggccgaguggauccagcggaugauggaggugcugcgcaagcgguccagcuccacgcucccgguccccguguucaagcgcaagauccccuga

SEQ ID NO: 5172 - RNA, 330 nt, Artificial Sequence
  derived and/or modified sequence opt2 from CXCL13__Homo_sapiens__AAC14402
augaaguucaucuccaccucccuccuccucaugcuccucgucuccucccucucccccguccagggcguccucgaggucuacuacaccucccuccgcugccgcugcguccaggaguccuccgucuucaucccccgccgcuucaucgaccgcauccagauccucccccgcggcaacggcugcccccgcaaggagaucaucgucuggaagaagaacaaguccaucgucugcgucgacccccaggccgaguggauccagcgcaugauggagguccuccgcaagcgcuccuccuccacccuccccguccccgucuucaagcgcaagauccccuga

SEQ ID NO: 5173 - RNA, 330 nt, Artificial Sequence
  derived and/or modified sequence opt3 from CXCL13__Homo_sapiens__AAC14402
augaaguucaucagcaccucccugcuccuuaugcuguuggugucuucauuaagucccguccagggcguucuggagguguacuauacaagccuaagauguaggugcguacaagaauccucuguguuuauuccucggcgcuucauagaccgaauccagauucucccacgugggaacggaugcccgagaaaagagaucauugucuggaagaaaaauaagucgaucguguguguugauccccaggccgaauggauacagaggaugauggaggugcugcggaaacgcucaagcaguacucuuccugucccaguguuuaagagaaagauccccuga

SEQ ID NO: 5174 - RNA, 330 nt, Artificial Sequence
  derived and/or modified sequence opt4 from CXCL13__Homo_sapiens__AAC14402
augaaguucaucagcaccagccugcugcugaugcugcuggugagcagccugagccccgugcagggcgugcuggagguguacuacaccagccugagaugcagaugcgugcaggagagcagcguguucauccccagaagauucaucgacagaauccagauccugcccagaggcaacggcugccccagaaaggagaucaucguguggaagaagaacaagagcaucgugugcguggacccccaggccgaguggauccagagaaugauggaggugcugagaaagagaagcagcagcacccugcccgugcccguguucaagagaaagauccccuga

SEQ ID NO: 5175 - RNA, 330 nt, Artificial Sequence
  derived and/or modified sequence opt5 from CXCL13__Homo_sapiens__AAC14402
augaaguucaucagcaccucccugcuccugaugcuucuggugucuagccucucccccguccagggcguucuggagguguacuauacaucucuuagaugccggugugugcaagaaagcuccgucuuuauuccucgcagauucaucgaccggauucagauccugccgcgcgggaacggaugccccagaaaagagauuaucguguggaagaaaaauaagucuaucguuuguguggauccucaggccgaauggauucagcggaugauggagguccuccgcaaaagaagcuccagcacgcugcccgugccuguuuuuaagcggaagauccccuga

SEQ ID NO: 5176 - RNA, 330 nt, Artificial Sequence
  derived and/or modified sequence opt6 from CXCL13__Homo_sapiens__AAC14402
augaaauuuauaucaacaucacuacuacuaaugcuauuaguaucaagccuaagcccaguacaaggaguacucgaaguauauuacacaagcuuaagauguagauguguacaagaaucaagcguauucauaccaagaagauuuauagacagaauacaaauacuaccaagaggaaacggaugcccaagaaaagaaauaauaguauggaaaaaaaauaaaucaauaguaugcguagacccacaagcagaauggauacaaagaaugauggaaguauuaagaaaaagaucaagcucaacauuaccaguaccaguauucaaaagaaaaauaccauaa

SEQ ID NO: 5177 - protein, 111 aa, Artificial Sequence
  CXCL14__Homo_sapiens__O95715
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 5178 - RNA, 336 nt, Artificial Sequence
  CXCL14__Homo_sapiens__AAP35743
augucccugcucccacgccgcgccccuccggucagcaugaggcuccuggcggccgcgcugcuccugcugcugcuggcgcuguacaccgcgcguguggacggguccaaaugcaagugcucccggaagggacccaagauccgcuacagcgacgugaagaagcuggaaaugaagccaaaguacccgcacugcgaggagaagaugguuaucaucaccaccaagagcguguccagguaccgaggucaggagcacugccugcaccccaagcugcagagcaccaagcgcuucaucaagugguacaacgccuggaacgagaagcgcagggucuacgaagaauag

SEQ ID NO: 5179 - RNA, 336 nt, Artificial Sequence
  derived and/or modified sequence opt1 from CXCL14__Homo_sapiens__AAP35743
augagccugcucccccgccgggccccgcccguguccaugcgccugcuggccgcggcccuccugcugcuccugcuggcccucuacaccgcccgggucgacggcagcaagugcaagugcucccgcaaggggcccaagauccgguacagcgacgugaagaagcuggagaugaagcccaaguacccgcacugcgaggagaagauggugaucaucaccacgaaguccgucagccgcuaccggggccaggagcacugccugcaccccaagcuccaguccaccaagcgcuucaucaagugguacaacgccuggaacgagaagcggcgcguguacgaggaguga

SEQ ID NO: 5180 - RNA, 336 nt, Artificial Sequence
  derived and/or modified sequence opt2 from CXCL14__Homo_sapiens__AAP35743
augucccuccucccccgccgcgccccccccgucuccaugcgccuccucgccgccgcccuccuccuccuccuccucgcccucuacaccgcccgcgucgacggcuccaagugcaagugcucccgcaagggccccaagauccgcuacuccgacgucaagaagcucgagaugaagcccaaguacccccacugcgaggagaagauggucaucaucaccaccaaguccgucucccgcuaccgcggccaggagcacugccuccaccccaagcuccaguccaccaagcgcuucaucaagugguacaacgccuggaacgagaagcgccgcgucuacgaggaguga

SEQ ID NO: 5181 - RNA, 336 nt, Artificial Sequence
  derived and/or modified sequence opt3 from CXCL14__Homo_sapiens__AAP35743
augagccugcuccccagaagggccccuccaguguccaugcggcuucuggcugcagccuuguuacugcuacuccuggcgcuuuacaccgcucgcgucgacggcucuaagugcaaauguucacgaaaggggccgaaaauccguuauagugauguuaagaaacuggagaugaagcccaaguacccucacugcgaagagaaaauggugauuauaacaacuaagagcguauccagauauaggggacaggaacauuguuugcacccaaaacuccaaucuacgaagcgguucaucaaaugguacaacgccuggaaugagaagcgcagaguguaugaagaguga

SEQ ID NO: 5182 - RNA, 336 nt, Artificial Sequence
  derived and/or modified sequence opt4 from CXCL14__Homo_sapiens__AAP35743
augagccugcugcccagaagagccccccccgugagcaugagacugcuggccgccgcccugcugcugcugcugcuggcccuguacaccgccagaguggacggcagcaagugcaagugcagcagaaagggccccaagaucagauacagcgacgugaagaagcuggagaugaagcccaaguacccccacugcgaggagaagauggugaucaucaccaccaagagcgugagcagauacagaggccaggagcacugccugcaccccaagcugcagagcaccaagagauucaucaagugguacaacgccuggaacgagaagagaagaguguacgaggaguga

SEQ ID NO: 5183 - RNA, 336 nt, Artificial Sequence
  derived and/or modified sequence opt5 from CXCL14__Homo_sapiens__AAP35743
augagccugcuccccagacgggccccuccgguguccaugcgccugcuugcugccgcgcugcuccugcuucugcucgcucuguacaccgccagagucgacggcucuaagugcaaauguagccggaaggggcccaaaauccgcuauuccgauguuaagaaacuggagaugaagccuaaguacccccacugcgaagagaaaauggugauuaucacaacgaagucugugagcagauaucggggacaggaacauugucuccacccuaaacugcaauccaccaagcgcuucauuaaaugguacaacgccuggaaugagaagagacgggucuaugaagaguga

SEQ ID NO: 5184 - RNA, 336 nt, Artificial Sequence
  derived and/or modified sequence opt6 from CXCL14__Homo_sapiens__AAP35743
augucacuacuaccaagaagagcaccaccaguaucaaugagacuacuagcagcagcacuacuacuacuauuacuagcacuauacacagcaagaguagacggaagcaaaugcaaaugcucaagaaaaggaccaaaaauaagauacucagacguaaaaaaauuagaaaugaaaccaaaauacccacacugcgaagaaaaaaugguaauaauaacaacaaaaucaguaucaagauacagaggacaagaacacugccuacacccaaaacuacaaagcacaaaaagauucauaaaaugguacaacgcauggaacgaaaaaagaagaguauacgaagaauaa

SEQ ID NO: 5185 - protein, 167 aa, Artificial Sequence
  CXCL15__Mus_musculus__Q9WVL7
MAAQGWSMLLLAVLNLGIFVRPCDTQELRCLCIQEHSEFIPLKLIKNIMVIFETIYCNRKEVIAVPKNGSMICLDPDAPWVKATVGPITNRFLPEDLKQKEFPPAMKLLYSVEHEKPLYLSFGRPENKRIFPFPIRETSRHFADLAHNSDRNFLRDSSEVSLTGSDA

SEQ ID NO: 5186 - RNA, 504 nt, Artificial Sequence
  CXCL15__Mus_musculus__AAD38079
auggcugcucaaggcugguccaugcuccugcuggcuguccuuaaccuaggcaucuucguccgucccugugacacucaagagcuacgaugucuguguauucaggaacacucugaauucauuccucucaaacucauuaaaaauauaauggugauauucgagaccauuuacugcaacagaaaggaagugauagcagucccaaaaaaugggaguaugauuuguuuggauccugaugcuccaugggugaaggcuacuguuggcccaauuacuaacagguuccuaccugaggaccucaaacaaaaggaauuuccaccggcaaugaagcuucuguauaguguugagcaugaaaagccucuauaucuuucauuugggagaccugagaacaagagaauauuucccuuuccaauucgggagaccucuagacacuuugcugauuuagcucacaacagugauaggaauuuucuacgggacuccagugaagucagcuugacaggcagugaugccuaa

SEQ ID NO: 5187 - RNA, 504 nt, Artificial Sequence
  derived and/or modified sequence opt1 from CXCL15__Mus_musculus__AAD38079
auggccgcccagggcuggagcaugcugcuccuggcggugcugaaccucgggaucuucguccgccccugcgacacccaggagcugcggugccugugcauccaggagcacuccgaguucaucccgcucaagcugaucaagaacaucauggugaucuucgagaccaucuacugcaaccgcaaggaggugaucgccguccccaagaacggcagcaugaucugccuggaccccgacgcccccugggugaaggccacgguggggccgaucaccaaccgguuccuccccgaggaccugaagcagaaggaguucccgcccgccaugaagcugcucuacuccgucgagcacgagaagccccuguaccugagcuucggccgccccgagaacaagcggaucuuccccuuccccauccgcgagaccucccggcacuucgcggaccucgcccacaacagcgaccgcaacuuccugcgggacuccagcgaggugucccugaccgggagcgacgccuga

SEQ ID NO: 5188 - RNA, 504 nt, Artificial Sequence
  derived and/or modified sequence opt2 from CXCL15__Mus_musculus__AAD38079
auggccgcccagggcugguccaugcuccuccucgccguccucaaccucggcaucuucguccgccccugcgacacccaggagcuccgcugccucugcauccaggagcacuccgaguucaucccccucaagcucaucaagaacaucauggucaucuucgagaccaucuacugcaaccgcaaggaggucaucgccguccccaagaacggcuccaugaucugccucgaccccgacgcccccugggucaaggccaccgucggccccaucaccaaccgcuuccuccccgaggaccucaagcagaaggaguucccccccgccaugaagcuccucuacuccgucgagcacgagaagccccucuaccucuccuucggccgccccgagaacaagcgcaucuuccccuuccccauccgcgagaccucccgccacuucgccgaccucgcccacaacuccgaccgcaacuuccuccgcgacuccuccgaggucucccucaccggcuccgacgccuga

SEQ ID NO: 5189 - RNA, 504 nt, Artificial Sequence
  derived and/or modified sequence opt3 from CXCL15__Mus_musculus__AAD38079
auggccgcucagggcuggagcaugcugcuccuugcagugcugaacuuggggaucuucgucagacccugcgacacccaagaguuaaggugucugugcauucaggaacacuccgaguuuauaccucuaaagcucaucaaaaauauuaugguuaucuucgaaacaauuuacuguaaccggaaggaggugaucgccguaccgaaaaauggaucuaugauaugccuggauccagacgcgcccugggugaaggcuacugucgguccuaucacgaaccgcuuucuuccagaagaucugaaacagaaggaguuucccccugccaugaaguugcucuauucaguggagcaugaaaaaccacuguaccugaguuuuggccgacccgagaauaagcguauuuucccuuuuccaaucagagaaaccagcaggcacuucgcagaccucgcccauaacuccgaucggaauuucuuacgcgacucuucggagguuucacugacagggagcgaugcuuga

SEQ ID NO: 5190 - RNA, 504 nt, Artificial Sequence
  derived and/or modified sequence opt4 from CXCL15__Mus_musculus__AAD38079
auggccgcccagggcuggagcaugcugcugcuggccgugcugaaccugggcaucuucgugagacccugcgacacccaggagcugagaugccugugcauccaggagcacagcgaguucaucccccugaagcugaucaagaacaucauggugaucuucgagaccaucuacugcaacagaaaggaggugaucgccgugcccaagaacggcagcaugaucugccuggaccccgacgcccccugggugaaggccaccgugggccccaucaccaacagauuccugcccgaggaccugaagcagaaggaguucccccccgccaugaagcugcuguacagcguggagcacgagaagccccuguaccugagcuucggcagacccgagaacaagagaaucuuccccuuccccaucagagagaccagcagacacuucgccgaccuggcccacaacagcgacagaaacuuccugagagacagcagcgaggugagccugaccggcagcgacgccuga

SEQ ID NO: 5191 - RNA, 504 nt, Artificial Sequence
  derived and/or modified sequence opt5 from CXCL15__Mus_musculus__AAD38079
auggccgcucagggcuggagcaugcugcuccuggccgugcuuaaccuggggaucuucgucagacccugcgacacccaagagcuccggugucugugcauucaggaacacuccgaguuuaucccucuuaagcugauuaaaaauaucaugguuauuuucgaaacaaucuacuguaaccgcaaggaggugaucgcggugccgaaaaauggaucuaugauuugccucgaucccgacgcuccuugggucaaggccacggugggccccaucaccaacagauuucugccugaagaucugaaacagaaggaguuucccccugccaugaagcuccuguauagcguugagcaugaaaaaccgcuuuaccuguccuucgggcggcccgagaauaagcgcauuuucccuuuucccaucagagaaacaucucggcacuucgcugaccucgcccauaacagcgaucgcaauuuucugagagacuccucugaggugagccuuaccggauccgaugcuuga

SEQ ID NO: 5192 - RNA, 504 nt, Artificial Sequence
  derived and/or modified sequence opt6 from CXCL15__Mus_musculus__AAD38079
auggcagcacaaggauggucaaugcuacuacuagcaguacuaaaccuaggaauauucguaagacccugcgacacacaagaacuaagaugccuaugcauacaagaacacucagaauucauaccacuaaaacuaauaaaaaacaucaugguaauauucgaaacaauauacugcaacagaaaagaaguaauagcaguaccaaaaaacggcucaaugauaugccuagaccccgacgcaccauggguaaaagcaacagucggaccaauaacaaacagauuccuaccagaagaccuaaaacaaaaagaauucccaccagcaaugaaacuacuauacucaguagaacacgaaaaaccauuauaucuaucauucggaagaccagaaaacaaaagaauauucccauucccaauaagagaaacauccagacacuucgcagaccuagcacacaacucagauagaaacuuccuaagagacucaucagaaguaucacuaacaggaucagacgcauaa

SEQ ID NO: 5193 - protein, 107 aa, Artificial Sequence
  CXCL1__Homo_sapiens__P09341
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 5194 - RNA, 324 nt, Artificial Sequence
  CXCL1__Homo_sapiens__AAA35933
auggcccgcgcugcucucuccgccgcccccagcaauccccggcuccugcgaguggcacugcugcuccugcuccugguagccgcuggccggcgcgcagcaggagcguccguggccacugaacugcgcugccagugcuugcagacccugcagggaauucaccccaagaacauccaaagugugaacgugaagucccccggaccccacugcgcccaaaccgaagucauagccacacucaagaaugggcggaaagcuugccucaauccugcaucccccauaguuaagaaaaucaucgaaaagaugcugaacagugacaaauccaacuga

SEQ ID NO: 5195 - RNA, 324 nt, Artificial Sequence
  derived and/or modified sequence opt1 from CXCL1__Homo_sapiens__AAA35933
auggcccgcgccgcgcugagcgccgcccccuccaacccgcggcuccugcgcguggcccugcuccugcugcuccuggucgccgcgggccggcgcgccgccggggccagcguggcgaccgagcugcggugccagugccuccagacccugcagggcauccaccccaagaacauccaguccgugaacgucaagagccccgggccccacugcgcccagacggaggugaucgccacccugaagaacggccgcaaggccugccucaacccggccucccccaucgugaagaagaucaucgagaagaugcugaacagcgacaaguccaacuga

SEQ ID NO: 5196 - RNA, 324 nt, Artificial Sequence
  derived and/or modified sequence opt2 from CXCL1__Homo_sapiens__AAA35933
auggcccgcgccgcccucuccgccgcccccuccaacccccgccuccuccgcgucgcccuccuccuccuccuccucgucgccgccggccgccgcgccgccggcgccuccgucgccaccgagcuccgcugccagugccuccagacccuccagggcauccaccccaagaacauccaguccgucaacgucaagucccccggcccccacugcgcccagaccgaggucaucgccacccucaagaacggccgcaaggccugccucaaccccgccucccccaucgucaagaagaucaucgagaagaugcucaacuccgacaaguccaacuga

SEQ ID NO: 5197 - RNA, 324 nt, Artificial Sequence
  derived and/or modified sequence opt3 from CXCL1__Homo_sapiens__AAA35933
auggccagagcugcacugagcgccgcgcccuccaacccuaggcugcuucggguggcucuguuguuacugcuacucgucgccgcaggccgccgagccgcuggggcaucuguugccaccgagcugcguugccagugucuucaaacacugcagggaauccacccaaagaauauucagucagugaacguaaaaaguccggguccccauugcgcucagacugaagugauagccacguugaagaauggcagaaaagcgugucucaacccugcaagcccaaucgucaagaaaauuaucgagaagaugcucaauuccgacaagucuaacuga

SEQ ID NO: 5198 - RNA, 324 nt, Artificial Sequence
  derived and/or modified sequence opt4 from CXCL1__Homo_sapiens__AAA35933
auggccagagccgcccugagcgccgcccccagcaaccccagacugcugagaguggcccugcugcugcugcugcugguggccgccggcagaagagccgccggcgccagcguggccaccgagcugagaugccagugccugcagacccugcagggcauccaccccaagaacauccagagcgugaacgugaagagccccggcccccacugcgcccagaccgaggugaucgccacccugaagaacggcagaaaggccugccugaaccccgccagccccaucgugaagaagaucaucgagaagaugcugaacagcgacaagagcaacuga

SEQ ID NO: 5199 - RNA, 324 nt, Artificial Sequence
  derived and/or modified sequence opt5 from CXCL1__Homo_sapiens__AAA35933
auggccagagcugcccugagcgcggcucccuccaacccucggcuccugcgcguggcccuucugcuccugcuucuggucgccgcuggcagacgggccgcuggggccucuguugcgaccgagcuccgcugccagugucugcaaacacugcagggaauccacccgaagaauauucagagcgugaacgugaaaucccccggcccucauugcgcccagacggaagucaucgcuacccucaagaaugggagaaaagccugucugaaccccgcuucuccuauugugaagaaaaucauugagaagaugcuuaauagcgacaaguccaacuga

SEQ ID NO: 5200 - RNA, 324 nt, Artificial Sequence
  derived and/or modified sequence opt6 from CXCL1__Homo_sapiens__AAA35933
auggcaagagcagcacuaagcgcagcaccaagcaacccaagacuacuaagaguagcacuacuauuacuacuacuaguagcagcaggaagaagagcagcaggagcaucaguagcaacagaacuaagaugccaaugccuacaaacacuacaaggaauacacccaaaaaacauacaaagcguaaacguaaaaucaccaggaccacacugcgcacaaacagaaguaauagcaacacuaaaaaacggaagaaaagcaugccuaaacccagcaucaccaauaguaaaaaaaauaauagaaaaaaugcuaaacagcgacaaaucaaacuaa

SEQ ID NO: 5201 - protein, 107 aa, Artificial Sequence
  CXCL2__Homo_sapiens__A0A024RDD9
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 5202 - RNA, 324 nt, Artificial Sequence
  CXCL2__Homo_sapiens__EAX05701
auggcccgcgccacgcucuccgccgcccccagcaauccccggcuccugcggguggcgcugcugcuccugcuccugguggccgccagccggcgcgcagcaggagcgccccuggccacugaacugcgcugccagugcuugcagacccugcagggaauucaccucaagaacauccaaagugugaaggugaagucccccggaccccacugcgcccaaaccgaagucauagccacacucaagaaugggcagaaagcuugucucaaccccgcaucgcccaugguuaagaaaaucaucgaaaagaugcugaaaaauggcaaauccaacuga

SEQ ID NO: 5203 - RNA, 324 nt, Artificial Sequence
  derived and/or modified sequence opt1 from CXCL2__Homo_sapiens__EAX05701
auggcccgcgccacccugagcgcggcccccuccaacccgcggcuccugcgcguggcccugcuccugcugcuccuggucgccgccagccggcgcgcggccggcgcgccccuggccaccgagcuccggugccagugccugcagacgcugcaggggauccaccucaagaacauccaguccgugaaggucaagagccccggcccccacugcgcccagaccgaggugaucgccacccugaagaacgggcagaaggccugccugaacccggccucccccauggugaagaagaucaucgagaagaugcucaagaacggcaagagcaacuga

SEQ ID NO: 5204 - RNA, 324 nt, Artificial Sequence
  derived and/or modified sequence opt2 from CXCL2__Homo_sapiens__EAX05701
auggcccgcgccacccucuccgccgcccccuccaacccccgccuccuccgcgucgcccuccuccuccuccuccucgucgccgccucccgccgcgccgccggcgccccccucgccaccgagcuccgcugccagugccuccagacccuccagggcauccaccucaagaacauccaguccgucaaggucaagucccccggcccccacugcgcccagaccgaggucaucgccacccucaagaacggccagaaggccugccucaaccccgccucccccauggucaagaagaucaucgagaagaugcucaagaacggcaaguccaacuga

SEQ ID NO: 5205 - RNA, 324 nt, Artificial Sequence
  derived and/or modified sequence opt3 from CXCL2__Homo_sapiens__EAX05701
auggccagagcuacccugagcgcagcccccuccaacccuaggcuccuucggguggcgcuguuguuacugcuacucgucgcugccucucgccgagcagccggcgcuccacuggcaacagagcuucguugccagugucugcaaacuuugcaggggauccaccucaagaauauucagucaguuaaagugaagaguccgggaccccauugcgcccagacggaaguaauagcuacccugaaaaacggucaaaaggccugucugaauccugcgagcccaauggugaaaaagaucauugagaagaugcucaaaaacggcaaguccaauuga

SEQ ID NO: 5206 - RNA, 324 nt, Artificial Sequence
  derived and/or modified sequence opt4 from CXCL2__Homo_sapiens__EAX05701
auggccagagccacccugagcgccgcccccagcaaccccagacugcugagaguggcccugcugcugcugcugcugguggccgccagcagaagagccgccggcgccccccuggccaccgagcugagaugccagugccugcagacccugcagggcauccaccugaagaacauccagagcgugaaggugaagagccccggcccccacugcgcccagaccgaggugaucgccacccugaagaacggccagaaggccugccugaaccccgccagccccauggugaagaagaucaucgagaagaugcugaagaacggcaagagcaacuga

SEQ ID NO: 5207 - RNA, 324 nt, Artificial Sequence
  derived and/or modified sequence opt5 from CXCL2__Homo_sapiens__EAX05701
auggccagagcuacccugagcgccgcgcccuccaacccucggcuccugcgcguggcccuucugcuccugcuucuggucgcugccucuagacgggcugccggggcuccgcucgccacagagcugcgcugccagugucugcaaacgcuccaggggauccaccugaagaauauucagagcguuaaagugaagucccccggaccucauugcgcgcagaccgaagugaucgccacacuuaaaaacggccaaaaggcuugucugaaucccgccucuccuauggucaaaaagauuaucgagaagaugcucaaaaacggcaagagcaauuga

SEQ ID NO: 5208 - RNA, 324 nt, Artificial Sequence
  derived and/or modified sequence opt6 from CXCL2__Homo_sapiens__EAX05701
auggcaagagcaacacuaagcgcagcaccaagcaacccaagacuacuaagaguagcacuacuacuacuauuacuaguagcagcaagcagaagagcagcaggagcaccacuagcaacagaacucagaugccaaugccuacaaacacuacaaggaauacaccuaaaaaacauacaaagcguaaaaguaaaaucaccaggaccacacugcgcacaaacagaaguaauagcaacacuaaaaaacggacaaaaagcaugccuaaacccagcaucaccaauggucaaaaaaauaauagaaaaaaugcuaaaaaacggaaaaucaaacuaa

SEQ ID NO: 5209 - protein, 107 aa, Artificial Sequence; identical to SEQ ID NO: 5201
  CXCL2__Homo_sapiens__P19875

SEQ ID NO: 5210 - RNA, 324 nt, Artificial Sequence
  CXCL2__Homo_sapiens__AAA63182
auggcccgcgccacgcucuccgccgcccccagcaauccccggcuccugcgaguggcgcugcugcuccugcuccugguggccgccagccggcgcgcagcaggagcgccccuggccacugaacugcgcugccagugcuugcagacccugcagggaauucaccucaagaacauccaaagugugaaggugaagucccccggaccccacugcgcccaaaccgaagucauagccacacucaagaaugggcagaaagcuugucucaaccccgcaucgcccaugguuaagaaaaucaucgaaaagaugcugaaaaauggcaaauccaacuga

SEQ ID NO: 5211 - RNA, 324 nt, Artificial Sequence; identical to SEQ ID NO: 5203
  derived and/or modified sequence opt1 from CXCL2__Homo_sapiens__AAA63182

SEQ ID NO: 5212 - RNA, 324 nt, Artificial Sequence; identical to SEQ ID NO: 5204
  derived and/or modified sequence opt2 from CXCL2__Homo_sapiens__AAA63182

SEQ ID NO: 5213 - RNA, 324 nt, Artificial Sequence; identical to SEQ ID NO: 5205
  derived and/or modified sequence opt3 from CXCL2__Homo_sapiens__AAA63182

SEQ ID NO: 5214 - RNA, 324 nt, Artificial Sequence; identical to SEQ ID NO: 5206
  derived and/or modified sequence opt4 from CXCL2__Homo_sapiens__AAA63182

SEQ ID NO: 5215 - RNA, 324 nt, Artificial Sequence; identical to SEQ ID NO: 5207
  derived and/or modified sequence opt5 from CXCL2__Homo_sapiens__AAA63182

SEQ ID NO: 5216 - RNA, 324 nt, Artificial Sequence
  derived and/or modified sequence opt6 from CXCL2__Homo_sapiens__AAA63182
auggcaagagcaacacuaagcgcagcaccaagcaacccaagacuacuaagaguagcacuacuacuacuacuacuaguagcagcaagcagaagagcagcaggagccccacuagcaacagaacuaagaugccaaugccuacaaacacuacaaggaauacaccuaaaaaacauacaaagcguaaaaguaaaaucaccaggaccacacugcgcacaaacagaaguaauagcaacacuaaaaaacggacaaaaagcaugccuaaacccagcaucaccaaugguaaaaaaaauaauagaaaaaaugcuaaaaaacggaaaaucaaacuaa

SEQ ID NO: 5217 - protein, 107 aa, Artificial Sequence
  CXCL3__Homo_sapiens__P19876
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 5218 - RNA, 324 nt, Artificial Sequence
  CXCL3__Homo_sapiens__AAH16308
auggcccacgccacgcucuccgccgcccccagcaauccccggcuccugcggguggcgcugcugcuccugcuccugguggccgccagccggcgcgcagcaggagcguccguggucacugaacugcgcugccagugcuugcagacacugcagggaauucaccucaagaacauccaaagugugaauguaaggucccccggaccccacugcgcccaaaccgaagucauagccacacucaagaaugggaagaaagcuugucucaaccccgcaucccccaugguucagaaaaucaucgaaaagauacugaacaaggggagcaccaacuga

SEQ ID NO: 5219 - RNA, 324 nt, Artificial Sequence
  derived and/or modified sequence opt1 from CXCL3__Homo_sapiens__AAH16308
auggcccacgccacccugagcgcggcccccuccaacccgcgccuccugcggguggcccugcuccugcugcuccuggucgccgccagccgccgggcggccggcgccuccguggugaccgagcugcgcugccagugccuccagacgcugcaggggauccaccugaagaacauccagagcgucaacgugcggucccccggcccccacugcgcccagaccgaggugaucgcgacccucaagaacgggaagaaggccugccugaaccccgccagcccgaugguccagaagaucaucgagaagauccugaacaagggcuccaccaacuga

SEQ ID NO: 5220 - RNA, 324 nt, Artificial Sequence
  derived and/or modified sequence opt2 from CXCL3__Homo_sapiens__AAH16308
auggcccacgccacccucuccgccgcccccuccaacccccgccuccuccgcgucgcccuccuccuccuccuccucgucgccgccucccgccgcgccgccggcgccuccgucgucaccgagcuccgcugccagugccuccagacccuccagggcauccaccucaagaacauccaguccgucaacguccgcucccccggcccccacugcgcccagaccgaggucaucgccacccucaagaacggcaagaaggccugccucaaccccgccucccccaugguccagaagaucaucgagaagauccucaacaagggcuccaccaacuga

SEQ ID NO: 5221 - RNA, 324 nt, Artificial Sequence
  derived and/or modified sequence opt3 from CXCL3__Homo_sapiens__AAH16308
auggcccacgcuacccugagcgcagcccccuccaacccuagacuccuuaggguggcgcuguuguuacugcuacucgucgcugccucucggcgcgcagccggcgcuucaguugugacagagcugcgaugccagugucuucaaacucugcaggggauccauuugaagaauauucagaguguaaacgugcguagcccaggaccgcacugcgcacagacggaagucauagccacccucaaaaaugguaagaaagccugucugaaccccgcuuccccuauggugcaaaagaucauugagaaaauccugaauaagggcucuacaaacuga

SEQ ID NO: 5222 - RNA, 324 nt, Artificial Sequence
  derived and/or modified sequence opt4 from CXCL3__Homo_sapiens__AAH16308
auggcccacgccacccugagcgccgcccccagcaaccccagacugcugagaguggcccugcugcugcugcugcugguggccgccagcagaagagccgccggcgccagcguggugaccgagcugagaugccagugccugcagacccugcagggcauccaccugaagaacauccagagcgugaacgugagaagccccggcccccacugcgcccagaccgaggugaucgccacccugaagaacggcaagaaggccugccugaaccccgccagccccauggugcagaagaucaucgagaagauccugaacaagggcagcaccaacuga

SEQ ID NO: 5223 - RNA, 324 nt, Artificial Sequence
  derived and/or modified sequence opt5 from CXCL3__Homo_sapiens__AAH16308
auggcccacgcuacccugagcgccgcgcccuccaacccuagacuccugcggguggcccuucugcuccugcuucuggucgcugccucucgcagagcugccggcgcuagcguugugacagagcuccggugccagugucugcaaacgcugcaggggauccaucucaagaauauucaguccgugaacguccgcucuccgggaccccacugcgcccagaccgaagugaucgcgacacugaaaaauggcaagaaagccugucuuaacccugcuagccccaugguucaaaagauuaucgagaaaauucugaauaagggguccaccaacuga

SEQ ID NO: 5224 - RNA, 324 nt, Artificial Sequence
  derived and/or modified sequence opt6 from CXCL3__Homo_sapiens__AAH16308
auggcacacgcaacacuaagcgcagcaccaagcaacccaagacuacuaagaguagcacuacuacuacuacuacuaguagcagcaagcagaagagcagcaggagcaucaguaguaacagaacuaagaugccaaugcuuacaaacacuacaaggaauacaccuaaaaaacauacaaagcguaaacguaagaucaccaggaccacacugcgcacaaacagaaguaauagcaacacuaaaaaacggaaaaaaagcaugccuaaacccagcaucaccaaugguacaaaaaauaauagaaaaaauacuaaacaaaggaagcacaaacuaa

SEQ ID NO: 5225 - protein, 101 aa, Artificial Sequence
  CXCL4__Homo_sapiens__P02776
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 5226 - RNA, 306 nt, Artificial Sequence
  CXCL4__Homo_sapiens__AAA60066
augagcuccgcagccggguucugcgccucacgccccgggcugcuguuccugggguugcugcuccugccacuuguggucgccuucgccagcgcugaagcugaagaagauggggaccugcagugccugugugugaagaccaccucccagguccgucccaggcacaucaccagccuggaggugaucaaggccggaccccacugccccacugcccaacugauagccacgcugaagaauggaaggaaaauuugcuuggaccugcaagccccgcuguacaagaaaauaauuaagaaacuuuuggagaguuag

SEQ ID NO: 5227 - RNA, 306 nt, Artificial Sequence
  derived and/or modified sequence opt1 from CXCL4__Homo_sapiens__AAA60066
augagcuccgccgccggcuucugcgcgagccgccccgggcuccuguuccugggccugcuccugcugccgcucguggucgccuucgccuccgccgaggccgaggaggacggggaccugcagugccugugcgugaagaccaccagccaggugcggccccgccacaucacgucccucgaggucaucaaggcgggcccccacugccccaccgcccagcugaucgccacccugaagaacgggcggaagaucugccucgaccugcaggccccgcuguacaagaagaucaucaagaagcuccuggagagcuga

SEQ ID NO: 5228 - RNA, 306 nt, Artificial Sequence
  derived and/or modified sequence opt2 from CXCL4__Homo_sapiens__AAA60066
auguccuccgccgccggcuucugcgccucccgccccggccuccucuuccucggccuccuccuccucccccucgucgucgccuucgccuccgccgaggccgaggaggacggcgaccuccagugccucugcgucaagaccaccucccagguccgcccccgccacaucaccucccucgaggucaucaaggccggcccccacugccccaccgcccagcucaucgccacccucaagaacggccgcaagaucugccucgaccuccaggccccccucuacaagaagaucaucaagaagcuccucgaguccuga

SEQ ID NO: 5229 - RNA, 306 nt, Artificial Sequence
  derived and/or modified sequence opt3 from CXCL4__Homo_sapiens__AAA60066
augagcuccgccgcuggcuucugcgcaucuagacccgggcugcucuuucuuggacuguuguuacugccucuaguggucgccuucgcgucagcugaggccgaagaggacggugaucuccagugucugugcguuaagaccacaagucaagugaggccacggcacaucacuagccuugaaguaauuaaagcaggcccgcauugucccacggcccagcugauagcuaccuugaagaacgggcgcaaaaucugccucgaccugcaggcaccucuguacaagaaaauuaucaagaagcucuuagaguccuga

SEQ ID NO: 5230 - RNA, 306 nt, Artificial Sequence
  derived and/or modified sequence opt4 from CXCL4__Homo_sapiens__AAA60066
augagcagcgccgccggcuucugcgccagcagacccggccugcuguuccugggccugcugcugcugccccuggugguggccuucgccagcgccgaggccgaggaggacggcgaccugcagugccugugcgugaagaccaccagccaggugagacccagacacaucaccagccuggaggugaucaaggccggcccccacugccccaccgcccagcugaucgccacccugaagaacggcagaaagaucugccuggaccugcaggccccccuguacaagaagaucaucaagaagcugcuggagagcuga

SEQ ID NO: 5231 - RNA, 306 nt, Artificial Sequence
  derived and/or modified sequence opt5 from CXCL4__Homo_sapiens__AAA60066
augagcuccgccgccggcuucugcgccucuagacccgggcugcucuuucugggacuucugcuccugccucuuguggucgcguucgcuagcgccgaggccgaagaggacggcgaucugcagugucucugcguuaagaccacaucccaagugcggccgcgccacaucacgucucuggaagugauuaaagcugggccccauuguccuaccgcccagcugaucgcuacacucaagaacggaagaaaaauuugccuggaccuucaggcuccccuguacaagaaaaucauuaagaagcuccuggagagcuga

SEQ ID NO: 5232 - RNA, 306 nt, Artificial Sequence
  derived and/or modified sequence opt6 from CXCL4__Homo_sapiens__AAA60066
augucaucagcagcaggauucugcgcaucaagaccaggacuacuauuccuaggacuacuacuacuaccauuaguaguagcauucgcaucagcagaagcagaagaagacggagaccuacaaugccuaugcguaaaaacaacaucacaaguaagaccaagacacauaacaucacuagaaguaauaaaagcaggaccacacugcccaacagcacaacuaauagcaacacuaaaaaacggaagaaaaauaugccuagaccuacaagcaccacuauacaaaaaaauaauaaaaaaacuacuagaaucauaa

SEQ ID NO: 5233 - protein, 114 aa, Artificial Sequence
  CXCL5__Homo_sapiens__P42830
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 5234 - RNA, 345 nt, Artificial Sequence
  CXCL5__Homo_sapiens__AAA86426
augagccuccuguccagccgcgcggcccguguccccgguccuucgagcuccuugugcgcgcuguuggugcugcugcugcugcugacgcagccagggcccaucgccagcgcugguccugccgcugcuguguugagagagcugcguugcguuuguuuacagaccacgcaaggaguucaucccaaaaugaucaguaaucugcaaguguucgccauaggcccacagugcuccaagguggaagugguagccucccugaagaacgggaaggaaauuugucuugauccagaagccccuuuucuaaagaaagucauccagaaaauuuuggacgguggaaacaaggaaaacuga

SEQ ID NO: 5235 - RNA, 345 nt, Artificial Sequence
  derived and/or modified sequence opt1 from CXCL5__Homo_sapiens__AAA86426
augagccugcucuccagccgcgccgcccgggugcccggcccguccagcucccugugcgcgcugcucguccugcugcuccugcugacccagcccgggcccaucgccagcgccggccccgccgccgcggugcuccgcgagcugcggugcgugugccugcagaccacgcaggggguccacccgaagaugaucuccaaccuccagguguucgccaucggcccccagugcagcaagguggaggucguggccucccugaagaacgggaaggagaucugccuggaccccgaggcccccuuccucaagaaggugauccagaagauccuggacggcggcaacaaggagaacuga

SEQ ID NO: 5236 - RNA, 345 nt, Artificial Sequence
  derived and/or modified sequence opt2 from CXCL5__Homo_sapiens__AAA86426
augucccuccucuccucccgcgccgcccgcguccccggccccuccuccucccucugcgcccuccucguccuccuccuccuccucacccagcccggccccaucgccuccgccggccccgccgccgccguccuccgcgagcuccgcugcgucugccuccagaccacccagggcguccaccccaagaugaucuccaaccuccaggucuucgccaucggcccccagugcuccaaggucgaggucgucgccucccucaagaacggcaaggagaucugccucgaccccgaggcccccuuccucaagaaggucauccagaagauccucgacggcggcaacaaggagaacuga

SEQ ID NO: 5237 - RNA, 345 nt, Artificial Sequence
  derived and/or modified sequence opt3 from CXCL5__Homo_sapiens__AAA86426
augagccugcucuccucuagagccgcuagggugcccggcccuucaaguagccuuugcgcacuguuggucuuacugcuacuccugacccagccagggccgaucgccuccgcgggacccgcugccgcaguucuucgggagcugcgcugugugugcuugcaaacaacucaggguguacacccuaagaugauuucuaaccuccagguguucgccauaggcccacaguguucgaaagucgaagugguugcuucacugaagaaugggaaagagaucugccuggaccccgaagcaccuuuucucaagaaagugauucaaaagaucuuagauggaggcaacaaggagaauuga

SEQ ID NO: 5238 - RNA, 345 nt, Artificial Sequence
  derived and/or modified sequence opt4 from CXCL5__Homo_sapiens__AAA86426
augagccugcugagcagcagagccgccagagugcccggccccagcagcagccugugcgcccugcuggugcugcugcugcugcugacccagcccggccccaucgccagcgccggccccgccgccgccgugcugagagagcugagaugcgugugccugcagaccacccagggcgugcaccccaagaugaucagcaaccugcagguguucgccaucggcccccagugcagcaagguggaggugguggccagccugaagaacggcaaggagaucugccuggaccccgaggcccccuuccugaagaaggugauccagaagauccuggacggcggcaacaaggagaacuga

SEQ ID NO: 5239 - RNA, 345 nt, Artificial Sequence
  derived and/or modified sequence opt5 from CXCL5__Homo_sapiens__AAA86426
augagccugcucuccucuagagccgcucgggugcccggcccuagcuccucucugugcgcccuucugguccuccugcuucugcucacccagccggggcccaucgcgagcgcuggaccugccgccgcuguucugcgcgagcugagaugugugugccuccaaacaacgcagggcgugcaccccaagaugauuuccaaccugcaggucuucgccaucgggccucaguguucuaaaguggaaguuguggcuagccuuaagaauggaaaagagauuugccuggaccccgaagccccuuuucucaagaaagucauccaaaagauucuggauggcgggaacaaggagaauuga

SEQ ID NO: 5240 - RNA, 345 nt, Artificial Sequence
  derived and/or modified sequence opt6 from CXCL5__Homo_sapiens__AAA86426
augucacuacuaucaucaagagcagcaagaguaccaggaccaucaucaucacuaugcgcacuacuaguacuacuauuacuacuaacacaaccaggaccaauagcaucagcaggaccagcagcagcaguacuaagagaacuaagaugcguaugccuacaaacaacacaaggaguacacccaaaaaugauaucaaaccuacaaguauucgcaauaggaccacaaugcucaaaaguagaaguaguagcaucacuaaaaaacggaaaagaaauaugccuagacccagaagcaccauucuuaaaaaaaguaauacaaaaaauacuagacggaggaaacaaagaaaacuaa

SEQ ID NO: 5241 - protein, 114 aa, Artificial Sequence; identical to SEQ ID NO: 5233
  CXCL5__Homo_sapiens__Q6I9S7

SEQ ID NO: 5242 - RNA, 345 nt, Artificial Sequence
  CXCL5__Homo_sapiens__AAP35453
augagccuccuguccagccgcgcggcccguguccccgguccuucgagcuccuugugcgcgcuguuggugcugcugcugcugcugacgcagccagggcccaucgccagcgcugguccugccgcugcuguguugagagagcugcguugcguuuguuuacagaccacgcaaggaguucaucccaaaaugaucaguaaucugcaaguguucgccauaggcccacagugcuccaagguggaagugguagccucccugaagaacgggaaggaaauuugucuugauccagaagccccuuuucuaaagaaagucauccagaaaauuuuggacgguggaaacaaggaaaacuag

SEQ ID NO: 5243 - RNA, 345 nt, Artificial Sequence; identical to SEQ ID NO: 5235
  derived and/or modified sequence opt1 from CXCL5__Homo_sapiens__AAP35453

SEQ ID NO: 5244 - RNA, 345 nt, Artificial Sequence; identical to SEQ ID NO: 5236
  derived and/or modified sequence opt2 from CXCL5__Homo_sapiens__AAP35453

SEQ ID NO: 5245 - RNA, 345 nt, Artificial Sequence; identical to SEQ ID NO: 5237
  derived and/or modified sequence opt3 from CXCL5__Homo_sapiens__AAP35453

SEQ ID NO: 5246 - RNA, 345 nt, Artificial Sequence; identical to SEQ ID NO: 5238
  derived and/or modified sequence opt4 from CXCL5__Homo_sapiens__AAP35453

SEQ ID NO: 5247 - RNA, 345 nt, Artificial Sequence; identical to SEQ ID NO: 5239
  derived and/or modified sequence opt5 from CXCL5__Homo_sapiens__AAP35453

SEQ ID NO: 5248 - RNA, 345 nt, Artificial Sequence
  derived and/or modified sequence opt6 from CXCL5__Homo_sapiens__AAP35453
augucacuacuaucaucaagagcagcaagaguaccaggaccaucaucaucacuaugcgcacuacuaguacuacuacuauuauuaacacaaccaggaccaauagcaucagcaggaccagcagcagcaguacuaagagaacuaagaugcguaugccuacaaacaacacaaggaguacacccaaaaaugauaucaaaccuacaaguauucgcaauaggaccacaaugcucaaaaguagaaguaguagcaucacuaaaaaacggaaaagaaauaugccuagacccagaagcaccauuccuaaaaaaaguaauacaaaaaauacuagacggaggaaacaaagaaaacuaa

SEQ ID NO: 5249 - protein, 114 aa, Artificial Sequence
  CXCL6__Homo_sapiens__P80162
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 5250 - RNA, 345 nt, Artificial Sequence
  CXCL6__Homo_sapiens__AAC51338
augagccucccguccagccgcgcggcccgugucccggguccuucgggcuccuugugcgcgcugcucgcgcugcugcuccugcugacgccgccggggccccucgccagcgcugguccugucucugcugugcugacagagcugcguugcacuuguuuacgcguuacgcugagaguaaaccccaaaacgauugguaaacugcagguguuccccgcaggcccgcagugcuccaagguggaagugguagccucccugaagaacgggaagcaaguuugucuggacccggaagccccuuuucuaaagaaagucauccagaaaauuuuggacaguggaaacaagaaaaacuga

SEQ ID NO: 5251 - RNA, 345 nt, Artificial Sequence
  derived and/or modified sequence opt1 from CXCL6__Homo_sapiens__AAC51338
augagccugcccuccagccgcgccgcccgggugccgggccccuccgggagccucugcgcgcugcuggcccuccugcugcuccugaccccgcccggcccccuggccuccgccgggcccgucagcgccgugcucaccgagcugcgcugcacgugccugcgggugacccuccgcgucaaccccaagaccaucggcaagcuccagguguuccccgcggggccgcagugcuccaagguggaggucguggccagccugaagaacggcaagcaggucugccuggaccccgaggcccccuuccugaagaaggugauccagaagauccuggacuccggcaacaagaagaacuga

SEQ ID NO: 5252 - RNA, 345 nt, Artificial Sequence
  derived and/or modified sequence opt2 from CXCL6__Homo_sapiens__AAC51338
augucccuccccuccucccgcgccgcccgcguccccggccccuccggcucccucugcgcccuccucgcccuccuccuccuccucaccccccccggcccccucgccuccgccggccccgucuccgccguccucaccgagcuccgcugcaccugccuccgcgucacccuccgcgucaaccccaagaccaucggcaagcuccaggucuuccccgccggcccccagugcuccaaggucgaggucgucgccucccucaagaacggcaagcaggucugccucgaccccgaggcccccuuccucaagaaggucauccagaagauccucgacuccggcaacaagaagaacuga

SEQ ID NO: 5253 - RNA, 345 nt, Artificial Sequence
  derived and/or modified sequence opt3 from CXCL6__Homo_sapiens__AAC51338
augagccugcccuccucuagagccgcuagggugccuggcccaucagggagucucugcgcacuucuggccuuguuacugcuacucaccccgcccggaccucuggcgagcgcugguccagucuccgccguucuuacagagcugcgguguacuugcuugcgcgugacgcuccgaguaaaccccaagaccaucggcaaauuacagguguucccugcagggccacaauguucuaaggucgaagugguugccucgcugaaaaauggaaaacaggugugccucgaccccgaggcuccuuuucugaagaaggucauucagaagauacuggauucaggcaacaaaaagaauuga

SEQ ID NO: 5254 - RNA, 345 nt, Artificial Sequence
  derived and/or modified sequence opt4 from CXCL6__Homo_sapiens__AAC51338
augagccugcccagcagcagagccgccagagugcccggccccagcggcagccugugcgcccugcuggcccugcugcugcugcugaccccccccggcccccuggccagcgccggccccgugagcgccgugcugaccgagcugagaugcaccugccugagagugacccugagagugaaccccaagaccaucggcaagcugcagguguuccccgccggcccccagugcagcaagguggaggugguggccagccugaagaacggcaagcaggugugccuggaccccgaggcccccuuccugaagaaggugauccagaagauccuggacagcggcaacaagaagaacuga

SEQ ID NO: 5255 - RNA, 345 nt, Artificial Sequence
  derived and/or modified sequence opt5 from CXCL6__Homo_sapiens__AAC51338
augagccugcccuccucuagagccgcucgggugccuggcccgagcgggucccucugcgcccugcuugcgcugcuccugcuucugacacccccuggaccccucgcuucugccggcccugucagcgccguucugaccgagcugcgcuguacgugccucagagugacccugcgggugaaccccaagacaaucgggaaacuucaggucuucccugcuggaccgcaauguuccaagguggaaguuguggccucucugaaaaauggcaagcaggucugccucgaccccgaggcuccuuuucugaaaaaggugauucagaagauccuugauagcgggaacaaaaagaauuga

SEQ ID NO: 5256 - RNA, 345 nt, Artificial Sequence
  derived and/or modified sequence opt6 from CXCL6__Homo_sapiens__AAC51338
augucacuaccaucaucaagagcagcaagaguaccaggaccaucaggaagccuaugcgcauuacuagcacuacuacuacuacuaacaccaccaggaccacuagcaucagcaggaccaguaucagcaguacuaacagaacuaagaugcacaugccuaagaguaacacuaagaguaaacccaaaaacaauaggaaaacuacaaguauucccagcaggaccacaaugcucaaaaguagaaguaguagcaucacuaaaaaacggaaaacaaguaugccuagacccagaagcaccauuccuaaaaaaaguaauacaaaaaauacuagacucaggaaacaaaaaaaacuaa

SEQ ID NO: 5257 - protein, 128 aa, Artificial Sequence
  CXCL7__Homo_sapiens__P02775
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 5258 - RNA, 387 nt, Artificial Sequence
  CXCL7__Homo_sapiens__AAA62836
augagccucagacuugauaccaccccuuccuguaacagugcgagaccacuucaugccuugcaggugcugcugcuucugucauugcugcugacugcucuggcuuccuccaccaaaggacaaacuaagagaaacuuggcgaaaggcaaagaggaaagucuagacagugacuuguaugcugaacuccgcugcauguguauaaagacaaccucuggaauucaucccaaaaacauccaaaguuuggaagugaucgggaaaggaacccauugcaaccaagucgaagugauagccacacugaaggaugggaggaaaaucugccuggacccagaugcucccagaaucaagaaaauuguacagaaaaaauuggcaggugaugaaucugcugauuaa

SEQ ID NO: 5259 - RNA, 387 nt, Artificial Sequence
  derived and/or modified sequence opt1 from CXCL7__Homo_sapiens__AAA62836
augagccugcgccucgacaccacccccuccugcaacagcgcccggccgcugcacgcccuccaggugcugcugcugcucucccugcugcucacggcgcuggccagcuccaccaagggccagaccaagcgcaaccuggccaaggggaaggaggagagccucgacuccgaccuguacgccgagcugcggugcaugugcaucaagaccacgagcggcauccaccccaagaacauccagucccucgaggucaucgggaagggcacccacugcaaccagguggaggugaucgccacccugaaggacgggcgcaagaucugccuggaccccgacgcgccccggaucaagaagaucguccagaagaagcucgccggcgacgagagcgccgacuga

SEQ ID NO: 5260 - RNA, 387 nt, Artificial Sequence
  derived and/or modified sequence opt2 from CXCL7__Homo_sapiens__AAA62836
augucccuccgccucgacaccacccccuccugcaacuccgcccgcccccuccacgcccuccagguccuccuccuccucucccuccuccucaccgcccucgccuccuccaccaagggccagaccaagcgcaaccucgccaagggcaaggaggagucccucgacuccgaccucuacgccgagcuccgcugcaugugcaucaagaccaccuccggcauccaccccaagaacauccagucccucgaggucaucggcaagggcacccacugcaaccaggucgaggucaucgccacccucaaggacggccgcaagaucugccucgaccccgacgccccccgcaucaagaagaucguccagaagaagcucgccggcgacgaguccgccgacuga

SEQ ID NO: 5261 - RNA, 387 nt, Artificial Sequence
  derived and/or modified sequence opt3 from CXCL7__Homo_sapiens__AAA62836
augagccugagacucgacaccacacccuccugcaacucugccaggccucuucacgcucugcaaguguuguuacugcuaucacuccugcuuacugcacuggccaguagcacgaagggccagaccaaacggaauuuggcgaaggggaaagaggaaucccucgauucugaccuguacgcugagcugcgcuguaugugcaucaagacaacuucggguauucauccgaaaaacauacagucacucgaagucaucggaaagggcacccacuguaaucagguugaggugauugccacauuaaaggaugggcgaaaaaucugccuggacccagaugcaccccguauuaagaaaaucguacagaagaaacuugccggagacgaaagcgcugauuga

SEQ ID NO: 5262 - RNA, 387 nt, Artificial Sequence
  derived and/or modified sequence opt4 from CXCL7__Homo_sapiens__AAA62836
augagccugagacuggacaccacccccagcugcaacagcgccagaccccugcacgcccugcaggugcugcugcugcugagccugcugcugaccgcccuggccagcagcaccaagggccagaccaagagaaaccuggccaagggcaaggaggagagccuggacagcgaccuguacgccgagcugagaugcaugugcaucaagaccaccagcggcauccaccccaagaacauccagagccuggaggugaucggcaagggcacccacugcaaccagguggaggugaucgccacccugaaggacggcagaaagaucugccuggaccccgacgcccccagaaucaagaagaucgugcagaagaagcuggccggcgacgagagcgccgacuga

SEQ ID NO: 5263 - RNA, 387 nt, Artificial Sequence
  derived and/or modified sequence opt5 from CXCL7__Homo_sapiens__AAA62836
augagccugagacucgacaccacacccuccugcaacucugcccggccucugcacgcccuucaggugcugcuccugcuuagccugcuccugacggcucuggcguccucuaccaagggccaaacaaaacgcaaucucgcuaaggggaaagaggaaagccuggauuccgaccuuuacgccgagcugagauguaugugcaucaagaccacaucuggcauucauccgaaaaacauccagagccucgaagucauuggaaaggggacccacuguaaucagguugaggugaucgccacacugaaggauggacggaaaauuugccuugaccccgaugcuccucgcaucaagaaaaucgugcagaagaaacuggccggcgacgaauccgcugauuga

SEQ ID NO: 5264 - RNA, 387 nt, Artificial Sequence
  derived and/or modified sequence opt6 from CXCL7__Homo_sapiens__AAA62836
augucacuaagacucgacacaacaccaucaugcaacucagcaagaccacuacacgcacuacaaguacuacuacuacuaagccuacuacuaacagcacuagcaagcucaacaaaaggacaaacaaaaagaaaccuagcaaaaggaaaagaagaaucacuagacagcgaccuauacgcagaacuaagaugcaugugcauaaaaacaacaucaggaauacacccaaaaaacauacaaagcuuagaaguaauaggaaaaggaacacacugcaaccaaguagaaguaauagcaacacuaaaagacggaagaaaaauaugccuagacccagacgcaccaagaauaaaaaaaauaguacaaaaaaaacuagcaggagacgaaucagcagacuaa

SEQ ID NO: 5265 - protein, 99 aa, Artificial Sequence
  CXCL8__Homo_sapiens__P10145
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 5266 - RNA, 300 nt, Artificial Sequence
  CXCL8__Homo_sapiens__AAA35611
augacuuccaagcuggccguggcucucuuggcagccuuccugauuucugcagcucugugugaaggugcaguuuugccaaggagugcuaaagaacuuagaugucagugcauaaagacauacuccaaaccuuuccaccccaaauuuaucaaagaacugagagugauugagaguggaccacacugcgccaacacagaaauuauuguaaagcuuucugauggaagagagcucugucuggaccccaaggaaaacugggugcagaggguuguggagaaguuuuugaagagggcugagaauucauaa

SEQ ID NO: 5267 - RNA, 300 nt, Artificial Sequence
  derived and/or modified sequence opt1 from CXCL8__Homo_sapiens__AAA35611
augaccagcaagcuggccguggcccuccuggcggccuuccugaucuccgccgcccucugcgagggcgccguccugccccgcagcgcgaaggagcugcggugccagugcaucaagaccuacuccaagccguuccaccccaaguucaucaaggagcuccgcgugaucgagagcgggccccacugcgccaacacggagaucaucgugaagcuguccgacggccgggagcugugccucgaccccaaggagaacuggguccagcgcgugguggagaaguuccugaagcgggccgagaacagcuga

SEQ ID NO: 5268 - RNA, 300 nt, Artificial Sequence
  derived and/or modified sequence opt2 from CXCL8__Homo_sapiens__AAA35611
augaccuccaagcucgccgucgcccuccucgccgccuuccucaucuccgccgcccucugcgagggcgccguccucccccgcuccgccaaggagcuccgcugccagugcaucaagaccuacuccaagcccuuccaccccaaguucaucaaggagcuccgcgucaucgaguccggcccccacugcgccaacaccgagaucaucgucaagcucuccgacggccgcgagcucugccucgaccccaaggagaacuggguccagcgcgucgucgagaaguuccucaagcgcgccgagaacuccuga

SEQ ID NO: 5269 - RNA, 300 nt, Artificial Sequence
  derived and/or modified sequence opt3 from CXCL8__Homo_sapiens__AAA35611
augaccagcaagcuggccguggcucuccuugcagccuuccugaucuccgcggcuuugugcgagggcgccgucuuacccagaucugcaaaagaacugaggugucagugcauuaagacauacucaaaaccuuuucacccaaaguucauaaaagagcuacggguuaucgaaagugggccgcauugugccaacacugagauuaucgugaagcucagcgacggacgcgaacugugccuugaucccaaggagaauuggguacaacgaguggucgagaaauuucugaagcgugcugaaaacuccuga

SEQ ID NO: 5270 - RNA, 300 nt, Artificial Sequence
  derived and/or modified sequence opt4 from CXCL8__Homo_sapiens__AAA35611
augaccagcaagcuggccguggcccugcuggccgccuuccugaucagcgccgcccugugcgagggcgccgugcugcccagaagcgccaaggagcugagaugccagugcaucaagaccuacagcaagcccuuccaccccaaguucaucaaggagcugagagugaucgagagcggcccccacugcgccaacaccgagaucaucgugaagcugagcgacggcagagagcugugccuggaccccaaggagaacugggugcagagagugguggagaaguuccugaagagagccgagaacagcuga

SEQ ID NO: 5271 - RNA, 300 nt, Artificial Sequence
  derived and/or modified sequence opt5 from CXCL8__Homo_sapiens__AAA35611
augaccagcaagcuggccguggcucuccuggccgcguuccuuaucuccgcugcccugugcgagggcgccguccuccccagaucugcuaaagaacugcggugucagugcauuaagacauacagcaaaccuuuucacccgaaguucaucaaagagcuucgcguuauugaauccgggccccauugugccaacacggagaucauugugaagcugucugacggaagagaacucugccuggauccuaaggagaauugggugcaacgggucguggagaaauuucugaagcgcgcugaaaacagcuga

SEQ ID NO: 5272 - RNA, 300 nt, Artificial Sequence
  derived and/or modified sequence opt6 from CXCL8__Homo_sapiens__AAA35611
augacaucaaaacuagcaguagcacuacuagcagcauuccuaauaucagcagcacuaugcgaaggagcaguacuaccaagaucagcaaaagaauuaagaugccaaugcauaaaaacauacucaaaaccauuccacccaaaauucauaaaagaacuaagaguaauagaaucaggaccacacugcgcaaacacagaaauaauaguaaaacuaucagacggaagagaacuaugccuagacccaaaagaaaacuggguacaaagaguaguagaaaaauuccuaaaaagagcagaaaacucauaa

SEQ ID NO: 5273 - protein, 52 aa, Artificial Sequence
  CXCL9__Homo_sapiens__L8E8X0
MMQHPCLFMTGCLLSFSNNKKHVVKHLRIFWTVFKKYTVYRKSYNLTMKRTL

SEQ ID NO: 5274 - RNA, 159 nt, Artificial Sequence
  CXCL9__Homo_sapiens__CCQ43176
augaugcaacauccuugucuuuuuaugacaggauguuugcucagcuucuccaacaauaagaagcacgugguaaaacacuugcggauauucuggacuguuuuuaaaaaauauacaguuuaccgaaaaucauauaaucuuacaaugaaaaggacuuuauag

SEQ ID NO: 5275 - RNA, 159 nt, Artificial Sequence
  derived and/or modified sequence opt1 from CXCL9__Homo_sapiens__CCQ43176
augaugcagcaccccugccuguucaugaccggcugccuccugagcuucuccaacaacaagaagcacguggucaagcaccuccgcaucuucuggaccguguucaagaaguacacgguguaccgcaagagcuacaaccugaccaugaagcggacccuguga

SEQ ID NO: 5276 - RNA, 159 nt, Artificial Sequence
  derived and/or modified sequence opt2 from CXCL9__Homo_sapiens__CCQ43176
augaugcagcaccccugccucuucaugaccggcugccuccucuccuucuccaacaacaagaagcacgucgucaagcaccuccgcaucuucuggaccgucuucaagaaguacaccgucuaccgcaaguccuacaaccucaccaugaagcgcacccucuga

SEQ ID NO: 5277 - RNA, 159 nt, Artificial Sequence
  derived and/or modified sequence opt3 from CXCL9__Homo_sapiens__CCQ43176
augaugcagcaccccugccuguucaugaccggcugucuccuuagcuuuuccaacaauaagaaacauguggucaagcaccugagaaucuucuggacaguuuuuaaaaaguacacuguguauaggaaaucuuacaacuugacgaugaagcggaccuuauga

SEQ ID NO: 5278 - RNA, 159 nt, Artificial Sequence
  derived and/or modified sequence opt4 from CXCL9__Homo_sapiens__CCQ43176
augaugcagcaccccugccuguucaugaccggcugccugcugagcuucagcaacaacaagaagcacguggugaagcaccugagaaucuucuggaccguguucaagaaguacaccguguacagaaagagcuacaaccugaccaugaagagaacccuguga

SEQ ID NO: 5279 - RNA, 159 nt, Artificial Sequence
  derived and/or modified sequence opt5 from CXCL9__Homo_sapiens__CCQ43176
augaugcagcaccccugccuguucaugaccggcugucuccugagcuuuuccaacaauaagaaacauguggucaagcaccuuagaaucuucuggacaguuuuuaaaaaguacacgguguaucggaaaucuuacaaccugaccaugaagcgcacacucuga

SEQ ID NO: 5280 - RNA, 159 nt, Artificial Sequence
  derived and/or modified sequence opt6 from CXCL9__Homo_sapiens__CCQ43176
augaugcaacacccaugccuauucaugaccggaugccuacuaucauucucaaacaacaaaaaacacguagucaaacaccuaagaauauucuggacaguauucaaaaaauacacaguauacagaaaaucauacaaccuaacaaugaaaagaacacuauaa

SEQ ID NO: 5281 - protein, 125 aa, Artificial Sequence
  CXCL9__Homo_sapiens__Q07325
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 5282 - RNA, 378 nt, Artificial Sequence
  CXCL9__Homo_sapiens__AAH63122
augaagaaaagugguguucuuuuccucuugggcaucaucuugcugguucugauuggagugcaaggaaccccaguagugagaaagggucgcuguuccugcaucagcaccaaccaagggacuauccaccuacaauccuugaaagaccuuaaacaauuugccccaagcccuuccugcgagaaaauugaaaucauugcuacacugaagaauggaguucaaacaugucuaaacccagauucagcagaugugaaggaacugauuaaaaagugggagaaacaggucagccaaaagaaaaagcaaaagaaugggaaaaaacaucaaaaaaagaaaguucugaaaguucgaaaaucucaacguucucgucaaaagaagacuacauaa

SEQ ID NO: 5283 - RNA, 378 nt, Artificial Sequence
  derived and/or modified sequence opt1 from CXCL9__Homo_sapiens__AAH63122
augaagaaguccggcgugcuguuccuccuggggaucauccugcucguccugaucggcgugcaggggacccccgugguccgcaagggccggugcagcugcaucagcaccaaccaggggacgauccaccuccagucccugaaggaccugaagcaguucgccccgagccccuccugcgagaagaucgagaucaucgccacccugaagaacggcgugcagaccugccucaaccccgacagcgcggacgugaaggagcugaucaagaagugggagaagcaggucucccagaagaagaagcagaagaacggcaagaagcaccagaagaagaaggugcugaaggugcgcaagagccagcggucccgccagaagaagaccacguga

SEQ ID NO: 5284 - RNA, 378 nt, Artificial Sequence
  derived and/or modified sequence opt2 from CXCL9__Homo_sapiens__AAH63122
augaagaaguccggcguccucuuccuccucggcaucauccuccucguccucaucggcguccagggcacccccgucguccgcaagggccgcugcuccugcaucuccaccaaccagggcaccauccaccuccagucccucaaggaccucaagcaguucgcccccucccccuccugcgagaagaucgagaucaucgccacccucaagaacggcguccagaccugccucaaccccgacuccgccgacgucaaggagcucaucaagaagugggagaagcaggucucccagaagaagaagcagaagaacggcaagaagcaccagaagaagaagguccucaagguccgcaagucccagcgcucccgccagaagaagaccaccuga

SEQ ID NO: 5285 - RNA, 378 nt, Artificial Sequence
  derived and/or modified sequence opt3 from CXCL9__Homo_sapiens__AAH63122
augaagaaaagcggcgugcuguuccuccuugggauaauucuguuggucuuaauaggaguucaggguacccccgugguaagaaaggggaggugcuccuguaucucuacaaaccaaggcacuauucaucugcagucacuaaaagaccucaagcaguuugccccuaguccaagcugcgagaaaaucgaaauuaucgcuacgcugaagaauggagugcagaccugucuuaacccggauuccgcagacgucaaggagcugaucaaaaagugggaaaaacaagugucucagaagaaaaagcagaagaauggcaaaaagcaccagaaaaagaaaguuuugaaggugcggaaaucgcaacgcucacgacagaagaagacaacuuga

SEQ ID NO: 5286 - RNA, 378 nt, Artificial Sequence
  derived and/or modified sequence opt4 from CXCL9__Homo_sapiens__AAH63122
augaagaagagcggcgugcuguuccugcugggcaucauccugcuggugcugaucggcgugcagggcacccccguggugagaaagggcagaugcagcugcaucagcaccaaccagggcaccauccaccugcagagccugaaggaccugaagcaguucgcccccagccccagcugcgagaagaucgagaucaucgccacccugaagaacggcgugcagaccugccugaaccccgacagcgccgacgugaaggagcugaucaagaagugggagaagcaggugagccagaagaagaagcagaagaacggcaagaagcaccagaagaagaaggugcugaaggugagaaagagccagagaagcagacagaagaagaccaccuga

SEQ ID NO: 5287 - RNA, 378 nt, Artificial Sequence
  derived and/or modified sequence opt5 from CXCL9__Homo_sapiens__AAH63122
augaagaaaagcggcgugcuguuccuccuggggaucauucuucugguccucaucggaguucagggcacccccguggugagaaaggggcggugcuccuguauuucuacaaaccaaggaacgauccaucugcagagccuuaaagaccugaagcaguuugccccuuccccgucuugcgagaaaauugaaaucaucgcuacccucaagaauggcguccagacaugucugaaccccgauagcgccgacgugaaggagcugauuaaaaagugggaaaaacaaguuucccagaagaaaaagcagaagaaugggaaaaagcaccagaaaaagaaagugcucaagguccgcaaaucucaaagaagccggcagaagaagaccacauga

SEQ ID NO: 5288 - RNA, 378 nt, Artificial Sequence
  derived and/or modified sequence opt6 from CXCL9__Homo_sapiens__AAH63122
augaaaaaaucaggaguacuauuccuacuaggaauaauacuacuaguacuaauaggaguacaaggaacaccaguaguaagaaaaggaagaugcagcugcauaucaacaaaccaaggaacaauacaccuacaaucacuaaaagaccuaaaacaauucgcaccaucaccaucaugcgaaaaaauagaaauaauagcaacacuaaaaaacggaguacaaacaugccuaaacccagacucagcagacguaaaagaauuaauaaaaaaaugggaaaaacaaguaagccaaaaaaaaaaacaaaaaaauggaaaaaaacaccaaaaaaaaaaaguacuaaaaguaagaaaaagccaaagaucaagacaaaaaaaaaccacauaa

SEQ ID NO: 5289 - protein, 114 aa, Artificial Sequence
  XCL1__Homo_sapiens__P47992
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 5290 - RNA, 345 nt, Artificial Sequence
  XCL1__Homo_sapiens__AAC50164
augagacuucucauccuggcccuccuuggcaucugcucucucacugcauacauuguggaagguguagggagugaagucucagauaagaggaccugugugagccucacuacccagcgacugccgguuagcagaaucaagaccuacaccaucacggaaggcuccuugagagcaguaauuuuuauuaccaaacguggccuaaaagucugugcugauccacaagccacgugggugagagacguggucaggagcauggacaggaaauccaacaccagaaauaacaugauccagaccaagccaacaggaacccagcaaucgaccaauacagcugugacccugacuggcuag

SEQ ID NO: 5291 - RNA, 345 nt, Artificial Sequence
  derived and/or modified sequence opt1 from XCL1__Homo_sapiens__AAC50164
augcgccugcucauccuggcccugcucggcaucugcagccugaccgccuacaucguggagggggucggcuccgaggugagcgacaagcggaccugcgugucccugacgacccagcgccuccccgucagccggaucaagaccuacaccaucacggaggggucccugcgcgcggugaucuucaucaccaagcggggccugaaggugugcgccgacccgcaggccaccuggguccgcgacguggugcggagcauggaccgcaaguccaacacccggaacaacaugauccagacgaagcccaccgggacccagcagagcaccaacacggccgucacccucaccggcuga

SEQ ID NO: 5292 - RNA, 345 nt, Artificial Sequence
  derived and/or modified sequence opt2 from XCL1__Homo_sapiens__AAC50164
augcgccuccucauccucgcccuccucggcaucugcucccucaccgccuacaucgucgagggcgucggcuccgaggucuccgacaagcgcaccugcgucucccucaccacccagcgccuccccgucucccgcaucaagaccuacaccaucaccgagggcucccuccgcgccgucaucuucaucaccaagcgcggccucaaggucugcgccgacccccaggccaccuggguccgcgacgucguccgcuccauggaccgcaaguccaacacccgcaacaacaugauccagaccaagcccaccggcacccagcaguccaccaacaccgccgucacccucaccggcuga

SEQ ID NO: 5293 - RNA, 345 nt, Artificial Sequence
  derived and/or modified sequence opt3 from XCL1__Homo_sapiens__AAC50164
augagacugcucauccuugcccuguugggcauuugcagcuuaaccgcuuacauaguggagggggucggauccgaaguuucugacaagaggacaugugugucacugacuacgcagcggcuacccguaagucgcaucaaaaccuauacaauuacugaggguagccuccgagcagugaucuucauuaccaagcguggccugaaagucugcgccgauccucaagcgacaugggugagagacguugugagguccauggaucggaagucuaacacccgcaauaacaugauccagacuaaaccaacagggacccagcagucgacgaauacugcugucacccuuacaggauga

SEQ ID NO: 5294 - RNA, 345 nt, Artificial Sequence
  derived and/or modified sequence opt4 from XCL1__Homo_sapiens__AAC50164
augagacugcugauccuggcccugcugggcaucugcagccugaccgccuacaucguggagggcgugggcagcgaggugagcgacaagagaaccugcgugagccugaccacccagagacugcccgugagcagaaucaagaccuacaccaucaccgagggcagccugagagccgugaucuucaucaccaagagaggccugaaggugugcgccgacccccaggccaccugggugagagacguggugagaagcauggacagaaagagcaacaccagaaacaacaugauccagaccaagcccaccggcacccagcagagcaccaacaccgccgugacccugaccggcuga

SEQ ID NO: 5295 - RNA, 345 nt, Artificial Sequence
  derived and/or modified sequence opt5 from XCL1__Homo_sapiens__AAC50164
augagacugcucauccuggcccuucugggcauuugcagccucaccgcuuacaucguggagggggucggauccgaaguuucugacaagcggacaugugugagccugacgacccagcgccuucccguguccagaauuaaaacauauaccaucacagagggcucucugcgggccgucauuuucaucaccaagcgcgggcucaaagugugcgcggauccucaagcuacauggguuagagacgugguccggagcauggaucgcaaguccaacaccagaaauaacaugauccagacgaaaccgaccggaacacagcagucuaccaauacagccgugacccugacgggcuga

SEQ ID NO: 5296 - RNA, 345 nt, Artificial Sequence
  derived and/or modified sequence opt6 from XCL1__Homo_sapiens__AAC50164
augagacuacuaauacuagcauuacuaggaauaugcucacuaacagcauacauaguagaaggaguaggaagcgaaguaucagacaaaagaacaugcguaagccuaacaacacaaagacuaccaguaucaagaauaaaaacauacacaauaacagaaggaagccuaagagcaguaauauucauaacaaaaagaggacuaaaaguaugcgcagacccacaagcaacauggguaagagacguaguaagaucaauggacagaaaaagcaacacaagaaacaacaugauacaaacaaaaccaacaggaacacaacaaucaacaaacacagcaguaacacuaacaggauaa

SEQ ID NO: 5297 - protein, 114 aa, Artificial Sequence
  XCL2__Homo_sapiens__Q9UBD3
MRLLILALLGICSLTAYIVEGVGSEVSHRRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 5298 - RNA, 345 nt, Artificial Sequence
  XCL2__Homo_sapiens__AAH69360
augagacuucucauccuggcccuccuuggcaucugcucucucacugcauacauuguggaagguguagggagugaagucucacauaggaggaccugugugagccucacuacccagcgacugccaguuagcagaaucaagaccuacaccaucacggaaggcuccuugagagcaguaauuuuuauuaccaaacguggccuaaaagucugugcugauccacaagccacgugggugagagacguggucaggagcauggacaggaaauccaacaccagaaauaacaugauccagaccaagccaacaggaacccagcaaucgaccaauacagcugugacccugacuggcuag

SEQ ID NO: 5299 - RNA, 345 nt, Artificial Sequence
  derived and/or modified sequence opt1 from XCL2__Homo_sapiens__AAH69360
augcgccugcucauccuggcccugcucggcaucugcagccugaccgccuacaucguggagggggucggcuccgaggugagccaccggcggaccugcgugucccugacgacccagcgccuccccgucagccgcaucaagaccuacaccaucacggaggggucccugcgggcggugaucuucaucaccaagcgcggccugaaggugugcgccgacccgcaggccaccuggguccgggacguggugcgcagcauggaccggaaguccaacacccgcaacaacaugauccagacgaagcccaccgggacccagcagagcaccaacacggccgucacccucaccggcuga

SEQ ID NO: 5300 - RNA, 345 nt, Artificial Sequence
  derived and/or modified sequence opt2 from XCL2__Homo_sapiens__AAH69360
augcgccuccucauccucgcccuccucggcaucugcucccucaccgccuacaucgucgagggcgucggcuccgaggucucccaccgccgcaccugcgucucccucaccacccagcgccuccccgucucccgcaucaagaccuacaccaucaccgagggcucccuccgcgccgucaucuucaucaccaagcgcggccucaaggucugcgccgacccccaggccaccuggguccgcgacgucguccgcuccauggaccgcaaguccaacacccgcaacaacaugauccagaccaagcccaccggcacccagcaguccaccaacaccgccgucacccucaccggcuga

SEQ ID NO: 5301 - RNA, 345 nt, Artificial Sequence
  derived and/or modified sequence opt3 from XCL2__Homo_sapiens__AAH69360
augagacugcucauccuugcccuguugggcauuugcagcuuaaccgcuuacauaguggagggggucggauccgaaguuucucacaggcggacaugugugucacugacuacgcagcgccuacccguaagucgaaucaagaccuauacaauuacugaggguagccuccgugcagugaucuucauuaccaaaagaggccugaaggucugcgccgacccucaagcgacaugggugagggauguugugcgguccauggaccgcaaaucuaacaccagaaauaacaugauccagacuaagccaacagggacccagcagucgacgaauacugcugucacccuuacaggauga

SEQ ID NO: 5302 - RNA, 345 nt, Artificial Sequence
  derived and/or modified sequence opt4 from XCL2__Homo_sapiens__AAH69360
augagacugcugauccuggcccugcugggcaucugcagccugaccgccuacaucguggagggcgugggcagcgaggugagccacagaagaaccugcgugagccugaccacccagagacugcccgugagcagaaucaagaccuacaccaucaccgagggcagccugagagccgugaucuucaucaccaagagaggccugaaggugugcgccgacccccaggccaccugggugagagacguggugagaagcauggacagaaagagcaacaccagaaacaacaugauccagaccaagcccaccggcacccagcagagcaccaacaccgccgugacccugaccggcuga

SEQ ID NO: 5303 - RNA, 345 nt, Artificial Sequence
  derived and/or modified sequence opt5 from XCL2__Homo_sapiens__AAH69360
augagacugcucauccuggcccuucugggcauuugcagccucaccgcuuacaucguggagggggucggauccgaaguuucucaccggcgcacaugugugagccugacgacccagagacuucccgugucccggauuaagacauauaccaucacagagggcucucugcgcgccgucauuuucaucaccaaaagagggcucaaggugugcgcggacccucaagcuacauggguucgggaugugguccgcagcauggacagaaaauccaacacccggaauaacaugauccagacgaagccgaccggaacacagcagucuaccaauacagccgugacccugacgggcuga

SEQ ID NO: 5304 - RNA, 345 nt, Artificial Sequence
  derived and/or modified sequence opt6 from XCL2__Homo_sapiens__AAH69360
augagacuacuaauacuagcacuauuaggaauaugcucacuaacagcauacauaguagaaggaguaggaagcgaaguaucacacagaagaacaugcguaagucuaacaacacaaagacuaccaguaucaagaauaaaaacauacacaauaacagaaggaagucuaagagcaguaauauucauaacaaaaagaggacuaaaaguaugcgcagacccacaagcaacauggguaagagacguaguaagaucaauggacagaaaaagcaacacaagaaacaacaugauacaaacaaaaccaacaggaacacaacaaucaacaaacacagcaguaacacuaacaggauaa

SEQ ID NO: 5305 - protein, 432 aa, Artificial Sequence
  Cytosine_Deaminase_codA__Escherichia_coli__A0A024KS17
MWRLTVSNNALQTIINARLPGKEGLWQIHLQDGKISAIDAQSGVMPITENSLDAEQGLVIPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAYREGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPIRYSVRGGKVIASTQPAQTTVYLEQPEAIDYKR

SEQ ID NO: 5306 - RNA, 1299 nt, Artificial Sequence
  Cytosine_Deaminase_codA__Escherichia_coli__CDU35197
auguggaggcuaacagugucgaauaacgcuuuacaaacaauuauuaacgcccgguuaccaggcaaagaggggcuguggcagauucaucugcaggacggaaaaaucagcgccauugaugcgcaauccggcgugaugcccauaacugaaaacagccuggaugccgaacaagguuuaguuauaccgccguuuguggagccacauauucaccuggacaccacgcaaaccgccggacaaccaaacuggaaucaguccggcacgcuguuugaaggcauugaacgcugggccgagcgcaaagcguuauuaacccaugacgacgugaaacaacgcgcauggcaaacgcugaaauggcagauugccaacggcauucagcaugugcguacccaugucgaugucuccgacgcaacgcugacugcguugaaagcgaugcuggaagugaaacaggaaguugcgccguggauugaucugcaaaucgucgccuucccgcaggaagggauuuugucguaucccaacggugaagcguugcuggaagaggcgcuacgcuuaggggcagauguuguuggggcgauuccgcauuuugaauuuacccgugaauacggcguggagucgcugcauaaaaccuucgcccuggcgcaaaaauacgaccgucucaucgacguucacugugaugagaucgaugacgagcagucgcgcuuugucgaaaccguugcugcccuggcguaccgugaaggcaugggcgcgcgagucaccgccagccacaccacggcaaugcacuccuauaacggggcguauaccucacgucuguuccgcuugcugaaaauguccgguauuaacuuugucgccaacccgcuggucaauauucaucugcaaggacgauucgauacguauccaaaacgucgcggcaucacgcgcguuaaagagaugcuggaguccggcauuaacgucugcuuuggucacgaugaugucuucgauccgugguauccgcugggaacggcgaauaugcugcaagugcugcauauggggcugcauguuugccaguugaugggcuacgggcagauuaacgauggccugaauuuaaucacccaccacagugccagaacguugaauuugcaggauuacggcauugccgccggaaacagcgcaaaccugauuauccugccggcugaaaauggauuugaugcgcugcgccgucagguuccgauacguuauucgguacguggcggcaaggugauugccaguacacaaccggcacaaaccaccguauaucuggagcagccagaagccaucgauuacaaacgguga

SEQ ID NO: 5307 - RNA, 1299 nt, Artificial Sequence
  derived and/or modified sequence opt1 from Cytosine_Deaminase_codA__Escherichia_coli__CDU35197
auguggcgccugaccgugagcaacaacgcccuccagaccaucaucaacgcccggcugcccggcaaggaggggcuguggcagauccaccuccaggacggcaagaucuccgcgaucgacgcccagagcggggucaugccgaucacggagaacucccuggacgccgagcagggccuggugaucccgcccuucguggagccccacauccaccucgacaccacccagaccgccgggcagcccaacuggaaccagagcggcacgcuguucgagggcaucgagcgcugggccgagcggaaggcgcugcucacccacgacgacgucaagcagcgcgccuggcagacccugaaguggcagaucgccaacgggauccagcacgugcggacccacguggacgucuccgacgccacgcugaccgcgcucaaggccaugcuggaggugaagcaggagguggcccccuggaucgaccugcagaucgucgccuucccccaggagggcauccucagcuaccccaacggggaggcccugcuggaggaggcgcuccgccugggcgccgacguggugggggccaucccgcacuucgaguucacccgggaguacggcgucgagucccugcacaagaccuucgcccucgcccagaaguacgaccgccugaucgacgugcacugcgacgagaucgacgacgagcagagccgguucguggagacggucgcggcccuggccuaccgcgagggcaugggggcccgggugaccgccucccacaccaccgcgaugcacagcuacaacggcgccuacacgucccgccucuuccggcugcugaagaugagcgggaucaacuucguggccaacccccucgucaacauccaccuccagggccgcuucgacaccuaccccaagcggcgcggcaucacccgggugaaggagaugcuggaguccgggaucaacgugugcuucggccacgacgacgucuucgaccccugguacccgcuggggaccgccaacaugcuccaggugcugcacaugggccugcacgugugccagcugaugggguacggccagaucaacgacggccugaaccucaucacgcaccacagcgcccgcacccugaaccugcaggacuacgggaucgcggccggcaacuccgccaaccucaucauccugcccgccgagaacggguucgacgcgcugcggcgccagguccccauccgguacagcgugcgcggcgggaaggucaucgccuccacccagcccgcccagaccacgguguaccucgagcagccggaggccaucgacuacaagcgcuga

SEQ ID NO: 5308 - RNA, 1299 nt, Artificial Sequence
  derived and/or modified sequence opt2 from Cytosine_Deaminase_codA__Escherichia_coli__CDU35197
auguggcgccucaccgucuccaacaacgcccuccagaccaucaucaacgcccgccuccccggcaaggagggccucuggcagauccaccuccaggacggcaagaucuccgccaucgacgcccaguccggcgucaugcccaucaccgagaacucccucgacgccgagcagggccucgucaucccccccuucgucgagccccacauccaccucgacaccacccagaccgccggccagcccaacuggaaccaguccggcacccucuucgagggcaucgagcgcugggccgagcgcaaggcccuccucacccacgacgacgucaagcagcgcgccuggcagacccucaaguggcagaucgccaacggcauccagcacguccgcacccacgucgacgucuccgacgccacccucaccgcccucaaggccaugcucgaggucaagcaggaggucgcccccuggaucgaccuccagaucgucgccuucccccaggagggcauccucuccuaccccaacggcgaggcccuccucgaggaggcccuccgccucggcgccgacgucgucggcgccaucccccacuucgaguucacccgcgaguacggcgucgagucccuccacaagaccuucgcccucgcccagaaguacgaccgccucaucgacguccacugcgacgagaucgacgacgagcagucccgcuucgucgagaccgucgccgcccucgccuaccgcgagggcaugggcgcccgcgucaccgccucccacaccaccgccaugcacuccuacaacggcgccuacaccucccgccucuuccgccuccucaagauguccggcaucaacuucgucgccaacccccucgucaacauccaccuccagggccgcuucgacaccuaccccaagcgccgcggcaucacccgcgucaaggagaugcucgaguccggcaucaacgucugcuucggccacgacgacgucuucgaccccugguacccccucggcaccgccaacaugcuccagguccuccacaugggccuccacgucugccagcucaugggcuacggccagaucaacgacggccucaaccucaucacccaccacuccgcccgcacccucaaccuccaggacuacggcaucgccgccggcaacuccgccaaccucaucauccuccccgccgagaacggcuucgacgcccuccgccgccagguccccauccgcuacuccguccgcggcggcaaggucaucgccuccacccagcccgcccagaccaccgucuaccucgagcagcccgaggccaucgacuacaagcgcuga

SEQ ID NO: 5309 - RNA, 1299 nt, Artificial Sequence
  derived and/or modified sequence opt3 from Cytosine_Deaminase_codA__Escherichia_coli__CDU35197
auguggagacugaccgugagcaacaaugcccuccagacaaucauuaacgcuaggcuucccggcaaggaggggcuguggcaaauacacuugcaggacggaaaaaucuccgcaauugaugcccagucuggugucaugccuaucacugaaaauucauuagacgcggagcagggccugguuauuccaccguucguggaaccccauauccaccuagauacgacccaaacagcugggcagccuaacuggaaucagaguggaacucucuuugagggcauagaacggugggccgagcgcaaggcacugcuuacccaugacgauguaaaacagcgagccuggcaaacacugaaguggcagaucgcuaacgguauucagcacgugcguacccaugucgacgugagcgaugcaacuuugacagcccucaaagcuaugcuggagguuaagcaggaaguggccccauggaucgaccugcaaauugucgcguucccccaggaggggauccucuccuacccuaauggagaagcauuacuggaggaggcccuuagauugggcgcugaugugguaggcgccauaccacacuuugaguucaccagggaauaugggguugaaucucugcacaagacguuugcacuagcucagaaauacgaccggcucauugaugugcauugcgacgagaucgaugacgaacaaucgcgcuucgucgagacuguggccgcgcuggccuauagagagggaaugggugcaagggugaccgcuucacacacaacugccaugcauagcuacaacggcgcuuauaccagucggcuuuuucgccuguugaagauguccgggauuaauuucgucgccaacccccucguuaauauccaucugcagggacgauuugacacauacccuaaaagaaggggcaucacccgggugaaggaaauguuagagucugguauuaacguauguuucgggcacgaugacguguuugauccaugguauccgcugggaacggcaaauaugcuccagguccuucacaugggccugcacgugugccaguugaugggcuacgggcaaauaaacgacggacuaaaucugaucacucaucacagcgcccguacacucaaccugcaggauuacgguauugcugcgggcaacuccgcaaaucuuaucauacugcccgccgaaaacggguucgacgcuuugcgcagacagguuccuauuagguauucagugcggggaggcaaagucaucgccaguacccagccagcacaaacuacaguguaccucgagcagcccgaagccaucgauuauaagcgauga

SEQ ID NO: 5310 - RNA, 1299 nt, Artificial Sequence
  derived and/or modified sequence opt4 from Cytosine_Deaminase_codA__Escherichia_coli__CDU35197
auguggagacugaccgugagcaacaacgcccugcagaccaucaucaacgccagacugcccggcaaggagggccuguggcagauccaccugcaggacggcaagaucagcgccaucgacgcccagagcggcgugaugcccaucaccgagaacagccuggacgccgagcagggccuggugaucccccccuucguggagccccacauccaccuggacaccacccagaccgccggccagcccaacuggaaccagagcggcacccuguucgagggcaucgagagaugggccgagagaaaggcccugcugacccacgacgacgugaagcagagagccuggcagacccugaaguggcagaucgccaacggcauccagcacgugagaacccacguggacgugagcgacgccacccugaccgcccugaaggccaugcuggaggugaagcaggagguggcccccuggaucgaccugcagaucguggccuucccccaggagggcauccugagcuaccccaacggcgaggcccugcuggaggaggcccugagacugggcgccgacguggugggcgccaucccccacuucgaguucaccagagaguacggcguggagagccugcacaagaccuucgcccuggcccagaaguacgacagacugaucgacgugcacugcgacgagaucgacgacgagcagagcagauucguggagaccguggccgcccuggccuacagagagggcaugggcgccagagugaccgccagccacaccaccgccaugcacagcuacaacggcgccuacaccagcagacuguucagacugcugaagaugagcggcaucaacuucguggccaacccccuggugaacauccaccugcagggcagauucgacaccuaccccaagagaagaggcaucaccagagugaaggagaugcuggagagcggcaucaacgugugcuucggccacgacgacguguucgaccccugguacccccugggcaccgccaacaugcugcaggugcugcacaugggccugcacgugugccagcugaugggcuacggccagaucaacgacggccugaaccugaucacccaccacagcgccagaacccugaaccugcaggacuacggcaucgccgccggcaacagcgccaaccugaucauccugcccgccgagaacggcuucgacgcccugagaagacaggugcccaucagauacagcgugagaggcggcaaggugaucgccagcacccagcccgcccagaccaccguguaccuggagcagcccgaggccaucgacuacaagagauga

SEQ ID NO: 5311 - RNA, 1299 nt, Artificial Sequence
  derived and/or modified sequence opt5 from Cytosine_Deaminase_codA__Escherichia_coli__CDU35197
auguggagacugaccgugagcaacaaugcccuccagacaaucauuaacgcucggcugcccggcaaggaggggcuuuggcaaauccaucugcaggacggaaaaauuuccgccaucgaugcgcagucuggcgucaugccuauuacggaaaauagccucgacgcugagcaggggcugguuaucccgcccuucguggaaccucacauccaccuugauaccacacaaaccgccggacagcccaacuggaaucaguccggcacacuguuugaggggauugaacgcugggccgagagaaaggcucuccugacccaugacgaugugaaacagcgggccuggcaaacacugaaguggcagaucgcuaacggcauucagcacguccgcacccauguggacguuucugaugccacgcucaccgcgcugaaagccaugcuugaggugaagcaggaagucgcuccuuggaucgaccugcaaauuguggccuucccccaggagggaauccucagcuacccuaauggcgaagcucugcuugaggaggcccugagacucggggcggauguugugggagccauuccgcacuuugaguucacacgggaauauggcgucgaaucccugcacaagaccuuugcucuggcccagaaauacgaccgccucaucgaugugcauugcgacgagaucgaugacgaacaaucuagauucguggagacagucgcugcccuggccuaucgggaggggaugggagcucgcguuaccgcgagccacacgacagccaugcauuccuacaacggcgcuuauaccagcagacuuuuucggcugcucaagaugucugggauuaauuucguggccaacccccuggugaauauccaccuucagggacgcuuugacacauacccuaaaagacggggcauuacccgcgucaaggaaaugcuggaguccggcaucaacguguguuucgggcacgaugacguuuuugaucccugguauccucucggaaccgccaauaugcuccaggugcugcauaugggccugcacgucugccagcugaugggguacggacaaauuaacgacggccuuaaucugaucacacaucacagcgcuagaacgcucaaccugcaggauuacgggaucgccgcgggaaacucugcuaaucuuauuauccugcccgccgaaaacggcuucgacgcccuccggagacaggugccgauucgcuauuccguucggggcgggaaagugaucgcuagcacccagccugcccaaacaaccgucuaccuggagcagcccgaagcuauugauuauaagagauga

SEQ ID NO: 5312 - RNA, 1299 nt, Artificial Sequence
  derived and/or modified sequence opt6 from Cytosine_Deaminase_codA__Escherichia_coli__CDU35197
auguggagacuaacaguuucaaauaacgcauuacaaacaauaauaaaugcuagacucccaggaaaagaaggacuauggcaaauccauuuacaagauggaaaaaucucagcaauagaugcacaaaguggaguaaugccaauaacagaaaacagccuagaugcagaacaaggcuuaguaauaccaccauuuguagagccacacauacacuuagauacgacucaaacagcaggccaaccaaauuggaaccaaaguggaacacuauuugaaggaauagaaagaugggcagaaagaaaagcauuacuaacacacgaugacguaaaacaaagagcauggcaaacauuaaaauggcaaauagcaaacggaauccaacauguaagaacacacguagacguaucagacgcuacauuaacagcacucaaagcaaugcuagaaguaaaacaagaaguagccccauggauagaucuacaaauaguagcauuuccucaagaaggaauauuauccuauccuaauggagaagcacuacuagaagaagcauuacgacuaggugcagacguaguaggagcaaucccucauuuugaauucacaagggaauacggcguagaaagcuuacacaaaaccuuugcucuagcacaaaaauacgacagauuaauagauguccauugcgacgaaauagacgaugaacaaucaagauuuguagaaacaguagcagcauuagcauauagagaagguaugggugcaagaguaacagcaucacauacuacagcaaugcauagcuacaauggugcauacacaucaagacucuuuagauuacuuaaaaugaguggaauaaauuuuguugcuaacccacuaguaaacauacaccuucaaggaagauucgauacguacccaaaaagaagagguaucacaagaguaaaagagauguuagaaucaggaauaaacguaugcuucggacacgacgauguauuugacccaugguauccauuaggaacagccaauaugcuacaaguacuacauaugggucuccauguaugucaacucaugggauacggucaaauaaacgauggacuaaauuuaauaacucaucacucagcaagaacucuaaaccuacaagacuauggaauagccgcaggaaauucagcaaauuugauaauacuaccagcagaaaacgguuuugacgcacuaagaagacaaguuccaauaagauauagcgucagagguggaaaaguaauagcaagcacucaaccagcucaaacaacaguuuacuuagaacaaccagaagcaauagacuauaaaagauaa

SEQ ID NO: 5313 - protein, 432 aa, Artificial Sequence
  Cytosine_Deaminase_codA__Escherichia_coli__A0A0H2V4N7
MWRLTVSNNALQTIINARLPGKEGLWQIHLHDGKISAIDTQSGVMPVTENSLDAEQGLVLPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAHREGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVMASTQPAQTTVYLEQPEAIDYKR

SEQ ID NO: 5314 - RNA, 1299 nt, Artificial Sequence
  Cytosine_Deaminase_codA__Escherichia_coli__AAN78935
auguggaggcuaacagugucgaauaacgcuuuacaaacaauuauuaacgcccgguuacccggcaaagaggggcuguggcagauucaucuucacgacggaaaaaucagcgccauugauacgcaaucuggugugaugcccguaacugaaaacagccuggaugccgaacaagguuuaguuuuaccgccguuuguggagccgcauauucaccuggacaccacgcaaaccgccggacaaccgaacuggaaucaguccggcacgcuguuugaaggcauugaacgcugggccgagcgcaaagcguuauuaacccaugacgaugugaaacaacgcgccuggcaaacgcugaaauggcagauugccaacggcauucagcaugugcguacccaugucgaugucuccgacgcaacgcugacugcguugaaagcgaugcuggaagugaaacaggaaguugcgccguggauugaucugcaaaucgucgccuucccgcaggaagggauuuugucguaucccaacggugaagcguugcuggaagaggcguuacgcuuaggggcagacguuguuggggcgauuccgcauuuugaauuuacccgugaauauggcguggagucgcugcauaaaaccuucgcccuggcgcaaaaauacgaccgucucaucgauguucacugugacgagauugaugaugagcaaucacgcuuugucgaaaccguugcugcccuggcgcaccgugaaggcaugggcgcgcgagucaccgccagccauacuacggcaaugcacuccuauaacggggcguauacuucgcgccuguuucguuugcugaaaauguccgguauuaacuuugucgccaacccguuggucaauauucaucugcaaggacguuucgauacguauccaaaacgucgcggcaucacgcgcguuaaagagaugcuggaguccggcauuaacgucugcuuuggucacgaugaugucuucgauccgugguauccgcugggaacggcgaauaugcugcaagugcugcauauggggcugcauguuugccagcugaugggcuacgggcagauuaacgacggccugaauuuaaucacccaccacagcgccaggacguugaauuugcaggauuacggcauugccgccggaaacagcgccaaccugauuauccugccggcugaaaauggguuugaugcguugcgccgucagguuccgguacguuauucgguacguggcgguaaggugauggccagcacacaaccggcacaaaccaccguauaucuggagcagccagaagccaucgauuacaaacgguaa

SEQ ID NO: 5315 - RNA, 1299 nt, Artificial Sequence
  derived and/or modified sequence opt1 from Cytosine_Deaminase_codA__Escherichia_coli__AAN78935
auguggcgccugaccgugagcaacaacgcccuccagaccaucaucaacgcccggcugcccggcaaggaggggcuguggcagauccaccuccacgacggcaagaucuccgcgaucgacacgcagagcggggucaugccggugaccgagaacucccuggacgccgagcagggccuggugcucccgcccuucgucgagccccacauccaccuggacaccacccagacggccgggcagcccaacuggaaccagagcggcacccuguucgagggcaucgagcgcugggccgagcggaaggcccuccugacccacgacgacgugaagcagcgcgcguggcagacccugaaguggcagaucgccaacgggauccagcacgugcggacgcacgucgacguguccgacgccacccucaccgcccugaaggcgaugcuggaggugaagcaggaggucgcccccuggaucgaccuccagaucguggccuucccccaggagggcauccugagcuaccccaacggggaggcccugcucgaggaggcccugcgccugggcgcggacguggucggggccaucccgcacuucgaguucacccgggaguacggcguggagucccuccacaagacguucgcccuggcccagaaguacgaccgccugaucgacgugcacugcgacgagaucgacgacgagcagagccgguucgucgagaccguggccgcgcucgcccaccgcgagggcaugggggcccgggugaccgccucccacaccacggccaugcacagcuacaacggcgcguacaccucccgccuguuccggcugcucaagaugagcgggaucaacuucgucgccaacccccuggugaacauccaccuccagggccgcuucgacaccuaccccaagcggcgcggcaucacccgggugaaggagaugcuggaguccgggaucaacgucugcuucggccacgacgacguguucgaccccugguacccgcuggggacggccaacaugcuccaggugcugcacaugggccugcacgucugccagcugaugggguacggccagaucaacgacggccucaaccugaucacccaccacagcgcccgcacccugaaccuccaggacuacgggaucgccgcgggcaacuccgccaaccugaucauccugcccgccgagaacggguucgacgcccuccggcgccaggugcccguccgguacagcgugcgcggcgggaaggugauggcguccacccagcccgcccagacgaccgucuaccuggagcagccggaggccaucgacuacaagcgcuga

SEQ ID NO: 5316 - RNA, 1299 nt, Artificial Sequence
  derived and/or modified sequence opt2 from Cytosine_Deaminase_codA__Escherichia_coli__AAN78935
auguggcgccucaccgucuccaacaacgcccuccagaccaucaucaacgcccgccuccccggcaaggagggccucuggcagauccaccuccacgacggcaagaucuccgccaucgacacccaguccggcgucaugcccgucaccgagaacucccucgacgccgagcagggccucguccucccccccuucgucgagccccacauccaccucgacaccacccagaccgccggccagcccaacuggaaccaguccggcacccucuucgagggcaucgagcgcugggccgagcgcaaggcccuccucacccacgacgacgucaagcagcgcgccuggcagacccucaaguggcagaucgccaacggcauccagcacguccgcacccacgucgacgucuccgacgccacccucaccgcccucaaggccaugcucgaggucaagcaggaggucgcccccuggaucgaccuccagaucgucgccuucccccaggagggcauccucuccuaccccaacggcgaggcccuccucgaggaggcccuccgccucggcgccgacgucgucggcgccaucccccacuucgaguucacccgcgaguacggcgucgagucccuccacaagaccuucgcccucgcccagaaguacgaccgccucaucgacguccacugcgacgagaucgacgacgagcagucccgcuucgucgagaccgucgccgcccucgcccaccgcgagggcaugggcgcccgcgucaccgccucccacaccaccgccaugcacuccuacaacggcgccuacaccucccgccucuuccgccuccucaagauguccggcaucaacuucgucgccaacccccucgucaacauccaccuccagggccgcuucgacaccuaccccaagcgccgcggcaucacccgcgucaaggagaugcucgaguccggcaucaacgucugcuucggccacgacgacgucuucgaccccugguacccccucggcaccgccaacaugcuccagguccuccacaugggccuccacgucugccagcucaugggcuacggccagaucaacgacggccucaaccucaucacccaccacuccgcccgcacccucaaccuccaggacuacggcaucgccgccggcaacuccgccaaccucaucauccuccccgccgagaacggcuucgacgcccuccgccgccagguccccguccgcuacuccguccgcggcggcaaggucauggccuccacccagcccgcccagaccaccgucuaccucgagcagcccgaggccaucgacuacaagcgcuga

SEQ ID NO: 5317 - RNA, 1299 nt, Artificial Sequence
  derived and/or modified sequence opt3 from Cytosine_Deaminase_codA__Escherichia_coli__AAN78935
auguggagacugaccgugagcaacaaugcccuccagacaaucauuaacgcuaggcuucccggcaaggaggggcuguggcaaauacacuugcaugacggaaaaaucuccgcaauugauacucagucuggugucaugccuguuacggaaaauucauuagacgccgagcagggccuggugcuaccaccguucguagaaccccacauccaucucgauaccacacagacugcggggcaaccuaacuggaaucagaguggaacccuguuugagggcauugaacggugggcugagcgcaaggcccuucugacacacgacgaugugaaacagcgagcauggcagaccuugaaguggcaaaucgccaacgguauacagcauguccguacucacguggacguuagcgaugcuacacucaccgcacugaaagccaugcuggaggugaagcaggaagucgcuccauggaucgaccuccagauuguggccuucccccaagaggggaucuuauccuacccuaauggagaagcgcugcuugaggaggcauugagacugggcgccgauguaguuggcgcuauuccacacuuugaguucacgagggaauaugggguggaaucucuacauaagacuuuugcccucgcacagaaauacgaccggcugaucgauguccacugcgacgagauagaugacgaacagucgcgcuucguggagaccguggcugcccuugcgcauagagagggaaugggugccagggucacagcaucacacacuaccgcuaugcacagcuauaacggcgccuacacaagucggcuguuucgcuugcucaagauguccgggauuaauuucguugcuaacccccuggugaauauccauuuacaaggacgauuugacaccuauccuaaaagaaggggcauuacgcggguaaaggaaaugcuggagucugguaucaacguguguuucgggcacgaugacgucuuugauccaugguacccgcucggaacugccaauaugcuucaggugcugcauaugggcuugcacguuugccagcuaaugggcuaugggcagaucaacgacggacugaaucucauuacacaucacagcgcacguacccugaaccuucaagauuacgguauagccgcuggcaacuccgcgaaucugaucauuuugcccgcagaaaacggguucgacgcccuccgcagacaggugccugucagguacucagugcggggaggcaaaguaauggcuaguacucagccagcccagacaaccguuuaucuggagcaacccgaagcaaucgauuacaagcgauga

SEQ ID NO: 5318 - RNA, 1299 nt, Artificial Sequence
  derived and/or modified sequence opt4 from Cytosine_Deaminase_codA__Escherichia_coli__AAN78935
auguggagacugaccgugagcaacaacgcccugcagaccaucaucaacgccagacugcccggcaaggagggccuguggcagauccaccugcacgacggcaagaucagcgccaucgacacccagagcggcgugaugcccgugaccgagaacagccuggacgccgagcagggccuggugcugccccccuucguggagccccacauccaccuggacaccacccagaccgccggccagcccaacuggaaccagagcggcacccuguucgagggcaucgagagaugggccgagagaaaggcccugcugacccacgacgacgugaagcagagagccuggcagacccugaaguggcagaucgccaacggcauccagcacgugagaacccacguggacgugagcgacgccacccugaccgcccugaaggccaugcuggaggugaagcaggagguggcccccuggaucgaccugcagaucguggccuucccccaggagggcauccugagcuaccccaacggcgaggcccugcuggaggaggcccugagacugggcgccgacguggugggcgccaucccccacuucgaguucaccagagaguacggcguggagagccugcacaagaccuucgcccuggcccagaaguacgacagacugaucgacgugcacugcgacgagaucgacgacgagcagagcagauucguggagaccguggccgcccuggcccacagagagggcaugggcgccagagugaccgccagccacaccaccgccaugcacagcuacaacggcgccuacaccagcagacuguucagacugcugaagaugagcggcaucaacuucguggccaacccccuggugaacauccaccugcagggcagauucgacaccuaccccaagagaagaggcaucaccagagugaaggagaugcuggagagcggcaucaacgugugcuucggccacgacgacguguucgaccccugguacccccugggcaccgccaacaugcugcaggugcugcacaugggccugcacgugugccagcugaugggcuacggccagaucaacgacggccugaaccugaucacccaccacagcgccagaacccugaaccugcaggacuacggcaucgccgccggcaacagcgccaaccugaucauccugcccgccgagaacggcuucgacgcccugagaagacaggugcccgugagauacagcgugagaggcggcaaggugauggccagcacccagcccgcccagaccaccguguaccuggagcagcccgaggccaucgacuacaagagauga

SEQ ID NO: 5319 - RNA, 1299 nt, Artificial Sequence
  derived and/or modified sequence opt5 from Cytosine_Deaminase_codA__Escherichia_coli__AAN78935
auguggagacugaccgugagcaacaaugcccuccagacaaucauuaacgcucggcugcccggcaaggaggggcuuuggcaaauccaucugcacgacggaaaaauuuccgccaucgauacgcagucuggcgucaugccuguuaccgaaaauagccucgacgcggagcaggggcuggugcuuccgcccuucguggaaccucacauucaucuggauacaacccagacagcuggacaacccaacuggaaucaguccggcacccucuuugaggggaucgaacgcugggccgagagaaaggcccugcugacacacgacgaugucaaacagcgggcuuggcagacccucaaguggcaaaucgccaacggcauucagcaugugcgcacgcacguugacgugucugaugcuacccugacagcccuuaaagcgaugcuggaggucaagcaggaaguggccccuuggaucgaccuccagauuguugcuuucccccaagagggaauccugagcuacccuaauggcgaagcccuucuggaggaggcucucagacugggggccgauguggucggagcgauuccgcacuuugaguucacccgggaauauggcguggaaucccugcauaagacauuugcccucgcucagaaauacgaccgccugaucgaugugcacugcgacgagauugaugacgaacagucuagauucgucgagaccguugccgcucuugcccaucgggaggggaugggagcccgcgugacggcuagccacacaaccgcgaugcacuccuauaacggcgccuacacaagcagacuguuucggcuccugaagaugucugggaucaauuucguggcuaacccccuugucaauauccaucugcaaggacgcuuugacaccuauccuaaaagacggggcauuacccgcgugaaggaaaugcucgaguccggcaucaacguuuguuucgggcacgaugacguguuugaucccugguacccucugggaacagccaauaugcugcagguccuccauaugggccugcacgugugccagcuuaugggguauggacagauuaacgacggccugaaucucaucacgcaucacagcgccagaacccugaaccuucaagauuacgggauugcugccggaaacucugcgaaucugaucauccuccccgcugaaaacggcuucgacgcccugcggagacagguuccggugcgcuacuccguccggggcgggaaagugauggccagcacacagccugcucagaccacagucuaucuggagcaacccgaagccauugauuacaagagauga

SEQ ID NO: 5320 - RNA, 1299 nt, Artificial Sequence
  derived and/or modified sequence opt6 from Cytosine_Deaminase_codA__Escherichia_coli__AAN78935
auguggagacuaacagucucaaauaacgcuuuacaaacaauaauaaaugcaagacuaccaggaaaagaaggacuauggcaaauacaccuacacgacggaaaaauaagcgcaauagacacacaaucaggaguaaugccagucacagaaaauagcuuagacgcugaacaaggauugguauuaccaccauuuguagaaccacacauccacuuagacacuacacaaacagccggacaaccaaauuggaaccaaaguggaacacuauucgaaggaauagaaagaugggcagaaagaaaagcacuauuaacccacgacgacguaaaacaaagagcauggcaaacacuaaaauggcaaauagcaaaugggauacaacauguacgaacacauguagauguaucagaugcaacauuaaccgcauugaaagcaauguuagaaguaaaacaagaagucgcaccauggauagaccuacaaauugucgcauucccccaagaaggaauacuaucauaccccaauggugaagcauuacuagaagaagcacuaagacucggagcagauguaguuggagcaauaccacacuuugaauucacuagagaauauggagucgaaagccuacacaaaacauuugcacuagcucaaaaauaugauagauuaauagacguacacugugaugaaauagaugaugaacaaucaagguuuguagaaacaguagcagcauuagcacauagagaaggaaugggagcaagaguaacagcaagucauacaacagcaaugcauucauacaacggagcauacacaagcagacuauuuaggcuacuaaaaauguccggaauaaauuuugucgcaaacccacuaguaaacauacacuuacaaggacgauucgacacauacccaaaaagacgaggaaucacuagaguaaaagaaauguuagaaucaggaauaaacguaugcuuuggacaugacgauguuuuugaucccugguauccauuaggaacagccaacauguuacaaguacuacacaugggacuacaugucugucaauuaauggguuauggacaaauaaacgaugguuuaaaucuaauaacacaccacucagcaagaacauuaaauuuacaagacuacggaauagcagcaggaaauucagcaaacuuaauaauacuaccugcagaaaacggauucgacgcguuaagacgacaaguacccguaagauacagcguaagagguggaaaaguaauggcaucaacucaacccgcacaaacaacaguuuacuuagaacaaccagaagcaauagacuauaaaagauaa

SEQ ID NO: 5321 - protein, 432 aa, Artificial Sequence
  Cytosine_Deaminase_codA__Escherichia_coli__A0A0H2YX33
MWRLTVSNNALQTIINAQLPGKEGLWQIHLHDGKISAIDAQSGVMPVTENSLDAEQGLVLPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAHREGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVIASTQPAQTTVYLEQPEAIDYKR

SEQ ID NO: 5322 - RNA, 1299 nt, Artificial Sequence
  Cytosine_Deaminase_codA__Escherichia_coli__ABI99817
auguggaggcuaacagugucgaauaaugcuuuacaaacaauuauuaacgcccaguuacccggcaaagaggggcuguggcagauucaucuucacgacggaaaaaucagcgccauugaugcgcaauccggggugaugcccguaacugaaaacagccuggaugccgaacaagguuuaguuuuaccgccguuuguggagccgcauauucaccuggacaccacgcaaaccgccggacaaccgaacuggaaucaguccggcacgcuguuugaaggcauugaacgcugggccgagcgcaaagcguuauuaacucaugacgaugugaaacaacgcgcauggcaaacgcugaaauggcagauugccaacggcauucagcaugugcguacccaugucgaugucuccgacgcaacgcugacugcguugaaagcgaugcuggaagugaaacaggaaguugcgccguggauugaucugcaaaucgucgccuucccgcaggaagggauuuugucguaucccaacggugaagcguugcuggaagaggcgcuacgcuuaggggcagauguuguuggggcgauuccgcauuuugaauuuacccgugaauacggcguggagucgcugcauaaaaccuucgcccuggcgcaaaaauacgaccgucucaucgacguucacugugaugagaucgaugacgagcagucgcgcuuugucgaaaccguugcugcccuggcgcaccgugaaggcaugggcgcgcgagucaccgccagccauacuacggcaaugcacuccuauaacggggcguauacuucgcgccuguuccguuugcugaaaauguccgguauuaacuuugucgccaacccguuggucaauauucaucugcaaggacguuucgauacguauccaaaacgucgcggcaucacgcgcguuaaagagaugcuggaguccggcauuaacgucugcuuuggucacgaugaugucuucgauccgugguauccgcugggaacggcgaauaugcugcaagugcugcauauggggcugcauguuugccagcugaugggcuacgggcagauuaacgacggccugaauuuaaucacccaccacagcgccaggacguugaauuugcaggauuacggcauugccgccggaaacagcgccaaccugauuauccugccggcugaaaauggguuugaugcgcugcgccgucagguuccgguacguuauucgguacguggcggcaaggugauugccagcacacaaccggcacaaaccaccguauaucuggagcagccagaagccaucgauuacaaacgguaa

SEQ ID NO: 5323 - RNA, 1299 nt, Artificial Sequence
  derived and/or modified sequence opt1 from Cytosine_Deaminase_codA__Escherichia_coli__ABI99817
auguggcgccugaccgugagcaacaacgcccuccagaccaucaucaacgcccagcugcccggcaaggaggggcuguggcagauccaccuccacgacggcaagaucuccgcgaucgacgcccagagcggggucaugccggugacggagaacucccuggacgccgagcagggccuggugcucccgcccuucgucgagccccacauccaccuggacaccacccagaccgccgggcagcccaacuggaaccagagcggcacgcuguucgagggcaucgagcggugggccgagcgcaaggcgcuccugacccacgacgacgugaagcagcgggccuggcagacccugaaguggcagaucgccaacgggauccagcacgugcgcacccacgucgacguguccgacgccacgcucaccgcgcugaaggccaugcuggaggugaagcaggaggucgcccccuggaucgaccuccagaucguggccuucccccaggagggcauccugagcuaccccaacggggaggcccugcucgaggaggcgcugcggcugggcgccgacguggucggggccaucccgcacuucgaguucacccgcgaguacggcguggagucccuccacaagaccuucgcccuggcccagaaguacgaccggcugaucgacgugcacugcgacgagaucgacgacgagcagagccgcuucgucgagacgguggcggcccucgcccaccgggagggcaugggggcccgcgugaccgccucccacaccaccgcgaugcacagcuacaacggcgccuacacgucccggcuguuccgccugcucaagaugagcgggaucaacuucgucgccaacccccuggugaacauccaccuccagggccgguucgacaccuaccccaagcgccggggcaucacccgcgugaaggagaugcuggaguccgggaucaacgucugcuucggccacgacgacguguucgaccccugguacccgcuggggaccgccaacaugcuccaggugcugcacaugggccugcacgucugccagcugaugggguacggccagaucaacgacggccucaaccugaucacgcaccacagcgcccggacccugaaccuccaggacuacgggaucgcggccggcaacuccgccaaccugaucauccugcccgccgagaacggguucgacgcgcuccgccgccaggugcccguccgguacagcgugcggggcgggaaggugaucgccuccacccagcccgcccagaccacggucuaccuggagcagccggaggccaucgacuacaagcgcuga

SEQ ID NO: 5324 - RNA, 1299 nt, Artificial Sequence
  derived and/or modified sequence opt2 from Cytosine_Deaminase_codA__Escherichia_coli__ABI99817
auguggcgccucaccgucuccaacaacgcccuccagaccaucaucaacgcccagcuccccggcaaggagggccucuggcagauccaccuccacgacggcaagaucuccgccaucgacgcccaguccggcgucaugcccgucaccgagaacucccucgacgccgagcagggccucguccucccccccuucgucgagccccacauccaccucgacaccacccagaccgccggccagcccaacuggaaccaguccggcacccucuucgagggcaucgagcgcugggccgagcgcaaggcccuccucacccacgacgacgucaagcagcgcgccuggcagacccucaaguggcagaucgccaacggcauccagcacguccgcacccacgucgacgucuccgacgccacccucaccgcccucaaggccaugcucgaggucaagcaggaggucgcccccuggaucgaccuccagaucgucgccuucccccaggagggcauccucuccuaccccaacggcgaggcccuccucgaggaggcccuccgccucggcgccgacgucgucggcgccaucccccacuucgaguucacccgcgaguacggcgucgagucccuccacaagaccuucgcccucgcccagaaguacgaccgccucaucgacguccacugcgacgagaucgacgacgagcagucccgcuucgucgagaccgucgccgcccucgcccaccgcgagggcaugggcgcccgcgucaccgccucccacaccaccgccaugcacuccuacaacggcgccuacaccucccgccucuuccgccuccucaagauguccggcaucaacuucgucgccaacccccucgucaacauccaccuccagggccgcuucgacaccuaccccaagcgccgcggcaucacccgcgucaaggagaugcucgaguccggcaucaacgucugcuucggccacgacgacgucuucgaccccugguacccccucggcaccgccaacaugcuccagguccuccacaugggccuccacgucugccagcucaugggcuacggccagaucaacgacggccucaaccucaucacccaccacuccgcccgcacccucaaccuccaggacuacggcaucgccgccggcaacuccgccaaccucaucauccuccccgccgagaacggcuucgacgcccuccgccgccagguccccguccgcuacuccguccgcggcggcaaggucaucgccuccacccagcccgcccagaccaccgucuaccucgagcagcccgaggccaucgacuacaagcgcuga

SEQ ID NO: 5325 - RNA, 1299 nt, Artificial Sequence
  derived and/or modified sequence opt3 from Cytosine_Deaminase_codA__Escherichia_coli__ABI99817
auguggagacugaccgugagcaacaaugcccuccagacaaucauuaacgcucaacuucccggcaaggaggggcuguggcagauacacuugcaugacggaaaaaucuccgcaauugaugcccagucuggugucaugccuguuacugaaaauucauuagacgcggagcagggccuggugcuaccaccguucguagaaccccacauccaucucgauacgacccaaacagcugggcagccuaacuggaaucagaguggaacucuguuugagggcauugaaaggugggccgagcggaaggcacuucugacccacgacgaugugaaacagcgcgccuggcaaacauugaaguggcagaucgcuaacgguauacagcauguccgaacccacguggacguuagcgaugcaacucucacagcccugaaagcuaugcuggaggugaagcaggaagucgccccauggaucgaccuccaaauuguggcguucccccaggaggggaucuuauccuacccuaauggagaagcacugcuugaggaggccuugcgucugggcgcugauguaguuggcgccauuccacacuuugaguucaccagagaauaugggguggaaucucuacauaagacguuugcacucgcucagaaauacgacaggcugaucgauguccacugcgacgagauagaugacgaacaaucgcgguucguggagacuguggccgcgcuugcccaucgcgagggaaugggugcaagagucaccgcuucacacacaacugccaugcacagcuauaacggcgcuuacaccaguaggcuguuucgguugcucaagauguccgggauuaauuucguugccaacccccuggugaauauccauuuacagggacgcuuugacacauauccuaaacgaagaggcauuaccaggguaaaggaaaugcuggagucugguaucaacguguguuucgggcacgaugacgucuuugauccaugguacccgcucggaacggcaaauaugcuucaggugcugcauaugggcuugcacguuugccagcuaaugggcuaugggcaaaucaacgacggacugaaucucauuacucaucacagcgcccggacacugaaccuucaggauuacgguauagcugcgggcaacuccgcaaaucugaucauuuugcccgccgaaaacggguucgacgcucuccgucgccaggugccugucagauacucagugaggggaggcaaaguaaucgccaguacccagccagcacaaacuacaguuuaucuggagcagcccgaagccauagauuacaagcgguga

SEQ ID NO: 5326 - RNA, 1299 nt, Artificial Sequence
  derived and/or modified sequence opt4 from Cytosine_Deaminase_codA__Escherichia_coli__ABI99817
auguggagacugaccgugagcaacaacgcccugcagaccaucaucaacgcccagcugcccggcaaggagggccuguggcagauccaccugcacgacggcaagaucagcgccaucgacgcccagagcggcgugaugcccgugaccgagaacagccuggacgccgagcagggccuggugcugccccccuucguggagccccacauccaccuggacaccacccagaccgccggccagcccaacuggaaccagagcggcacccuguucgagggcaucgagagaugggccgagagaaaggcccugcugacccacgacgacgugaagcagagagccuggcagacccugaaguggcagaucgccaacggcauccagcacgugagaacccacguggacgugagcgacgccacccugaccgcccugaaggccaugcuggaggugaagcaggagguggcccccuggaucgaccugcagaucguggccuucccccaggagggcauccugagcuaccccaacggcgaggcccugcuggaggaggcccugagacugggcgccgacguggugggcgccaucccccacuucgaguucaccagagaguacggcguggagagccugcacaagaccuucgcccuggcccagaaguacgacagacugaucgacgugcacugcgacgagaucgacgacgagcagagcagauucguggagaccguggccgcccuggcccacagagagggcaugggcgccagagugaccgccagccacaccaccgccaugcacagcuacaacggcgccuacaccagcagacuguucagacugcugaagaugagcggcaucaacuucguggccaacccccuggugaacauccaccugcagggcagauucgacaccuaccccaagagaagaggcaucaccagagugaaggagaugcuggagagcggcaucaacgugugcuucggccacgacgacguguucgaccccugguacccccugggcaccgccaacaugcugcaggugcugcacaugggccugcacgugugccagcugaugggcuacggccagaucaacgacggccugaaccugaucacccaccacagcgccagaacccugaaccugcaggacuacggcaucgccgccggcaacagcgccaaccugaucauccugcccgccgagaacggcuucgacgcccugagaagacaggugcccgugagauacagcgugagaggcggcaaggugaucgccagcacccagcccgcccagaccaccguguaccuggagcagcccgaggccaucgacuacaagagauga

SEQ ID NO: 5327 - RNA, 1299 nt, Artificial Sequence
  derived and/or modified sequence opt5 from Cytosine_Deaminase_codA__Escherichia_coli__ABI99817
auguggagacugaccgugagcaacaaugcccuccagacaaucauuaacgcucaacugcccggcaaggaggggcuuuggcagauccaccuucaugacggaaaaauuuccgccaucgaugcgcagucuggcgucaugccuguuacggaaaauagccucgacgcugagcaggggcuggugcuuccgcccuucguggaaccucacauucaucuggauaccacacaaaccgccggacagcccaacuggaaucaguccggcacacucuuugaggggaucgaacggugggccgagcgcaaggcucugcugacccacgacgaugucaaacagagagccuggcaaacacucaaguggcagaucgcuaacggcauucagcaugugcggacccacguugacgugucugaugccacgcugaccgcgcuuaaagccaugcuggaggucaagcaggaaguggcuccuuggaucgaccuccaaauuguugccuucccccaggagggaauccugagcuacccuaauggcgaagcucugcuggaggaggcccuccgccugggggcggauguggucggagccauuccgcacuuugaguucacaagagaauauggcguggaaucccugcauaagaccuuugcucucgcccagaaauacgaccggcugaucgaugugcacugcgacgagauugaugacgaacaaucucgcuucgucgagacaguugcugcccuugcccauagagaggggaugggagcucgggugaccgcgagccacacgacagccaugcacuccuauaacggcgcuuacaccagccgccuguuuagacuccugaagaugucugggaucaauuucguggccaacccccuugucaauauccaucugcagggacgguuugacacauauccuaaacgcagaggcauuacccgggugaaggaaaugcucgaguccggcaucaacguuuguuucgggcacgaugacguguuugaucccugguacccucugggaaccgccaauaugcugcagguccuccauaugggccugcacgugugccagcuuaugggguauggacaaauuaacgacggccugaaucucaucacacaucacagcgcucgcacgcugaaccuucaggauuacgggauugccgcgggaaacucugcuaaucugaucauccuccccgccgaaaacggcuucgacgcccugagacggcagguuccggugagauacuccguccgcggcgggaaagugauugcuagcacccagccugcccaaacaaccgucuaucuggagcagcccgaagcuaucgauuacaagcgguga

SEQ ID NO: 5328 - RNA, 1299 nt, Artificial Sequence
  derived and/or modified sequence opt6 from Cytosine_Deaminase_codA__Escherichia_coli__ABI99817
auguggagauuaacaguaucaaauaaugcacuacaaacaauaauaaaugcacaacuaccuggaaaagaaggacuauggcaaauacaucuacacgauggaaaaauaucugcaauagacgcacaaucaggaguaaugccagucacagaaaauagcuuagacgcugaacaaggacuaguacuccccccauucgucgaaccacauauacacuuagauacuacacaaacagccggacaaccaaauuggaaucaaucaggaacauuauuugaaggaauagaaagaugggccgaaagaaaagcauuacuaacacacgaugacguaaaacaaagagcuuggcaaacauuaaaauggcaaauagcaaauggcauacagcaugucagaacacacgucgauguaucugacgcaacccuaacagcacuaaaagcuaugcuagaaguaaaacaagaaguagcuccauggauagauuuacaaauagucgcauuuccacaagaaggaauacuaucauaucccaauggagaagcuuuauuagaagaagcuuuaagacuaggugcagaugucguuggagcaaucccucauuucgaauucacaagagaauacggaguugaaucacuacacaaaacauucgcacuagcccaaaaauacgaucgauuaauagacguucauugcgaugaaauagaugaugaacaaucacgauuuguugaaacaguagcagcauuagcacauagagaaggcaugggagcacgaguaacagcaucacacacaacugcaaugcacucauacaauggagcauauacaucacgguuauucagacuacuaaaaaugagugggauaaacuuuguagccaacccacuaguaaacauacacuuacaaggacgauuugacacauauccuaaaagacgaggaauaaccagaguaaaagaaaugcuagaaucaggaaucaauguaugcuucggacacgaugauguauuugacccaugguauccacuuggcacagcaaauauguuacaaguacuccauaugggacuacaugucugucaacuaaugggauacggacaaauaaacgauggauuaaaccuaauaacacaccauucugcaagaacuuuaaauuuacaagauuauggaauagcagcaggcaauucagcaaaccuuauaauucuacccgcagaaaauggcuucgaugcauuaagaagacaaguuccaguaagauauucaguaagaggaggaaaaguaaucgcaucaacacaaccugcacaaacaacaguauaccuagaacaaccagaagcaauagacuauaaacgauaa

SEQ ID NO: 5329 - protein, 432 aa, Artificial Sequence
  Cytosine_Deaminase_codA__Escherichia_coli__F4NM90
MWRLTVSNNALQTIINARLPGKEGLWQIHLQDGKISAIDAQSGVMPITENSLDAEQGLVIPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAHREGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVIASTQPAQTTVYLEQPEAIDYKR

SEQ ID NO: 5330 - RNA, 1299 nt, Artificial Sequence
  Cytosine_Deaminase_codA__Escherichia_coli__EGJ07181
auguggagguuaacagugucgaauaacgcuuuacaaacaauuauuaacgcccgguuaccaggcaaagaggggcuguggcagauucaucugcaggacggaaaaaucagcgccauugaugcgcaauccggcgugaugcccauaacugaaaacagccuggaugccgaacaagguuuaguuauaccgccguuuguggagccgcauauucaccuggacaccacgcaaaccgccggacaaccgaacuggaaucaguccggcacgcuguuugaaggcauugaacgcugggccgagcgcaaagcguuauuaacccaugacgaugugaaacaacgcgccuggcaaacgcugaaauggcagauugccaacggcauucagcaugugcguacccaugucgauguuucggaugcaacgcuaacugcgcugaaagcaaugcuggaagugaagcaggaagucgcgccguggauugaucugcaaauugucgccuucccucaggaagggauuuugucguaucccaacggugaagcguugcuggaagaggcguuacgcuuaggggcagauguagugggggcgauuccgcauuuugaauuuacccgugaauacggcguggagucgcugcauaaaaccuucgcccuggcgcaaaaauacgaccgucucaucgacguucacugugaugagaucgaugacgagcagucgcgcuuugucgaaaccguugcugcccuggcgcaccgugaaggcaugggcgcgcgagucaccgccagccacaccacggcaaugcacuccuauaacggggcguauaccucacgccuguuccgcuugcugaaaauguccgguauuaacuuugucgccaacccgcuggucaauauucaucugcaaggacguuucgauacguauccaaaacgucgcggcaucacgcgcguuaaagagaugcuggaguccggcauuaacgucugcuuuggucacgaugaugucuucgauccgugguauccgcugggaacggcgaauaugcugcaagugcugcauauggggcugcauguuugccaguugaugggcuacgggcagauuaacgauggccugaauuuaaucacccaccacagugccagaacauugaauuugcaggauuacggcauugccgccggaaacagcgcaaaccugauuauccugccggcugaaaauggauuugaugcgcugcgccgucagguuccgguacguuauucgguacguggcggcaaggugauugccaguacacaaccggcacaaaccaccguauaucuggagcagccagaagccaucgauuacaaacgguaa

SEQ ID NO: 5331 - RNA, 1299 nt, Artificial Sequence
  derived and/or modified sequence opt1 from Cytosine_Deaminase_codA__Escherichia_coli__EGJ07181
auguggcgccugaccgugagcaacaacgcccuccagaccaucaucaacgcccggcugcccggcaaggaggggcuguggcagauccaccuccaggacggcaagaucuccgcgaucgacgcccagagcggggucaugccgaucacggagaacucccuggacgccgagcagggccuggugaucccgcccuucguggagccccacauccaccucgacaccacccagaccgccgggcagcccaacuggaaccagagcggcacgcuguucgagggcaucgagcgcugggccgagcggaaggcgcugcucacccacgacgacgucaagcagcgcgccuggcagacccugaaguggcagaucgccaacgggauccagcacgugcggacccacguggacgucuccgacgccacgcugaccgcgcucaaggccaugcuggaggugaagcaggagguggcccccuggaucgaccugcagaucgucgccuucccccaggagggcauccucagcuaccccaacggggaggcccugcuggaggaggcgcuccgccugggcgccgacguggugggggccaucccgcacuucgaguucacccgggaguacggcgucgagucccugcacaagaccuucgcccucgcccagaaguacgaccgccugaucgacgugcacugcgacgagaucgacgacgagcagagccgguucguggagacggucgcggcccuggcccaccgcgagggcaugggggcccgggugaccgccucccacaccaccgcgaugcacagcuacaacggcgccuacacgucccgccucuuccggcugcugaagaugagcgggaucaacuucguggccaacccccucgucaacauccaccuccagggccgcuucgacaccuaccccaagcggcgcggcaucacccgggugaaggagaugcuggaguccgggaucaacgugugcuucggccacgacgacgucuucgaccccugguacccgcuggggaccgccaacaugcuccaggugcugcacaugggccugcacgugugccagcugaugggguacggccagaucaacgacggccugaaccucaucacgcaccacagcgcccgcacccugaaccugcaggacuacgggaucgcggccggcaacuccgccaaccucaucauccugcccgccgagaacggguucgacgcgcugcggcgccagguccccgugcgguacagcguccgcggcgggaaggugaucgccuccacccagcccgcccagaccacgguguaccucgagcagccggaggccaucgacuacaagcgcuga

SEQ ID NO: 5332 - RNA, 1299 nt, Artificial Sequence
  derived and/or modified sequence opt2 from Cytosine_Deaminase_codA__Escherichia_coli__EGJ07181
auguggcgccucaccgucuccaacaacgcccuccagaccaucaucaacgcccgccuccccggcaaggagggccucuggcagauccaccuccaggacggcaagaucuccgccaucgacgcccaguccggcgucaugcccaucaccgagaacucccucgacgccgagcagggccucgucaucccccccuucgucgagccccacauccaccucgacaccacccagaccgccggccagcccaacuggaaccaguccggcacccucuucgagggcaucgagcgcugggccgagcgcaaggcccuccucacccacgacgacgucaagcagcgcgccuggcagacccucaaguggcagaucgccaacggcauccagcacguccgcacccacgucgacgucuccgacgccacccucaccgcccucaaggccaugcucgaggucaagcaggaggucgcccccuggaucgaccuccagaucgucgccuucccccaggagggcauccucuccuaccccaacggcgaggcccuccucgaggaggcccuccgccucggcgccgacgucgucggcgccaucccccacuucgaguucacccgcgaguacggcgucgagucccuccacaagaccuucgcccucgcccagaaguacgaccgccucaucgacguccacugcgacgagaucgacgacgagcagucccgcuucgucgagaccgucgccgcccucgcccaccgcgagggcaugggcgcccgcgucaccgccucccacaccaccgccaugcacuccuacaacggcgccuacaccucccgccucuuccgccuccucaagauguccggcaucaacuucgucgccaacccccucgucaacauccaccuccagggccgcuucgacaccuaccccaagcgccgcggcaucacccgcgucaaggagaugcucgaguccggcaucaacgucugcuucggccacgacgacgucuucgaccccugguacccccucggcaccgccaacaugcuccagguccuccacaugggccuccacgucugccagcucaugggcuacggccagaucaacgacggccucaaccucaucacccaccacuccgcccgcacccucaaccuccaggacuacggcaucgccgccggcaacuccgccaaccucaucauccuccccgccgagaacggcuucgacgcccuccgccgccagguccccguccgcuacuccguccgcggcggcaaggucaucgccuccacccagcccgcccagaccaccgucuaccucgagcagcccgaggccaucgacuacaagcgcuga

SEQ ID NO: 5333 - RNA, 1299 nt, Artificial Sequence
  derived and/or modified sequence opt3 from Cytosine_Deaminase_codA__Escherichia_coli__EGJ07181
auguggagacugaccgugagcaacaaugcccuccagacaaucauuaacgcuaggcuucccggcaaggaggggcuguggcaaauacacuugcaggacggaaaaaucuccgcaauugaugcccagucuggugucaugccuaucacugaaaauucauuagacgcggagcagggccugguuauuccaccguucguggaaccccauauccaccuagauacgacccaaacagcugggcagccuaacuggaaucagaguggaacucucuuugagggcauagaacggugggccgagcgcaaggcacugcuuacccaugacgauguaaaacagcgagccuggcaaacacugaaguggcagaucgcuaacgguauucagcacgugcguacccaugucgacgugagcgaugcaacuuugacagcccucaaagcuaugcuggagguuaagcaggaaguggccccauggaucgaccugcaaauugucgcguucccccaggaggggauccucuccuacccuaauggagaagcauuacuggaggaggcccuuagauugggcgcugaugugguaggcgccauaccacacuuugaguucaccagggaauaugggguugaaucucugcacaagacguuugcacuagcucagaaauacgaccggcucauugaugugcauugcgacgagaucgaugacgaacaaucgcgcuucgucgagacuguggccgcgcuggcccacagagagggaaugggugcaagggugaccgcuucacauacaacugccaugcacagcuauaacggcgcuuacaccagucggcuuuuucgccuguugaagauguccgggauuaauuucgucgccaacccccucguuaauauccaucugcagggacgauuugacacauauccuaaaagaaggggcaucacccgggugaaggaaauguuagagucugguauuaacguauguuucgggcacgaugacguguuugauccaugguacccgcugggaacggcaaauaugcuccagguccuucacaugggccugcaugugugccaguugaugggcuaugggcaaauaaacgacggacuaaaucugaucacucaccauagcgcccguacacucaaccugcaggauuacgguauugcugcgggcaacuccgcaaaucuuaucauacugcccgccgaaaacggguucgacgcuuugcgcagacagguuccugugagguacucaguccggggaggcaaagugauugccaguacccagccagcacaaacuacaguauaucucgagcagcccgaagccaucgauuacaagcgauga

SEQ ID NO: 5334 - RNA, 1299 nt, Artificial Sequence
  derived and/or modified sequence opt4 from Cytosine_Deaminase_codA__Escherichia_coli__EGJ07181
auguggagacugaccgugagcaacaacgcccugcagaccaucaucaacgccagacugcccggcaaggagggccuguggcagauccaccugcaggacggcaagaucagcgccaucgacgcccagagcggcgugaugcccaucaccgagaacagccuggacgccgagcagggccuggugaucccccccuucguggagccccacauccaccuggacaccacccagaccgccggccagcccaacuggaaccagagcggcacccuguucgagggcaucgagagaugggccgagagaaaggcccugcugacccacgacgacgugaagcagagagccuggcagacccugaaguggcagaucgccaacggcauccagcacgugagaacccacguggacgugagcgacgccacccugaccgcccugaaggccaugcuggaggugaagcaggagguggcccccuggaucgaccugcagaucguggccuucccccaggagggcauccugagcuaccccaacggcgaggcccugcuggaggaggcccugagacugggcgccgacguggugggcgccaucccccacuucgaguucaccagagaguacggcguggagagccugcacaagaccuucgcccuggcccagaaguacgacagacugaucgacgugcacugcgacgagaucgacgacgagcagagcagauucguggagaccguggccgcccuggcccacagagagggcaugggcgccagagugaccgccagccacaccaccgccaugcacagcuacaacggcgccuacaccagcagacuguucagacugcugaagaugagcggcaucaacuucguggccaacccccuggugaacauccaccugcagggcagauucgacaccuaccccaagagaagaggcaucaccagagugaaggagaugcuggagagcggcaucaacgugugcuucggccacgacgacguguucgaccccugguacccccugggcaccgccaacaugcugcaggugcugcacaugggccugcacgugugccagcugaugggcuacggccagaucaacgacggccugaaccugaucacccaccacagcgccagaacccugaaccugcaggacuacggcaucgccgccggcaacagcgccaaccugaucauccugcccgccgagaacggcuucgacgcccugagaagacaggugcccgugagauacagcgugagaggcggcaaggugaucgccagcacccagcccgcccagaccaccguguaccuggagcagcccgaggccaucgacuacaagagauga

SEQ ID NO: 5335 - RNA, 1299 nt, Artificial Sequence
  derived and/or modified sequence opt5 from Cytosine_Deaminase_codA__Escherichia_coli__EGJ07181
auguggagacugaccgugagcaacaaugcccuccagacaaucauuaacgcucggcugcccggcaaggaggggcuuuggcaaauccaucugcaggacggaaaaauuuccgccaucgaugcgcagucuggcgucaugccuauuacggaaaauagccucgacgcugagcaggggcugguuaucccgcccuucguggaaccucacauccaccuugauaccacacaaaccgccggacagcccaacuggaaucaguccggcacacuguuugaggggauugaacgcugggccgagagaaaggcucuccugacccaugacgaugugaaacagcgggccuggcaaacacugaaguggcagaucgcuaacggcauucagcacguccgcacccauguggacguuucugaugccacgcucaccgcgcugaaagccaugcuugaggugaagcaggaagucgcuccuuggaucgaccugcaaauuguggccuucccccaggagggaauccucagcuacccuaauggcgaagcucugcuugaggaggcccugagacucggggcggauguugugggagccauuccgcacuuugaguucacacgggaauauggcgucgaaucccugcacaagaccuuugcucuggcccagaaauacgaccgccucaucgaugugcauugcgacgagaucgaugacgaacaaucuagauucguggagacagucgcugcccuggcccaccgggaggggaugggagcucgcguuaccgcgagccauacgacagccaugcacuccuauaacggcgcuuacaccagcagacuuuuucggcugcucaagaugucugggauuaauuucguggccaacccccuggugaauauccaccuucagggacgcuuugacacauauccuaaaagacggggcauuacccgcgucaaggaaaugcuggaguccggcaucaacguguguuucgggcaugaugacguuuuugaucccugguacccucucggaaccgccaauaugcuccaggugcugcacaugggccugcaugucugccagcugaugggguauggacaaauuaacgacggccuuaaucugaucacacaccauagcgcuagaacgcucaaccugcaggauuacgggaucgccgcgggaaacucugcuaaucuuauuauccugcccgccgaaaacggcuucgacgcccuccggagacaggugccgguucgcuacuccgugcggggcgggaaagucauugcuagcacccagccugcccaaacaaccguguaucuggagcagcccgaagcuaucgauuacaagagauga

SEQ ID NO: 5336 - RNA, 1299 nt, Artificial Sequence
  derived and/or modified sequence opt6 from Cytosine_Deaminase_codA__Escherichia_coli__EGJ07181
auguggagauuaacuguaucaaauaacgcauuacaaacaauaauaaaugcaagacuaccaggaaaagaagguuuauggcaaauacaucuacaagacggaaaaauaucagccauagacgcacaaagcggcguaaugccaauaaccgaaaauaguuuagacgcagaacaaggacuaguaauaccaccuuuuguagaaccacacauacacuuagauacuacacaaacggcaggacaaccaaauuggaaucaaucaggaacacuuuuugaaggaauagaaagaugggcagaaagaaaagcucuguuaacucacgaugauguuaaacaaagagccuggcaaacucucaaauggcaaauagcaaacggaauacaacauguacgaacacauguugauguuagcgacgcaacacuaacagcuuuaaaagccauguuagaaguaaaacaagaaguagcaccauggauagauuugcaaauaguagcauuuccacaagaaggaauauuaucauauccuaauggagaagcacuacuagaagaagcauuaagauuaggagcagacguugucggugcaauaccacacuuugaauuuacacgagaauacggaguagaaucacuacauaaaacauuugcauuggcacaaaaauacgacagauuaauagauguacauugcgacgaaauugacgacgaacaaucaagauucguagaaacaguagcagccuuagcacaccgagaagggaugggagcaagaguaacagcaagccauacaacagcaaugcacucauacaauggagccuauacaucaagacuauucagacuauuaaaaaugaguggcaucaacuuuguagcaaauccauuagucaacauacacuuacaaggucgauuugauacauauccuaaaagaagaggcaucacaagaguaaaagaaauguuagagucuggaauaaauguaugcuuuggacaugacgacguauuugaucccugguauccauuaggaaccgcuaauauguuacaaguauugcauaugggcuuacacguaugucaauuaauggguuauggccaaauaaacgacggccuaaauuuaauuacucaccauagugcaagaacauuaaaccuacaagacuauggcauagcagcaggaaacucagcuaacuuaauaauacuaccagcagaaaacggcuuugaugcacuaagaagacaaguaccaguacgauauuccguaagaggaggaaaaguaauagcuagcacacaaccagcacaaacaacaguauaccuugaacaaccagaagcaauagacuauaaaagauaa

SEQ ID NO: 5337 - protein, 388 aa, Artificial Sequence
  Cytosine_Deaminase_codA__Escherichia_coli__H9UNZ4
MPITENSLDAEQGLVIPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAHHEGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVIASTQPAQTTVYLEQPEAIDYKR

SEQ ID NO: 5338 - RNA, 1167 nt, Artificial Sequence
  Cytosine_Deaminase_codA__Escherichia_coli__AFG39237
augcccauaacugaaaacagccuggaugccgaacaagguuuaguuauaccgccguuuguggagccacauauucaccuggacaccacgcaaaccgccggacaaccgaacuggaaucaguccggcacgcuguuugaaggcauugaacgcugggccgagcgcaaagcguuauuaacccaugacgaugugaaacaacgcgcauggcaaacgcugaaauggcagauugccaacggcauucagcaugugcguacccaugucgauguuucggaugcaacgcuaacugcgcugaaagcaaugcuggaagugaagcaggaagucgcgccguggauugaucugcaaaucgucgccuucccucaggaagggauuuugucguaucccaacggugaagcguugcuggaagaggcguuacgcuuaggggcagauguagugggggcgauuccgcauuuugaauuuacccgugaauacggcguggagucgcugcauaaaaccuucgcccuggcgcaaaaauacgaccgucucaucgacguucacugugaugagaucgaugacgagcagucgcgcuuugucgaaaccguugcugcccuggcgcaccaugaaggcaugggcgcgcgagucaccgccagccacaccacggcaaugcacuccuauaacggggcguauaccucacgccuguuccgcuugcugaaaauguccgguauuaacuuugucgccaacccgcuggucaauauucaucugcaaggacguuucgauacguauccaaaacgucgcggcaucacgcgcguuaaagagaugcuggaguccggcauuaacgucugcuuuggucacgaugaugucuucgauccgugguauccgcugggaacggcgaauaugcugcaagugcugcauauggggcugcauguuugccaguugaugggcuacgggcagauuaacgauggccugaauuuaaucacccaccacagcgcaaggacguugaauuugcaggauuacggcauugccgccggaaacagcgccaaccugauuauccugccggcugaaaauggguuugaugcgcugcgccgucagguuccgguacguuauucgguacguggcggcaaggugauugccagcacacaaccggcacaaaccaccguauaucuggagcagccagaagccaucgauuacaaacguuga

SEQ ID NO: 5339 - RNA, 1167 nt, Artificial Sequence
  derived and/or modified sequence opt1 from Cytosine_Deaminase_codA__Escherichia_coli__AFG39237
augcccaucaccgagaacagccuggacgccgagcagggccucgugaucccgcccuucgucgagccccacauccaccuggacaccacgcagaccgccgggcagcccaacuggaaccaguccggcacccuguucgaggggaucgagcgcugggcggagcggaaggcccuccugacccacgacgacgugaagcagcgcgccuggcagacgcugaaguggcagaucgccaacggcauccagcacgugcggacccacgucgacgugagcgacgccacccucaccgcgcugaaggccaugcuggaggugaagcaggaggucgccccguggaucgaccuccagaucguggccuucccccaggaggggauccuguccuaccccaacggcgaggcgcugcucgaggaggcccugcgccugggcgccgacguggucggggccaucccccacuucgaguucacgcgggaguacggcguggagagccuccacaagaccuucgcccuggcgcagaaguacgaccgccugaucgacgugcacugcgacgagaucgacgacgagcagucccgguucgucgagaccguggccgcccucgcccaccacgaggggaugggcgcccgcgugaccgcgagccacacgaccgccaugcacuccuacaacggggccuacaccagccggcuguuccgccugcucaagauguccggcaucaacuucgucgccaacccgcuggugaacauccaccuccagggccgguucgacaccuaccccaagcgccgggggaucacgcgcgugaaggagaugcuggagagcggcaucaacgucugcuucgggcacgacgacguguucgaccccugguacccccugggcaccgccaacaugcuccaggugcugcacaugggccugcacgucugccagcugaugggguacggccagaucaacgacgggcucaaccugaucacccaccacuccgcgcggacccugaaccuccaggacuacggcaucgccgccgggaacagcgccaaccugaucauccugccggccgagaacggcuucgacgcgcuccgccgccaggugcccgugcgguacuccguccggggcgggaaggugaucgccagcacgcagcccgcccagaccaccgucuaccuggagcagcccgaggccaucgacuacaagcgcuga

SEQ ID NO: 5340 - RNA, 1167 nt, Artificial Sequence
  derived and/or modified sequence opt2 from Cytosine_Deaminase_codA__Escherichia_coli__AFG39237
augcccaucaccgagaacucccucgacgccgagcagggccucgucaucccccccuucgucgagccccacauccaccucgacaccacccagaccgccggccagcccaacuggaaccaguccggcacccucuucgagggcaucgagcgcugggccgagcgcaaggcccuccucacccacgacgacgucaagcagcgcgccuggcagacccucaaguggcagaucgccaacggcauccagcacguccgcacccacgucgacgucuccgacgccacccucaccgcccucaaggccaugcucgaggucaagcaggaggucgcccccuggaucgaccuccagaucgucgccuucccccaggagggcauccucuccuaccccaacggcgaggcccuccucgaggaggcccuccgccucggcgccgacgucgucggcgccaucccccacuucgaguucacccgcgaguacggcgucgagucccuccacaagaccuucgcccucgcccagaaguacgaccgccucaucgacguccacugcgacgagaucgacgacgagcagucccgcuucgucgagaccgucgccgcccucgcccaccacgagggcaugggcgcccgcgucaccgccucccacaccaccgccaugcacuccuacaacggcgccuacaccucccgccucuuccgccuccucaagauguccggcaucaacuucgucgccaacccccucgucaacauccaccuccagggccgcuucgacaccuaccccaagcgccgcggcaucacccgcgucaaggagaugcucgaguccggcaucaacgucugcuucggccacgacgacgucuucgaccccugguacccccucggcaccgccaacaugcuccagguccuccacaugggccuccacgucugccagcucaugggcuacggccagaucaacgacggccucaaccucaucacccaccacuccgcccgcacccucaaccuccaggacuacggcaucgccgccggcaacuccgccaaccucaucauccuccccgccgagaacggcuucgacgcccuccgccgccagguccccguccgcuacuccguccgcggcggcaaggucaucgccuccacccagcccgcccagaccaccgucuaccucgagcagcccgaggccaucgacuacaagcgcuga

SEQ ID NO: 5341 - RNA, 1167 nt, Artificial Sequence
  derived and/or modified sequence opt3 from Cytosine_Deaminase_codA__Escherichia_coli__AFG39237
augcccaucaccgagaacagccuggacgccgaacagggccucgugauuccuccauucgucgagccgcacauacaucuugauacaacucaaacggcugggcagcccaauuggaaccaguccggaacccuguuugaagguaucgagagaugggcagaaaggaaggccuuguuaacacacgacgauguuaaacagcgggcguggcaaacucugaaguggcagauugcuaauggcauccagcaugugcgcacccacguagacgugucugaugccacacuaaccgcacucaaagccaugcuggaggucaagcaggagguggcuccuuggauugaccuucaaaucguugcauucccacaggaagggauacugucauaccccaacggagaggccuugcucgaagaggcucugcgacugggcgccgauguggucggugcgaucccucauuuugaguucacucgugaauaugggguggagagucuccacaaaacauuugcauuagcccagaaguacgacagacugauugauguacacugcgacgaaaucgaugacgagcagagcagguucguugaaaccguggcugcccuugcacaucacgagggaaugggcgcucgggucacggccucccauacuaccgcgaugcacucuuauaauggcgccuacacaucgcgcuuguuuagacugcuaaagaugucagggauuaacuucguggcaaauccacucgugaacauccaucugcaaggaagguuugauacuuaucccaaacggcgcgguauaacccgagucaaggagaugcuugaaagcggcauuaauguuuguuucgggcacgacgacguguuugauccuugguacccacugggaacagcuaacauguugcagguacuccacaugggccugcaugugugccaguuaauggguuaugggcaaaucaaugacggacugaaccucauuacccaccauagugccagaacgcuuaaucugcaggauuacggcaucgcugccggcaacuccgcaaauuugaucauucuaccggccgagaacggguucgacgcucugaggcggcagguccccgugcguuacucuguucgcggagguaaagugauagcgagcacucagccugcacaaacaaccgucuaucucgaacagccagaggccaucgauuacaagagauga

SEQ ID NO: 5342 - RNA, 1167 nt, Artificial Sequence
  derived and/or modified sequence opt4 from Cytosine_Deaminase_codA__Escherichia_coli__AFG39237
augcccaucaccgagaacagccuggacgccgagcagggccuggugaucccccccuucguggagccccacauccaccuggacaccacccagaccgccggccagcccaacuggaaccagagcggcacccuguucgagggcaucgagagaugggccgagagaaaggcccugcugacccacgacgacgugaagcagagagccuggcagacccugaaguggcagaucgccaacggcauccagcacgugagaacccacguggacgugagcgacgccacccugaccgcccugaaggccaugcuggaggugaagcaggagguggcccccuggaucgaccugcagaucguggccuucccccaggagggcauccugagcuaccccaacggcgaggcccugcuggaggaggcccugagacugggcgccgacguggugggcgccaucccccacuucgaguucaccagagaguacggcguggagagccugcacaagaccuucgcccuggcccagaaguacgacagacugaucgacgugcacugcgacgagaucgacgacgagcagagcagauucguggagaccguggccgcccuggcccaccacgagggcaugggcgccagagugaccgccagccacaccaccgccaugcacagcuacaacggcgccuacaccagcagacuguucagacugcugaagaugagcggcaucaacuucguggccaacccccuggugaacauccaccugcagggcagauucgacaccuaccccaagagaagaggcaucaccagagugaaggagaugcuggagagcggcaucaacgugugcuucggccacgacgacguguucgaccccugguacccccugggcaccgccaacaugcugcaggugcugcacaugggccugcacgugugccagcugaugggcuacggccagaucaacgacggccugaaccugaucacccaccacagcgccagaacccugaaccugcaggacuacggcaucgccgccggcaacagcgccaaccugaucauccugcccgccgagaacggcuucgacgcccugagaagacaggugcccgugagauacagcgugagaggcggcaaggugaucgccagcacccagcccgcccagaccaccguguaccuggagcagcccgaggccaucgacuacaagagauga

SEQ ID NO: 5343 - RNA, 1167 nt, Artificial Sequence
  derived and/or modified sequence opt5 from Cytosine_Deaminase_codA__Escherichia_coli__AFG39237
augcccaucaccgagaacagccuggacgccgaacagggccucgugauuccuccguucgucgagccccacauccaucuggauacaacgcaaaccgcugggcagccuaauuggaaccaguccggaacacuuuuugaaggcauugagagaugggccgaacggaaggcgcugcucacccacgacgauguuaaacagcgcgcuuggcaaacacugaaguggcagaucgccaaugggauucagcaugugagaacccacguggacgucucugaugccacacuuaccgcucugaaagccaugcucgaggugaagcaggagguugcucccuggaucgaccugcaaaucguggccuucccucaggaaggcauucugagcuaccccaacggagaggcgcuccuggaagaggcccuucggcugggggcugaugucgugggagccaucccucauuuugaguucacgcgcgaauauggcguugagucccuccacaaaaccuuugcucuggcccagaaguacgacagacuuauugaugugcacugcgacgaaaucgaugacgagcagucucgguucgucgaaacaguggcggcccuggcucaucacgagggcaugggggcccgcgugaccgcuagccauacaaccgccaugcacuccuauaauggagccuacacgucuagacucuuucggcugcugaagaugagcggcauuaacuucgucgcuaauccgcucguuaacauccaucugcaagggcgcuuugauacauaucccaaaagacggggaauuacccgcgugaaggagaugcuugaauccggcaucaauguguguuucgggcacgacgacgucuuugauccuugguacccccugggaacagcgaacaugcuccaggugcugcacaugggccuucauguuugccagcugaugggcuaugggcaaaucaaugacggacucaaccugauuacccaccauagcgccagaacccugaaucuccaggauuacggcaucgcugccgggaacucugccaaucugauuauccuuccugcugagaacggauucgacgcccugcggcgccaggugcccgucagauacuccgugcggggcgggaaaguuauugcgagcacacagccggcucaaacgaccguguaucucgaacagccugaggccaucgauuacaagagauga

SEQ ID NO: 5344 - RNA, 1167 nt, Artificial Sequence
  derived and/or modified sequence opt6 from Cytosine_Deaminase_codA__Escherichia_coli__AFG39237
augccaauaacagaaaauucauuggaugcagaacaaggauuaguaauuccaccauucguagaaccacacauacauuuagacacaacacaaacagcaggacaaccaaauuggaaucaaucaggaacuuuauucgaaggaaucgaacgcugggcagaaagaaaagcacuauuaacacacgacgauguuaaacaaagagccuggcaaacucuaaaauggcaaauagcaaacggaauacaacacguaagaacacacguagacguaucagacgcaacuuuaacagcacuaaaagcaauguuagaaguaaaacaagaaguagcaccguggauagaccuacaaauaguagcauuuccacaagaaggaaucuuaagcuauccaaacggagaagcauuacuagaagaagcacuaagacucggagcagauguaguaggagcaauaccacacuuugaauucacaagagaauauggaguagaaucuuuacauaaaacauuugcacuagcacaaaaauacgacagacucaucgauguccacugcgaugaaauagacgaugaacaaaguagauuugucgaaacaguugcagcacuagcacaucacgaaggaaugggagcaagaguaacagcaucacauacaacagcaaugcacucauacaauggcgcauacacaagucgacuauuuagauuauuaaaaaugucaggaauaaacuuuguagcuaacccacuaguaaauauccaccuccaaggaagauucgacacauacccaaaaagacgaggaaucacaagaguaaaagaaauguuagaaaguggaauaaacguaugcuuuggacaugacgauguauucgauccaugguauccucuuggaacagccaauauguuacaaguacuacacaugggacuacauguaugccaauuaaugggauacggacaaauaaacgacggucuuaacuuaauaacacaucacagugcaagaacauuaaacuuacaagacuauggcauagcagccggaaauucagcaaaucuaauaauucuaccagcagaaaacggcuuugaugcauuaagaagacaaguuccaguaagauacucaguaagaggagguaaaguaaucgcaucaacacaaccagcccaaacaacaguauauuuagaacaaccagaagcaauagacuacaaaagauaa

SEQ ID NO: 5345 - protein, 432 aa, Artificial Sequence; identical to SEQ ID NO: 5321
  Cytosine_Deaminase_codA__Escherichia_coli__Q1RFJ5

SEQ ID NO: 5346 - RNA, 1299 nt, Artificial Sequence
  Cytosine_Deaminase_codA__Escherichia_coli__ABE05869
auguggaggcuaacagugucgaauaaugcuuuacaaacaauuauuaacgcccaguuacccggcaaagaggggcuguggcagauucaucuucacgacggaaaaaucagcgccauugaugcgcaauccggggugaugcccguaacugaaaacagccuggaugccgaacaagguuuaguuuuaccgccguuuguggagccgcauauucaccuggacaccacgcaaaccgccggacaaccgaacuggaaucaguccggcacgcuguuugaaggcauugaacgcugggccgagcgcaaagcguuauuaacucaugacgaugugaaacaacgcgcauggcaaacgcugaaauggcagauugccaacggcauucagcaugugcguacccaugucgaugucuccgacgcaacgcugacugcguugaaagcgaugcuggaagugaaacaggaaguugcgccguggauugaucugcaaaucgucgccuucccgcaggaagggauuuugucguaucccaacggugaagcgcugcuggaagaggcgcuacgcuuaggggcagauguuguuggggcgauuccgcauuuugaauuuacccgugaauacggcguggagucgcugcauaaaaccuucgcccuggcgcaaaaauacgaccgucucaucgacguucacugugaugagaucgaugacgagcagucgcgcuuugucgaaaccguugcugcccuggcgcaccgugaaggcaugggcgcgcgagucaccgccagccauacuacggcaaugcacuccuauaacggggcguauacuucgcgccuguuccguuugcugaaaauguccgguauuaacuuugucgccaacccguuggucaauauucaucugcaaggacguuucgauacguauccaaaacgucgcggcaucacgcgcguuaaagagaugcuggaguccggcauuaacgucugcuuuggucacgaugaugucuucgauccgugguauccgcugggaacggcgaauaugcugcaagugcugcauauggggcugcauguuugccagcugaugggcuacgggcagauuaacgacggccugaauuuaaucacccaccacagcgccaggacguugaauuugcaggauuacggcauugccgccggaaacagcgccaaccugauuauccugccggcugaaaauggguuugaugcgcugcgccgucagguuccgguacguuauucgguacguggcggcaaggugauugccagcacacaaccggcacaaaccaccguauaucuggagcagccagaagccaucgauuacaaacgguaa

SEQ ID NO: 5347 - RNA, 1299 nt, Artificial Sequence; identical to SEQ ID NO: 5323
  derived and/or modified sequence opt1 from Cytosine_Deaminase_codA__Escherichia_coli__ABE05869

SEQ ID NO: 5348 - RNA, 1299 nt, Artificial Sequence; identical to SEQ ID NO: 5324
  derived and/or modified sequence opt2 from Cytosine_Deaminase_codA__Escherichia_coli__ABE05869

SEQ ID NO: 5349 - RNA, 1299 nt, Artificial Sequence; identical to SEQ ID NO: 5325
  derived and/or modified sequence opt3 from Cytosine_Deaminase_codA__Escherichia_coli__ABE05869

SEQ ID NO: 5350 - RNA, 1299 nt, Artificial Sequence; identical to SEQ ID NO: 5326
  derived and/or modified sequence opt4 from Cytosine_Deaminase_codA__Escherichia_coli__ABE05869

SEQ ID NO: 5351 - RNA, 1299 nt, Artificial Sequence; identical to SEQ ID NO: 5327
  derived and/or modified sequence opt5 from Cytosine_Deaminase_codA__Escherichia_coli__ABE05869

SEQ ID NO: 5352 - RNA, 1299 nt, Artificial Sequence
  derived and/or modified sequence opt6 from Cytosine_Deaminase_codA__Escherichia_coli__ABE05869
auguggagauuaacaguaagcaauaacgcacuacaaacaauaauaaaugcacaacucccaggaaaagaaggauuauggcaaauucacuuacaugacggaaaaauaucagcaauagaugcacaaucaggagucaugccaguaacagaaaauagccuugacgcagaacaagggcuaguccuacccccauucguagaaccacacauacauuuagauacuacacaaacagcaggucaaccaaauuggaaucaaucaggaacacuauuugaaggaauagaaagaugggcagaaagaaaagcauuacuaacacaugaugacguaaaacaaagagcauggcaaacacucaaauggcaaauagccaauggaauacaacauguaagaacucacgucgacgucagugacgcuacauuaacugcacuuaaagcaaugcuggaaguaaaacaagaaguagcaccauggaucgaucuacaaauaguagcauuuccacaagaaggaauauuaucuuacccuaauggagaagcuuuacuagaagaagcauuaagacuaggagcugacguaguaggagcaauaccacacuuugaauuuacaagagaauauggcguagaaucuuuacauaagacauucgcacuagcacaaaaauacgauaggcuaauagauguacauugcgacgaaauagaugaugaacaaagcagauucguagaaacaguagcagcacuugcacacagagaaggaaugggagcaagaguuacagcaucacacacaacagcaaugcauaguuacaauggagcauacacaagcagauuauuuagacuccuaaaaaugaguggaauaaacuuuguagcaaauccacuaguaaauauacauuuacaaggacgauuugauacuuauccaaaaagacgaggaauaacaagaguaaaagaaaugcuagaaucuggcauaaaugugugcuucggccaugaugaugucuuugauccaugguauccacuagguacagcaaauaugcuacaaguucuacacaugggauuacauguaugccaacuuaugggauauggacaaauaaacgacggccuuaaccuaauaacacaccacucagccagaacauuaaauuuacaagacuacggaauagcagcaggaaauucagcaaaucucauaauacugccagcagaaaacggauuugaugccuuaagaagacaaguaccuguuagauacagcguuagaggagguaagguaauagcaucaacacaaccagcacaaacaacaguauaccuagaacaaccagaagcuauagacuacaaaagauaa

SEQ ID NO: 5353 - protein, 72 aa, Artificial Sequence
  Cytosine_Deaminase_codA__Escherichia_coli__Q2VP09
MKQRITVTVDSDSYQLLKAYDVNISGLVSTTMQNEARRLRAERWKAENQEGMAEVARFIEMNGSFADENRDW

SEQ ID NO: 5354 - RNA, 219 nt, Artificial Sequence
  Cytosine_Deaminase_codA__Escherichia_coli__ACQ41973
augaagcagcguauuacagugacaguugacagcgacagcuaucaguugcucaaggcauaugaugucaauaucuccggucugguaagcacaaccaugcagaaugaagcccgucgucugcgugccgaacgcuggaaagcggaaaaucaggaagggauggcugaggucgcccgguuuauugaaaugaacggcucuuuugcugacgagaacagggacugguga

SEQ ID NO: 5355 - RNA, 219 nt, Artificial Sequence
  derived and/or modified sequence opt1 from Cytosine_Deaminase_codA__Escherichia_coli__ACQ41973
augaagcagcgcaucaccgugaccgucgacagcgacuccuaccagcugcucaaggccuacgacgugaacaucagcggccugguguccacgaccaugcagaacgaggcccggcgccugcgggcggagcgcuggaaggccgagaaccaggaggggauggccgaggucgcccgguucaucgagaugaacggcagcuucgccgacgagaaccgcgacugguga

SEQ ID NO: 5356 - RNA, 219 nt, Artificial Sequence
  derived and/or modified sequence opt2 from Cytosine_Deaminase_codA__Escherichia_coli__ACQ41973
augaagcagcgcaucaccgucaccgucgacuccgacuccuaccagcuccucaaggccuacgacgucaacaucuccggccucgucuccaccaccaugcagaacgaggcccgccgccuccgcgccgagcgcuggaaggccgagaaccaggagggcauggccgaggucgcccgcuucaucgagaugaacggcuccuucgccgacgagaaccgcgacugguga

SEQ ID NO: 5357 - RNA, 219 nt, Artificial Sequence
  derived and/or modified sequence opt3 from Cytosine_Deaminase_codA__Escherichia_coli__ACQ41973
augaagcagagaaucaccgugacagucgacagcgauuccuaccaacugcucaaagccuaugacguuaacauuucuggccuugugucaacuacgaugcagaaugaggcuaggcggcugcgcgcagaacgauggaaggccgagaaccaggaagggauggcggagguagcucguuucauagaaaugaauggaaguuuugccgaugagaacagagacugguga

SEQ ID NO: 5358 - RNA, 219 nt, Artificial Sequence
  derived and/or modified sequence opt4 from Cytosine_Deaminase_codA__Escherichia_coli__ACQ41973
augaagcagagaaucaccgugaccguggacagcgacagcuaccagcugcugaaggccuacgacgugaacaucagcggccuggugagcaccaccaugcagaacgaggccagaagacugagagccgagagauggaaggccgagaaccaggagggcauggccgagguggccagauucaucgagaugaacggcagcuucgccgacgagaacagagacugguga

SEQ ID NO: 5359 - RNA, 219 nt, Artificial Sequence
  derived and/or modified sequence opt5 from Cytosine_Deaminase_codA__Escherichia_coli__ACQ41973
augaagcagagaaucaccgugacagucgacagcgauuccuaccaacugcucaaagccuaugacguuaacauuucuggccuggugagcacgaccaugcagaaugaggcucggcgccuuagagccgaacgguggaaggcggagaaccaggaagggauggcugagguggcccgcuucaucgaaaugaauggauccuuugccgaugagaacagagacugguga

SEQ ID NO: 5360 - RNA, 219 nt, Artificial Sequence
  derived and/or modified sequence opt6 from Cytosine_Deaminase_codA__Escherichia_coli__ACQ41973
augaaacaaagaauaacaguaacaguagauagcgacagcuaucaauuacuaaaagcauaugacguaaacauaagcggacuaguaagcacaacaaugcaaaaugaagcaagaagacuaagagcagaaagauggaaagcagaaaaucaagaaggaauggcagaaguagcaagauuuauagaaaugaauggaucauucgcagacgaaaacagagacugguaa

SEQ ID NO: 5361 - protein, 427 aa, Artificial Sequence
  Cytosine_Deaminase_codA__Escherichia_coli__Q53ZC8
MSNNALQTIINARLPGEEGLWQIHLQDGKISAIDAQSGVMPITENSLDAEQGLVIPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAHHEGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVIASTQPAQTTVYLEQPEAIDYKR

SEQ ID NO: 5362 - RNA, 1284 nt, Artificial Sequence
  Cytosine_Deaminase_codA__Escherichia_coli__AAP92816
augucgaauaacgcuuuacaaacaauuauuaacgcccgguuaccaggcgaagaggggcuguggcagauucaucugcaggacggaaaaaucagcgccauugaugcgcaauccggcgugaugcccauaacugaaaacagccuggaugccgaacaagguuuaguuauaccgccguuuguggagccacauauucaccuggacaccacgcaaaccgccggacaaccgaacuggaaucaguccggcacgcuguuugaaggcauugaacgcugggccgagcgcaaagcguuauuaacccaugacgaugugaaacaacgcgcauggcaaacgcugaaauggcagauugccaacggcauucagcaugugcguacccaugucgauguuucggaugcaacgcuaacugcgcugaaagcaaugcuggaagugaagcaggaagucgcgccguggauugaucugcaaaucgucgccuucccucaggaagggauuuugucguaucccaacggugaagcguugcuggaagaggcguuacgcuuaggggcagauguagugggggcgauuccgcauuuugaauuuacccgugaauacggcguggagucgcugcauaaaaccuucgcccuggcgcaaaaauacgaccgucucaucgacguucacugugaugagaucgaugacgagcagucgcgcuuugucgaaaccguugcugcccuggcgcaccaugaaggcaugggcgcgcgagucaccgccagccacaccacggcaaugcacuccuauaacggggcguauaccucacgccuguuccgcuugcugaaaauguccgguauuaacuuugucgccaacccgcuggucaauauucaucugcaaggacguuucgauacguauccaaaacgucgcggcaucacgcgcguuaaagagaugcuggaguccggcauuaacgucugcuuuggucacgaugaugucuucgauccgugguauccgcugggaacggcgaauaugcugcaagugcugcauauggggcugcauguuugccaguugaugggcuacgggcagauuaacgauggccugaauuuaaucacccaccacagcgcaaggacguugaauuugcaggauuacggcauugccgccggaaacagcgccaaccugauuauccugccggcugaaaauggguuugaugcgcugcgccgucagguuccgguacguuauucgguacguggcggcaaggugauugccagcacacaaccggcacaaaccaccguauaucuggagcagccagaagccaucgauuacaaacguuga

SEQ ID NO: 5363 - RNA, 1284 nt, Artificial Sequence
  derived and/or modified sequence opt1 from Cytosine_Deaminase_codA__Escherichia_coli__AAP92816
augagcaacaacgcccugcagaccaucaucaacgcccgccuccccggcgaggaggggcuguggcagauccaccuccaggacggcaagaucuccgcgaucgacgcccagagcggggugaugccgaucaccgagaacucccuggacgccgagcagggccuggucaucccgcccuucguggagccccacauccaccuggacacgacccagaccgccgggcagcccaacuggaaccagagcggcacccucuucgagggcaucgagcggugggccgagcgcaaggcgcugcugacgcacgacgacgugaagcagcgggccuggcagacccucaaguggcagaucgccaacgggauccagcacguccgcacccacguggacguguccgacgccacccugacggcgcugaaggccaugcucgaggucaagcaggagguggcccccuggaucgaccugcagaucguggccuucccccaggagggcauccugagcuaccccaacggggaggcccuccuggaggaggcgcugcggcucggcgccgacgucgugggggccaucccgcacuucgaguucacccgcgaguacggcguggagucccugcacaagaccuucgcccuggcccagaaguacgaccggcucaucgacguccacugcgacgagaucgacgacgagcagagccgcuucguggagaccguggcggcccuggcccaccacgagggcaugggggcccgggucacggccucccacaccaccgcgaugcacagcuacaacggcgccuacaccucccgccuguuccggcuccugaagaugagcgggaucaacuucguggccaacccccuggugaacauccaccuccagggccgcuucgacacguaccccaagcggcgcggcaucacccgggucaaggagaugcuggaguccgggaucaacgugugcuucggccacgacgacguguucgaccccugguacccgcuggggaccgccaacaugcuccagguccugcacaugggccugcacgugugccagcucaugggguacggccagaucaacgacggccugaaccugaucacccaccacagcgcccgcacgcucaaccugcaggacuacgggaucgcggccggcaacuccgccaaccugaucauccuccccgccgagaacggguucgacgcgcugcggcgccaggugcccguccgguacagcgugcgcggcgggaaggucaucgccuccacccagcccgcccagaccaccguguaccuggagcagccggaggccaucgacuacaagcgguga

SEQ ID NO: 5364 - RNA, 1284 nt, Artificial Sequence
  derived and/or modified sequence opt2 from Cytosine_Deaminase_codA__Escherichia_coli__AAP92816
auguccaacaacgcccuccagaccaucaucaacgcccgccuccccggcgaggagggccucuggcagauccaccuccaggacggcaagaucuccgccaucgacgcccaguccggcgucaugcccaucaccgagaacucccucgacgccgagcagggccucgucaucccccccuucgucgagccccacauccaccucgacaccacccagaccgccggccagcccaacuggaaccaguccggcacccucuucgagggcaucgagcgcugggccgagcgcaaggcccuccucacccacgacgacgucaagcagcgcgccuggcagacccucaaguggcagaucgccaacggcauccagcacguccgcacccacgucgacgucuccgacgccacccucaccgcccucaaggccaugcucgaggucaagcaggaggucgcccccuggaucgaccuccagaucgucgccuucccccaggagggcauccucuccuaccccaacggcgaggcccuccucgaggaggcccuccgccucggcgccgacgucgucggcgccaucccccacuucgaguucacccgcgaguacggcgucgagucccuccacaagaccuucgcccucgcccagaaguacgaccgccucaucgacguccacugcgacgagaucgacgacgagcagucccgcuucgucgagaccgucgccgcccucgcccaccacgagggcaugggcgcccgcgucaccgccucccacaccaccgccaugcacuccuacaacggcgccuacaccucccgccucuuccgccuccucaagauguccggcaucaacuucgucgccaacccccucgucaacauccaccuccagggccgcuucgacaccuaccccaagcgccgcggcaucacccgcgucaaggagaugcucgaguccggcaucaacgucugcuucggccacgacgacgucuucgaccccugguacccccucggcaccgccaacaugcuccagguccuccacaugggccuccacgucugccagcucaugggcuacggccagaucaacgacggccucaaccucaucacccaccacuccgcccgcacccucaaccuccaggacuacggcaucgccgccggcaacuccgccaaccucaucauccuccccgccgagaacggcuucgacgcccuccgccgccagguccccguccgcuacuccguccgcggcggcaaggucaucgccuccacccagcccgcccagaccaccgucuaccucgagcagcccgaggccaucgacuacaagcgcuga

SEQ ID NO: 5365 - RNA, 1284 nt, Artificial Sequence
  derived and/or modified sequence opt3 from Cytosine_Deaminase_codA__Escherichia_coli__AAP92816
augagcaacaaugcccugcagaccaucauuaacgcuagacuccccggcgaggaagggcuuuggcaaauacaucugcaggacggaaagaucuccgcaauugaugcccagucuggugugaugccuaucacagagaauaguuuggacgcggaacagggcuuagucauuccaccguucguugagccccacauccaccuggauacuacgcaaaccgcugggcagccuaacuggaaucagaguggaacacuauuugaaggcauagagaggugggccgagcggaaagcacuccugacucaugacgaugugaagcagcgcgccuggcaaacccuuaaauggcagaucgcuaacgguauucagcacguacgaacacauguggacgucagcgaugcaacccugacugccuugaaggcuaugcucgaagugaaacaggagguugccccauggaucgaccugcaaauuguggcguucccccaggaagggauccuguccuacccuaauggagaggcacucuuagaggaagcccugcgucuuggcgcugaugucgugggcgccauaccacacuuugaguucacaagagaauaugggguagagucuuugcacaagaccuuugcacuggcucagaaguacgacaggcuaauugauguucauugcgacgaaaucgaugacgagcaaucgcgguucguggagacggucgccgcgcucgcccaccaugaaggaaugggugcacgcgugacugcuucacacaccacagccaugcacagcuauaacggcgcuuacacuucaagacuguuuaggcuucugaaaauguccgggauuaauuucguggccaaccccuuggucaauauccaucuccagggacgguuugacaccuauccuaagcgccgaggcaucacaagaguuaaagagaugcuggaaucugguauuaacguguguuucgggcacgaugacguauuugauccaugguacccguuaggaaccgcaaauaugcuccaggugcugcauaugggccuucacgucugccagcugaugggcuaugggcaaauaaacgacggauugaaucuaaucacgcaucacagcgccaggacucugaaccuccaggauuacgguauugcugcgggcaacuccgcaaaucugaucauacuucccgccgagaacggguucgacgcucugcggcgucaggugccuguucgcuacucagugagaggaggcaaggucauugccaguacacagccagcacaaaccacuguguauuuggaacagcccgaggccaucgauuacaaaagguga

SEQ ID NO: 5366 - RNA, 1284 nt, Artificial Sequence
  derived and/or modified sequence opt4 from Cytosine_Deaminase_codA__Escherichia_coli__AAP92816
augagcaacaacgcccugcagaccaucaucaacgccagacugcccggcgaggagggccuguggcagauccaccugcaggacggcaagaucagcgccaucgacgcccagagcggcgugaugcccaucaccgagaacagccuggacgccgagcagggccuggugaucccccccuucguggagccccacauccaccuggacaccacccagaccgccggccagcccaacuggaaccagagcggcacccuguucgagggcaucgagagaugggccgagagaaaggcccugcugacccacgacgacgugaagcagagagccuggcagacccugaaguggcagaucgccaacggcauccagcacgugagaacccacguggacgugagcgacgccacccugaccgcccugaaggccaugcuggaggugaagcaggagguggcccccuggaucgaccugcagaucguggccuucccccaggagggcauccugagcuaccccaacggcgaggcccugcuggaggaggcccugagacugggcgccgacguggugggcgccaucccccacuucgaguucaccagagaguacggcguggagagccugcacaagaccuucgcccuggcccagaaguacgacagacugaucgacgugcacugcgacgagaucgacgacgagcagagcagauucguggagaccguggccgcccuggcccaccacgagggcaugggcgccagagugaccgccagccacaccaccgccaugcacagcuacaacggcgccuacaccagcagacuguucagacugcugaagaugagcggcaucaacuucguggccaacccccuggugaacauccaccugcagggcagauucgacaccuaccccaagagaagaggcaucaccagagugaaggagaugcuggagagcggcaucaacgugugcuucggccacgacgacguguucgaccccugguacccccugggcaccgccaacaugcugcaggugcugcacaugggccugcacgugugccagcugaugggcuacggccagaucaacgacggccugaaccugaucacccaccacagcgccagaacccugaaccugcaggacuacggcaucgccgccggcaacagcgccaaccugaucauccugcccgccgagaacggcuucgacgcccugagaagacaggugcccgugagauacagcgugagaggcggcaaggugaucgccagcacccagcccgcccagaccaccguguaccuggagcagcccgaggccaucgacuacaagagauga

SEQ ID NO: 5367 - RNA, 1284 nt, Artificial Sequence
  derived and/or modified sequence opt5 from Cytosine_Deaminase_codA__Escherichia_coli__AAP92816
augagcaacaaugcccugcagaccaucauuaacgcuagacuccccggcgaggaagggcuguggcaaauccaccuucaggacggaaagauuuccgccaucgaugcgcagucuggcgugaugccuauuacagagaauagccuggacgcugaacaggggcucgucaucccgcccuucguugagccucauauccaccuggauacgacccaaacagccggacagcccaacuggaaucaguccggcacccuuuuugaagggauugagcggugggccgagcgcaaagcucugcucacacaugacgaugugaagcagagagccuggcaaacccugaaauggcagaucgcuaacggcauucagcacgugcggacacaugucgacgugucugaugccacccugacggcgcucaaggccaugcuggaaguuaaacaggagguggcuccuuggaucgaccuucaaauugucgccuucccccaggaaggaauccugagcuacccuaauggcgaggcucuccuggaggaagcccuucgccugggggcggaugugguuggagccauuccgcacuuugaguucaccagagaauauggcguggagucccuccacaagacauuugcucuggcccagaaguacgaccggcugaucgauguccauugcgacgaaaucgaugacgagcaaucucgcuucguggagaccguggcugcccucgcccaccaugaagggaugggagcuagagucacagcgagccacaccacggccaugcacuccuauaacggcgcuuacacaagccggcuguuucgccuucugaaaaugucugggauuaauuucguugccaacccccucgugaauauccaucugcagggaagauuugacaccuauccuaagcggcgcggcauuacaagagugaaagagaugcuugaauccggcaucaacgucuguuucgggcacgaugacguguuugaucccugguacccucugggaaccgccaauaugcuccagguucugcauaugggccugcacgugugccagcucaugggguauggacaaauuaacgacggccugaaucuuaucacccaucacagcgcucggacacugaaccuccaggauuacgggaucgccgcgggaaacucugcuaaucugauuauccuucccgccgagaacggcuucgacgcccugcgcagacaggucccggugcgguacuccguuagaggcgggaaggugauugcuagcacgcagccugcccaaaccacagucuaucucgaacagcccgaggcuaucgauuacaaacgcuga

SEQ ID NO: 5368 - RNA, 1284 nt, Artificial Sequence
  derived and/or modified sequence opt6 from Cytosine_Deaminase_codA__Escherichia_coli__AAP92816
augucaaauaacgcauuacaaacaauaauaaaugcaagacuacccggagaagaaggacuauggcaaauacacuuacaagacggaaaaaucagugcuaucgaugcacaaucaggaguaaugccaauaacugaaaauagccuagacgcagaacaaggccuaguaauaccaccauuuguugaaccgcauauacaccuagacacaacacaaacagcagggcaaccaaacuggaaccaaucaggaacacuauuugaaggaauagaaagaugggcugaaagaaaagcacuacuaacacacgacgacguaaaacaacgagccuggcaaacacuaaaauggcaaauagcaaacggaauacaacacguuagaacucauguagaugucucagaugcaacauuaacagcguuaaaagcaaugcuugaaguaaaacaagaaguugcaccauggauagacuuacagauaguagcauucccccaagaaggaauacuaucauacccuaacggagaagcauuacuugaagaagcucuaagacuaggcgcagauguaguaggagcaauaccacacuucgaauuuacaagagaauacggaguagaaucacuacacaaaacauucgcuuuagcacaaaaauaugaccgauuaauagacguucacugcgacgaaaucgacgaugagcaaucuagauucguagaaacaguagcugccuuagcucaucacgaaggaaugggggcaagaguaacagcaucucauacaacagcuaugcacuccuacaacggagcauacacaagucgacuauuuagauuauuaaaaaugucaggcauaaauuuuguagcaaauccacuaguaaauauacacuuacaagguagauuugauacauacccaaaacgacgaggaauaacaagaguaaaagaaaugcuagaaagcggcauaaauguaugcuucggacacgacgacguauucgauccaugguauccccuaggaacagcaaauaugcuacaaguuuuacauaugggacuacacguaugucaauuaaugggauacggacaaauaaaugacggccuaaaucugauaacacaccacucagcacgaacacuaaauuuacaagacuacggaauagcagcaggaaacagcgcaaaccuuaucauauuaccagcagaaaacggauuugacgcauuaagaagacaaguaccaguuagauauuccguaagaggaggaaaaguaauagcaucuacacaaccagcacaaacaacaguauaccuagaacaaccagaagcaauagauuacaaaagauaa

SEQ ID NO: 5369 - protein, 427 aa, Artificial Sequence
  Cytosine_Deaminase_codA__Escherichia_coli__Q6Q8Q1
MSNNALQTIINARLPGEEGLWQIHLQDGKISAIDAQSGVMPITENSLDAEQGLVIPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLRADVVGAIPHFEFTREYGVESLHKTFALAQKYDRLIDVHCDEIDDEQSRFVETVAALAHHEGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVIASTQPAQTTVYLEQPEAIDYKR

SEQ ID NO: 5370 - RNA, 1284 nt, Artificial Sequence
  Cytosine_Deaminase_codA__Escherichia_coli__AAS58473
augucgaauaacgcuuuacaaacaauuauuaacgcccgguuaccaggcgaagaggggcuguggcagauucaucugcaggacggaaaaaucagcgccauugaugcgcaauccggcgugaugcccauaacugaaaacagccuggaugccgaacaagguuuaguuauaccgccguuuguggagccacauauucaccuggacaccacgcaaaccgccggacaaccgaacuggaaucaguccggcacgcuguuugaaggcauugaacgcugggccgagcgcaaagcguuauuaacccaugacgaugugaaacaacgcgcauggcagacgcugaaauggcagauugccaacggcauucagcaugugcguacccaugucgauguuucggaugcaacgcuaacugcgcugaaagcaaugcuggaagugaagcaggaagucgcgccguggauugaucugcaaaucgucgccuucccucaggaagggauuuugucguaucccaacggugaagcguugcuggaagaggcguuacgcuuaagggcagauguagugggggcgauuccgcauuuugaauuuacccgugaauacggcguggagucgcugcauaaaaccuucgcccuggcgcaaaaauacgaccgucucaucgacguucacugugaugagaucgaugacgagcagucgcgcuuugucgaaaccguugcugcccuggcgcaccaugaaggcaugggcgcgcgagucaccgccagccacaccacggcaaugcacuccuauaacggggcguauaccucacgccuguuccgcuugcugaaaauguccgguauuaacuuugucgccaacccgcuggucaauauucaucugcaaggacguuucgauacguauccaaaacgucgcggcaucacgcgcguuaaagagaugcuggaguccggcauuaacgucugcuuuggucacgaugaugucuucgauccgugguauccgcugggaacggcgaauaugcugcaagugcugcauauggggcugcauguuugccaguugaugggcuacgggcagauuaacgauggccugaauuuaaucacccaccacagcgcaaggacguugaauuugcaggauuacggcauugccgccggaaacagcgccaaccugauuauccugccggcugaaaauggguuugaugcgcugcgccgucagguuccgguacguuauucgguacguggcggcaaggugauugccagcacacaaccggcacaaaccaccguauaucuggagcagccagaagccaucgauuacaaacguuga

SEQ ID NO: 5371 - RNA, 1284 nt, Artificial Sequence
  derived and/or modified sequence opt1 from Cytosine_Deaminase_codA__Escherichia_coli__AAS58473
augagcaacaacgcccugcagaccaucaucaacgcccgccuccccggcgaggaggggcuguggcagauccaccuccaggacggcaagaucuccgcgaucgacgcccagagcggggugaugccgaucaccgagaacucccuggacgccgagcagggccuggucaucccgcccuucguggagccccacauccaccuggacacgacccagaccgccgggcagcccaacuggaaccagagcggcacccucuucgagggcaucgagcggugggccgagcgcaaggcgcugcugacgcacgacgacgugaagcagcgggccuggcagacccucaaguggcagaucgccaacgggauccagcacguccgcacccacguggacguguccgacgccacccugacggcgcugaaggccaugcucgaggucaagcaggagguggcccccuggaucgaccugcagaucguggccuucccccaggagggcauccugagcuaccccaacggggaggcccuccuggaggaggcgcugcggcuccgcgccgacgucgugggcgccaucccgcacuucgaguucacccgggaguacgggguggagucccugcacaagaccuucgcccuggcccagaaguacgaccgccucaucgacguccacugcgacgagaucgacgacgagcagagccgguucguggagaccguggcggcccuggcccaccacgagggcaugggcgcccgcgucacggccucccacaccaccgcgaugcacagcuacaacggggccuacaccucccggcuguuccgccuccugaagaugagcggcaucaacuucguggccaacccccuggugaacauccaccuccaggggcgguucgacacguaccccaagcgccggggcaucacccgcgucaaggagaugcuggaguccggcaucaacgugugcuucgggcacgacgacguguucgaccccugguacccgcugggcaccgccaacaugcuccagguccugcacauggggcugcacgugugccagcucaugggcuacgggcagaucaacgacggccugaaccugaucacccaccacagcgcccggacgcucaaccugcaggacuacggcaucgcggccgggaacuccgccaaccugaucauccuccccgccgagaacggcuucgacgcgcugcgccgccaggugcccguccgguacagcgugcgcgggggcaaggucaucgccuccacccagcccgcccagaccaccguguaccuggagcagccggaggccaucgacuacaagcgguga

SEQ ID NO: 5372 - RNA, 1284 nt, Artificial Sequence
  derived and/or modified sequence opt2 from Cytosine_Deaminase_codA__Escherichia_coli__AAS58473
auguccaacaacgcccuccagaccaucaucaacgcccgccuccccggcgaggagggccucuggcagauccaccuccaggacggcaagaucuccgccaucgacgcccaguccggcgucaugcccaucaccgagaacucccucgacgccgagcagggccucgucaucccccccuucgucgagccccacauccaccucgacaccacccagaccgccggccagcccaacuggaaccaguccggcacccucuucgagggcaucgagcgcugggccgagcgcaaggcccuccucacccacgacgacgucaagcagcgcgccuggcagacccucaaguggcagaucgccaacggcauccagcacguccgcacccacgucgacgucuccgacgccacccucaccgcccucaaggccaugcucgaggucaagcaggaggucgcccccuggaucgaccuccagaucgucgccuucccccaggagggcauccucuccuaccccaacggcgaggcccuccucgaggaggcccuccgccuccgcgccgacgucgucggcgccaucccccacuucgaguucacccgcgaguacggcgucgagucccuccacaagaccuucgcccucgcccagaaguacgaccgccucaucgacguccacugcgacgagaucgacgacgagcagucccgcuucgucgagaccgucgccgcccucgcccaccacgagggcaugggcgcccgcgucaccgccucccacaccaccgccaugcacuccuacaacggcgccuacaccucccgccucuuccgccuccucaagauguccggcaucaacuucgucgccaacccccucgucaacauccaccuccagggccgcuucgacaccuaccccaagcgccgcggcaucacccgcgucaaggagaugcucgaguccggcaucaacgucugcuucggccacgacgacgucuucgaccccugguacccccucggcaccgccaacaugcuccagguccuccacaugggccuccacgucugccagcucaugggcuacggccagaucaacgacggccucaaccucaucacccaccacuccgcccgcacccucaaccuccaggacuacggcaucgccgccggcaacuccgccaaccucaucauccuccccgccgagaacggcuucgacgcccuccgccgccagguccccguccgcuacuccguccgcggcggcaaggucaucgccuccacccagcccgcccagaccaccgucuaccucgagcagcccgaggccaucgacuacaagcgcuga

SEQ ID NO: 5373 - RNA, 1284 nt, Artificial Sequence
  derived and/or modified sequence opt3 from Cytosine_Deaminase_codA__Escherichia_coli__AAS58473
augagcaacaaugcccugcagaccaucauuaacgcuagacuccccggcgaggaagggcuuuggcaaauacaucugcaggacggaaagaucuccgcaauugaugcccagucuggugugaugccuaucacagagaauaguuuggacgcggaacagggcuuagucauuccaccguucguugagccccacauccaccuggauacuacgcaaaccgcugggcagccuaacuggaaucagaguggaacacuauuugaaggcauagagaggugggccgagcggaaagcacuccugacucaugacgaugugaagcagcgcgccuggcaaacccuuaaauggcagaucgcuaacgguauucagcacguacgaacacauguggacgucagcgaugcaacccugacugccuugaaggcuaugcucgaagugaaacaggagguugccccauggaucgaccugcaaauuguggcguucccccaggaagggauccuguccuacccuaauggagaggcacucuuagaggaagcccugcgucuuagagcugaugucgugggcgccauaccacacuuugaguucacaagggaauauggcguagagucuuugcacaagaccuuugcacuggcucagaaguacgaccggcuaauugauguucauugcgacgaaaucgaugacgagcaaucgcgcuucguggagacggucgccgcgcucgcccaccaugaagggaugggagcaagagugacugcuucacacaccacagccaugcacagcuauaacggugcuuacacuucaaggcuguuucggcuucugaaaauguccggcauuaauuucguggccaaccccuuggucaauauccaucuccaggggcgcuuugacaccuauccuaagcgaagaggaaucacaaggguuaaagagaugcuggaaucuggcauuaacguguguuucggucacgaugacguauuugauccaugguacccguuagggaccgcaaauaugcuccaggugcugcauaugggacuucacgucugccagcugaugggcuauggccaaauaaacgacggguugaaucuaaucacgcaucacagcgcccggacucugaaccuccaggauuacggaauugcugcggguaacuccgcaaaucugaucauacuucccgccgagaacggcuucgacgcucugcgucgccaggugccuguuagauacucagugaggggagggaaggucauugccaguacacagccagcacaaaccacuguguauuuggaacagcccgaggccaucgauuacaaacgguga

SEQ ID NO: 5374 - RNA, 1284 nt, Artificial Sequence
  derived and/or modified sequence opt4 from Cytosine_Deaminase_codA__Escherichia_coli__AAS58473
augagcaacaacgcccugcagaccaucaucaacgccagacugcccggcgaggagggccuguggcagauccaccugcaggacggcaagaucagcgccaucgacgcccagagcggcgugaugcccaucaccgagaacagccuggacgccgagcagggccuggugaucccccccuucguggagccccacauccaccuggacaccacccagaccgccggccagcccaacuggaaccagagcggcacccuguucgagggcaucgagagaugggccgagagaaaggcccugcugacccacgacgacgugaagcagagagccuggcagacccugaaguggcagaucgccaacggcauccagcacgugagaacccacguggacgugagcgacgccacccugaccgcccugaaggccaugcuggaggugaagcaggagguggcccccuggaucgaccugcagaucguggccuucccccaggagggcauccugagcuaccccaacggcgaggcccugcuggaggaggcccugagacugagagccgacguggugggcgccaucccccacuucgaguucaccagagaguacggcguggagagccugcacaagaccuucgcccuggcccagaaguacgacagacugaucgacgugcacugcgacgagaucgacgacgagcagagcagauucguggagaccguggccgcccuggcccaccacgagggcaugggcgccagagugaccgccagccacaccaccgccaugcacagcuacaacggcgccuacaccagcagacuguucagacugcugaagaugagcggcaucaacuucguggccaacccccuggugaacauccaccugcagggcagauucgacaccuaccccaagagaagaggcaucaccagagugaaggagaugcuggagagcggcaucaacgugugcuucggccacgacgacguguucgaccccugguacccccugggcaccgccaacaugcugcaggugcugcacaugggccugcacgugugccagcugaugggcuacggccagaucaacgacggccugaaccugaucacccaccacagcgccagaacccugaaccugcaggacuacggcaucgccgccggcaacagcgccaaccugaucauccugcccgccgagaacggcuucgacgcccugagaagacaggugcccgugagauacagcgugagaggcggcaaggugaucgccagcacccagcccgcccagaccaccguguaccuggagcagcccgaggccaucgacuacaagagauga

SEQ ID NO: 5375 - RNA, 1284 nt, Artificial Sequence
  derived and/or modified sequence opt5 from Cytosine_Deaminase_codA__Escherichia_coli__AAS58473
augagcaacaaugcccugcagaccaucauuaacgcuagacuccccggcgaggaagggcuguggcaaauccaccuucaggacggaaagauuuccgccaucgaugcgcagucuggcgugaugccuauuacagagaauagccuggacgcugaacaggggcucgucaucccgcccuucguugagccucauauccaccuggauacgacccaaacagccggacagcccaacuggaaucaguccggcacccuuuuugaagggauugagcggugggccgagcgcaaagcucugcucacacaugacgaugugaagcagagagccuggcaaacccugaaauggcagaucgcuaacggcauucagcacgugcggacacaugucgacgugucugaugccacccugacggcgcucaaggccaugcuggaaguuaaacaggagguggcuccuuggaucgaccuucaaauugucgccuucccccaggaaggaauccugagcuacccuaauggcgaggcucuccuggaggaagcccuucgccugagagcggaugugguuggggccauuccgcacuuugaguucacccgggaauauggaguggagucccuccacaagacauuugcucuggcccagaaguacgaccgccugaucgauguccauugcgacgaaaucgaugacgagcaaucuagauucguggagaccguggcugcccucgcccaccaugaaggcaugggggcucgggucacagcgagccacaccacggccaugcacuccuauaacggagcuuacacaagccgccuguuuagacuucugaaaaugucuggcauuaauuucguugccaacccccucgugaauauccaucugcaggggcgguuugacaccuauccuaagcgcagaggaauuacacgggugaaagagaugcuugaauccggcaucaacgucuguuucggccacgaugacguguuugaucccugguacccucuggggaccgccaauaugcuccagguucugcauaugggacugcacgugugccagcucaugggcuaugggcaaauuaacgacggacugaaucuuaucacccaucacagcgcucgcacacugaaccuccaggauuacggcaucgccgcggggaacucugcuaaucugauuauccuucccgccgagaacggauucgacgcccugagacggcaggucccggugagauacuccguucgcggcggcaaggugauugcuagcacgcagccugcccaaaccacagucuaucucgaacagcccgaggcuaucgauuacaaacgguga

SEQ ID NO: 5376 - RNA, 1284 nt, Artificial Sequence
  derived and/or modified sequence opt6 from Cytosine_Deaminase_codA__Escherichia_coli__AAS58473
augaguaacaacgcauuacaaacaauaauaaaugcgagauuaccaggugaagaaggacuuuggcaaauacauuuacaagauggaaaaauaucugcaauagacgcacaaagcggaguaaugccaauaacagaaaauucacuagaugcagaacaaggauuaguaauaccaccuuucguagaaccacauauacauuuagacacuacacaaacagcaggucaaccaaacuggaaccaaucaggaacauuauuugaaggaauagagagaugggccgaaagaaaagccuuacuaacacacgacgacgucaaacaaagagcauggcaaacauuaaaauggcaaauagcaaacggaauacaacauguaagaacacauguagacguaagugacgcaacacuaacagcacuaaaagcaauguuagaaguaaagcaagaaguagcaccauggauagaucuacaaauaguagcauucccccaagaaggaauacuaucauauccaaacggagaagcacuacuugaagaagcccuaagacuaagagcagauguaguaggagcaauaccacacuuugaauucacaagagaauacggaguagaaucacuacauaaaacuuuugcccuagcacaaaaauacgauagacuaauagauguacauugugacgaaauagacgaugaacaaucacgauucguugaaaccgucgcugcacuagcacaucacgaagggaugggugcaagaguaacagcuucacacacaacugccaugcacucuuauaacggagcauacacaagcagauuauucagacuauuaaaaaugaguggaauaaacuuuguagcuaauccccuaguaaauauacauuuacaagguagauuugacacauacccgaaaagaagaggaauaacaagaguaaaagaaaugcuagaaagcggcauaaacguauguuucggacaugacgacguauucgaccccugguauccauuaggaacagccaacauguuacaaguccuacacaugggccuacaugucugccaacuuaugggauacggacaaauuaacgacggacuaaacuuaaucacacaucauuccgcaagaacacucaauuuacaagacuaugguauagcagcaggaaacucagcuaaccuaauaauacuaccugcagaaaacggcuucgacgcauuaagaagacaaguuccaguaagauacucaguacgaggagggaaaguaauagcaucaacgcaaccagcucaaacaacaguauauuuagaacaaccagaagcaauagacuauaaaagauaa

SEQ ID NO: 5377 - protein, 432 aa, Artificial Sequence
  Cytosine_Deaminase_codA__Escherichia_coli__W8ZNH5
MWRLTVSNNALQTIINARLPGKEGLWQIHFHDGKISAIDAQSGVMPVTENSLDAEQGLVLPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAHREGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVIASTKPAQTTVYLEQPEAIDYKR

SEQ ID NO: 5378 - RNA, 1299 nt, Artificial Sequence
  Cytosine_Deaminase_codA__Escherichia_coli__CDN80736
auguggaggcuaacagugucgaauaaugcuuuacaaacaauuauuaacgcccgguuacccggcaaagaggggcuguggcagauucauuuucacgacggaaaaaucagcgccauugaugcgcaauccggcgugaugcccguaacugaaaacagccuggaugccgaacaagguuuaguuuuaccgccguuuguggagccgcauauucaccuggacaccacgcaaaccgccggacaaccgaacuggaaucaguccggcacgcuguuugaaggcauugaacgcugggccgagcgcaaagcguuauuaacucaugacgaugugaaacaacgcgcauggcaaacgcugaaauggcagauugccaacggcauucagcaugugcguacccaugucgauguuucggacgcaacgcugacugcgcugaaagcaaugcuggaagugaaacaggaaguugcgccguggauugaucuacaaaucgucgccuucccgcaggaagggauuuugucguaucccaauggugaagcguugcuggaagaggcguuacgcuuaggggcagacguuguuggggcgauuccgcauuuugaauuuacccgugaauauggcguggagucgcugcauaaaaccuucgcccuggcgcaaaaauacgaccgucucaucgauguucacugugacgagauugaugaugagcaaucacgcuuugucgaaaccguugcugcccuggcgcaccgugaaggcaugggcgcgcgagucaccgccagccauacuacggcaaugcacuccuauaacggggcguauacuucgcgccuguuucguuugcugaaaauguccgguauuaacuuugucgccaacccguuggucaauauucaucugcaaggacguuucgauacguauccaaaacgucgcggcaucacgcgcguuaaagagaugcuggaguccggcauuaacgucugcuuuggucacgaugaugucuucgauccgugguauccgcugggaacggcgaauaugcugcaagugcugcauauggggcugcauguuugccagcugaugggcuaugggcagauuaacgacggccugaauuuaaucacccaccacagugccagaacguugaauuugcaggauuacggcauugccgccggaaacagcgccaaccugauuauccugccggcugaaaauggguuugacgcgcugcgccgucagguuccggugcgcuauucgguacguggcggcaaggugauugccagcacaaaaccggcacaaaccaccguauaucuggagcagccagaagccaucgauuacaaacgguaa

SEQ ID NO: 5379 - RNA, 1299 nt, Artificial Sequence
  derived and/or modified sequence opt1 from Cytosine_Deaminase_codA__Escherichia_coli__CDN80736
auguggcgccugaccgugagcaacaacgcccuccagaccaucaucaacgcccggcugcccggcaaggaggggcuguggcagauccacuuccacgacggcaagaucuccgcgaucgacgcccagagcggggucaugccggugacggagaacucccucgacgccgagcagggccuggugcugccgcccuucgucgagccccacauccaccucgacaccacccagaccgccgggcagcccaacuggaaccagagcggcacgcuguucgagggcaucgagcgcugggccgagcggaaggcgcugcucacccacgacgacgugaagcagcgcgccuggcagacccugaaguggcagaucgccaacgggauccagcacgugcggacccacgucgacguguccgacgccacgcugaccgcgcucaaggccaugcuggaggugaagcaggaggucgcccccuggaucgaccugcagaucguggccuucccccaggagggcauccucagcuaccccaacggggaggcccugcuggaggaggcgcuccgccugggcgccgacguggucggggccaucccgcacuucgaguucacccgggaguacggcguggagucccugcacaagaccuucgcccucgcccagaaguacgaccgccugaucgacgugcacugcgacgagaucgacgacgagcagagccgguucgucgagacgguggcggcccuggcccaccgcgagggcaugggggcccgggugaccgccucccacaccaccgcgaugcacagcuacaacggcgccuacacgucccgccucuuccggcugcugaagaugagcgggaucaacuucgucgccaacccccucgugaacauccaccuccagggccgcuucgacaccuaccccaagcggcgcggcaucacccgggugaaggagaugcuggaguccgggaucaacgucugcuucggccacgacgacguguucgaccccugguacccgcuggggaccgccaacaugcuccaggugcugcacaugggccugcacgucugccagcugaugggguacggccagaucaacgacggccugaaccucaucacgcaccacagcgcccgcacccugaaccugcaggacuacgggaucgcggccggcaacuccgccaaccucaucauccugcccgccgagaacggguucgacgcgcugcggcgccaggugcccguccgguacagcgugcgcggcgggaaggugaucgccuccaccaagcccgcccagaccacggucuaccucgagcagccggaggccaucgacuacaagcgcuga

SEQ ID NO: 5380 - RNA, 1299 nt, Artificial Sequence
  derived and/or modified sequence opt2 from Cytosine_Deaminase_codA__Escherichia_coli__CDN80736
auguggcgccucaccgucuccaacaacgcccuccagaccaucaucaacgcccgccuccccggcaaggagggccucuggcagauccacuuccacgacggcaagaucuccgccaucgacgcccaguccggcgucaugcccgucaccgagaacucccucgacgccgagcagggccucguccucccccccuucgucgagccccacauccaccucgacaccacccagaccgccggccagcccaacuggaaccaguccggcacccucuucgagggcaucgagcgcugggccgagcgcaaggcccuccucacccacgacgacgucaagcagcgcgccuggcagacccucaaguggcagaucgccaacggcauccagcacguccgcacccacgucgacgucuccgacgccacccucaccgcccucaaggccaugcucgaggucaagcaggaggucgcccccuggaucgaccuccagaucgucgccuucccccaggagggcauccucuccuaccccaacggcgaggcccuccucgaggaggcccuccgccucggcgccgacgucgucggcgccaucccccacuucgaguucacccgcgaguacggcgucgagucccuccacaagaccuucgcccucgcccagaaguacgaccgccucaucgacguccacugcgacgagaucgacgacgagcagucccgcuucgucgagaccgucgccgcccucgcccaccgcgagggcaugggcgcccgcgucaccgccucccacaccaccgccaugcacuccuacaacggcgccuacaccucccgccucuuccgccuccucaagauguccggcaucaacuucgucgccaacccccucgucaacauccaccuccagggccgcuucgacaccuaccccaagcgccgcggcaucacccgcgucaaggagaugcucgaguccggcaucaacgucugcuucggccacgacgacgucuucgaccccugguacccccucggcaccgccaacaugcuccagguccuccacaugggccuccacgucugccagcucaugggcuacggccagaucaacgacggccucaaccucaucacccaccacuccgcccgcacccucaaccuccaggacuacggcaucgccgccggcaacuccgccaaccucaucauccuccccgccgagaacggcuucgacgcccuccgccgccagguccccguccgcuacuccguccgcggcggcaaggucaucgccuccaccaagcccgcccagaccaccgucuaccucgagcagcccgaggccaucgacuacaagcgcuga

SEQ ID NO: 5381 - RNA, 1299 nt, Artificial Sequence
  derived and/or modified sequence opt3 from Cytosine_Deaminase_codA__Escherichia_coli__CDN80736
auguggagacugaccgugagcaacaaugcccuccagacaaucauuaacgcuaggcuucccggcaaggaggggcuguggcaaauacacuuccaugacggaaaaaucuccgcaauugaugcccagucuggugucaugccuguuacugaaaauucauuggacgcggagcagggcuuagugcugccaccguuuguagaaccccacauccaucuagauacgacccagacagcugggcaaccuaacuggaaucagaguggaacucucuucgagggcauugaacggugggccgagcgcaaggcacugcuuacccacgacgaugugaaacagcgagccuggcagacacugaaguggcaaaucgcuaacgguauacagcauguccguacccacguggacguuagcgaugcaacuuugacagcccucaaagcuaugcuggaggugaagcaggaagucgccccauggaucgaccugcagauuguggcguuuccccaagaggggauccucuccuacccuaauggagaagcauuacuggaggaggcccuuagauugggcgcugauguaguuggcgccauuccacacuucgaauuuaccagggaguaugggguggaaucucugcauaagacguucgcacuagcucagaaauacgaccggcucaucgauguccacugcgacgagauagaugacgaacagucgcgcuuuguggagacuguggccgcgcuggcccauagagagggaaugggugcaagggucaccgcuucacacacaacugccaugcacagcuauaacggcgcuuacaccagucggcuuuuccgccuguugaagauguccgggauuaauuuuguugccaacccccucgugaauauccaucugcaaggacgauucgacacauauccuaaaagaaggggcauuacccggguaaaggaaauguuagagucugguaucaacguguguuuugggcacgaugacgucuucgauccaugguacccgcugggaacggcaaauaugcuccaggugcuucauaugggccugcacguuugccaguugaugggcuaugggcagaucaacgacggacuaaaucugauuacucaucacagcgcccguacacucaaccugcaagauuacgguauagcugcgggcaacuccgcaaaucuuaucauucugcccgccgaaaacggguuugacgcuuugcgcagacaggugccugucagguacucagugcggggaggcaaaguaaucgccaguaccaagccagcacagacuacaguuuaucucgagcagcccgaagccauagauuacaagcgauga

SEQ ID NO: 5382 - RNA, 1299 nt, Artificial Sequence
  derived and/or modified sequence opt4 from Cytosine_Deaminase_codA__Escherichia_coli__CDN80736
auguggagacugaccgugagcaacaacgcccugcagaccaucaucaacgccagacugcccggcaaggagggccuguggcagauccacuuccacgacggcaagaucagcgccaucgacgcccagagcggcgugaugcccgugaccgagaacagccuggacgccgagcagggccuggugcugccccccuucguggagccccacauccaccuggacaccacccagaccgccggccagcccaacuggaaccagagcggcacccuguucgagggcaucgagagaugggccgagagaaaggcccugcugacccacgacgacgugaagcagagagccuggcagacccugaaguggcagaucgccaacggcauccagcacgugagaacccacguggacgugagcgacgccacccugaccgcccugaaggccaugcuggaggugaagcaggagguggcccccuggaucgaccugcagaucguggccuucccccaggagggcauccugagcuaccccaacggcgaggcccugcuggaggaggcccugagacugggcgccgacguggugggcgccaucccccacuucgaguucaccagagaguacggcguggagagccugcacaagaccuucgcccuggcccagaaguacgacagacugaucgacgugcacugcgacgagaucgacgacgagcagagcagauucguggagaccguggccgcccuggcccacagagagggcaugggcgccagagugaccgccagccacaccaccgccaugcacagcuacaacggcgccuacaccagcagacuguucagacugcugaagaugagcggcaucaacuucguggccaacccccuggugaacauccaccugcagggcagauucgacaccuaccccaagagaagaggcaucaccagagugaaggagaugcuggagagcggcaucaacgugugcuucggccacgacgacguguucgaccccugguacccccugggcaccgccaacaugcugcaggugcugcacaugggccugcacgugugccagcugaugggcuacggccagaucaacgacggccugaaccugaucacccaccacagcgccagaacccugaaccugcaggacuacggcaucgccgccggcaacagcgccaaccugaucauccugcccgccgagaacggcuucgacgcccugagaagacaggugcccgugagauacagcgugagaggcggcaaggugaucgccagcaccaagcccgcccagaccaccguguaccuggagcagcccgaggccaucgacuacaagagauga

SEQ ID NO: 5383 - RNA, 1299 nt, Artificial Sequence
  derived and/or modified sequence opt5 from Cytosine_Deaminase_codA__Escherichia_coli__CDN80736
auguggagacugaccgugagcaacaaugcccuccagacaaucauuaacgcucggcugcccggcaaggaggggcuuuggcaaauccacuuccaugacggaaaaauuuccgccaucgaugcgcagucuggcgucaugccuguuacggaaaauagccuggacgcugagcaggggcucgugcugccgcccuuuguggaaccucacauucaucuugauaccacacagaccgccggacaacccaacuggaaucaguccggcacacuguucgaggggaucgaacgcugggccgagagaaaggcucuccugacccacgacgaugucaaacagcgggccuggcagacacugaaguggcaaaucgcuaacggcauucagcaugugcgcacccacguugacgugucugaugccacgcucaccgcgcugaaagccaugcuugaggucaagcaggaaguggcuccuuggaucgaccugcagauuguugccuuuccccaagagggaauccucagcuacccuaauggcgaagcucugcuugaggaggcccugagacucggggcggauguggucggagccauuccgcacuucgaauuuacacgggaguauggcguggaaucccugcauaagaccuucgcucuggcccagaaauacgaccgccucaucgaugugcacugcgacgagauugaugacgaacagucuagauuugucgagacaguugcugcccuggcccaucgggaggggaugggagcucgcgugaccgcgagccacacgacagccaugcacuccuauaacggcgcuuacaccagcagacuuuuccggcugcucaagaugucugggaucaauuuuguggccaacccccuggucaauauccaucuucaaggacgcuucgacacauauccuaaaagacggggcauuacccgcgugaaggaaaugcuggaguccggcaucaacguuuguuuugggcacgaugacguguucgaucccugguacccucucggaaccgccaauaugcugcagguccugcauaugggccuccacgugugccagcugaugggguauggacagauuaacgacggccuuaaucugaucacacaucacagcgcuagaacgcucaaccugcaagauuacgggauugccgcgggaaacucugcuaaucuuaucauccugcccgccgaaaacggcuuugacgcccuccggagacagguuccggugcgcuacuccguccggggcgggaaagugauugcuagcaccaagccugcccagacaaccgucuaucuggagcagcccgaagcuaucgauuacaagagauga

SEQ ID NO: 5384 - RNA, 1299 nt, Artificial Sequence
  derived and/or modified sequence opt6 from Cytosine_Deaminase_codA__Escherichia_coli__CDN80736
auguggagguuaacaguaucuaacaacgcacuacaaacaauaauaaaugcucgacuuccaggcaaagaaggacuuuggcaaauacacuuucaugauggcaaaaucagcgcaauagacgcacaaucaggagugaugcccgucaccgaaaauucauuagacgcagaacaaggacuagucuuacccccauucguagaaccgcauauacacuuagauacuacacaaacagcaggacaaccaaauuggaaccaaucuggaacacuauucgaaggaauagaaagaugggcagaaagaaaagcacuacuaacacacgaugacguaaaacaaagagcauggcaaacacuaaaauggcaaauagcaaacggaauccaacacguacgaacacauguagaugucucagacgcaacacuaaccgcacuaaaagcaauguuagaagucaaacaagaaguagcaccauggaucgaucuacaaauaguagcauuuccacaagaaggaauacugagcuauccaaacggagaagcauuauuagaagaagcacuaagacuaggagcagacguaguaggugcaauaccacauuuugaauuuacaagagaauauggcguagaaucucuccacaaaacuuucgcacuagcacaaaaauaugauagauuaauagauguacauugcgaugaaauagacgaugaacagaguagauucguagaaacaguagcagcacuugcacauagggaagguaugggcgcaagaguaacagcaagucacacaacagcaaugcacucauacaauggagcauauaccaguagacucuuucgacuccucaaaaugucaggaauaaauuuuguagccaacccucuaguuaauauacacuuacaaggaagauucgacacauacccuaaaagaagaggaauaacaagaguaaaagaaauguuagaaucaggcauaaacguuuguuuuggacacgaugauguauuugauccuugguauccauuaggaacagccaauauguuacaaguacuccauauggguuuacauguaugccaauuaaugggauacggacaaaucaaugauggauuaaacuuaauaacacaccauucagcaagaacacuaaaucuacaagauuauggaauagcagccggaaauucagcaaaucuaauaauacuaccagcagaaaacggauuugacgcccugagaagacaaguaccaguaagauacucaguaagaggaggaaaaguaauagcaucaacaaaaccagcacaaacaaccguauacuuagaacaaccagaagcaauagacuauaaaagauaa

SEQ ID NO: 5385 - protein, 158 aa, Artificial Sequence
  Cytosine_Deaminase_fcy1__Saccharomyces_cerevisiae__A0A023ZJG6
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFIDERPQDWFEDIGE

SEQ ID NO: 5386 - RNA, 477 nt, Artificial Sequence
  Cytosine_Deaminase_fcy1__Saccharomyces_cerevisiae__AHY78226
auggugacagggggaauggcaagcaagugggaucagaaggguauggacauugccuaugaggaggcggccuuagguuacaaagagggugguguuccuauuggcggaugucuuaucaauaacaaagacggaaguguucucggucguggucacaacaugagauuucaaaagggauccgccacacuacauggugagaucuccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauuuaucgaugaaagaccucaggauugguuugaagauauuggugaguag

SEQ ID NO: 5387 - RNA, 477 nt, Artificial Sequence
  derived and/or modified sequence opt1 from Cytosine_Deaminase_fcy1__Saccharomyces_cerevisiae__AHY78226
auggugaccggcgggauggccagcaagugggaccagaagggcauggacaucgccuacgaggaggcggcccugggguacaaggagggcgggguccccaucggcggcugccucaucaacaacaaggacggguccgugcugggccgcgggcacaacaugcgguuccagaagggcagcgccacccugcacggggagaucuccacgcucgagaacugcggccgccuggagggcaagguguacaaggacaccacccuguacaccacgcucagcccgugcgacaugugcaccggggccaucaucauguacggcaucccccggugcgucgugggggagaacgugaacuucaaguccaagggcgagaaguaccugcagacccgcggccacgaggucgugguggucgacgacgagcggugcaagaagaucaugaagcaguucaucgacgagcgcccccaggacugguucgaggacaucggggaguga

SEQ ID NO: 5388 - RNA, 477 nt, Artificial Sequence
  derived and/or modified sequence opt2 from Cytosine_Deaminase_fcy1__Saccharomyces_cerevisiae__AHY78226
auggucaccggcggcauggccuccaagugggaccagaagggcauggacaucgccuacgaggaggccgcccucggcuacaaggagggcggcguccccaucggcggcugccucaucaacaacaaggacggcuccguccucggccgcggccacaacaugcgcuuccagaagggcuccgccacccuccacggcgagaucuccacccucgagaacugcggccgccucgagggcaaggucuacaaggacaccacccucuacaccacccucucccccugcgacaugugcaccggcgccaucaucauguacggcaucccccgcugcgucgucggcgagaacgucaacuucaaguccaagggcgagaaguaccuccagacccgcggccacgaggucgucgucgucgacgacgagcgcugcaagaagaucaugaagcaguucaucgacgagcgcccccaggacugguucgaggacaucggcgaguga

SEQ ID NO: 5389 - RNA, 477 nt, Artificial Sequence
  derived and/or modified sequence opt3 from Cytosine_Deaminase_fcy1__Saccharomyces_cerevisiae__AHY78226
auggugaccggcgggauggccagcaagugggaccagaaaggaauggauaucgcuuacgaggaagcagcccuggguuauaaggagggcgggguccccauuggaggcugccucauaaacaauaaagacgguuccguucuugggagaggacacaacaugagguuccaaaagggcucugcgacacugcauggcgaaaucucaacuuuggagaauugugggcgguuagaaggaaaaguguacaaggauacgacccuguauacaacucuaaguccuugcgacauguguaccggugcuauuaucauguacggcauuccacgcugcguagugggggagaacgucaauuuuaagagcaaaggagagaaguaucuccagacacgaggccacgaagugguuguggucgaugacgagcguuguaaaaagaucaugaaacaguucauagaugaaagaccgcaggacugguuugaggauaucggugaguga

SEQ ID NO: 5390 - RNA, 477 nt, Artificial Sequence
  derived and/or modified sequence opt4 from Cytosine_Deaminase_fcy1__Saccharomyces_cerevisiae__AHY78226
auggugaccggcggcauggccagcaagugggaccagaagggcauggacaucgccuacgaggaggccgcccugggcuacaaggagggcggcgugcccaucggcggcugccugaucaacaacaaggacggcagcgugcugggcagaggccacaacaugagauuccagaagggcagcgccacccugcacggcgagaucagcacccuggagaacugcggcagacuggagggcaagguguacaaggacaccacccuguacaccacccugagccccugcgacaugugcaccggcgccaucaucauguacggcauccccagaugcguggugggcgagaacgugaacuucaagagcaagggcgagaaguaccugcagaccagaggccacgaggugguggugguggacgacgagagaugcaagaagaucaugaagcaguucaucgacgagagaccccaggacugguucgaggacaucggcgaguga

SEQ ID NO: 5391 - RNA, 477 nt, Artificial Sequence
  derived and/or modified sequence opt5 from Cytosine_Deaminase_fcy1__Saccharomyces_cerevisiae__AHY78226
auggugaccggcgggauggccagcaagugggaccagaaaggaauggauaucgcuuacgaggaagccgcgcugggcuauaaggaagggggaguccccauuggcgggugccucaucaacaauaaagacggauccguucugggcagaggccacaacaugcgguuccaaaaggggucugcuacacuucauggagagauuagcacgcuggagaauuguggccgccucgaagggaaaguguacaaggauaccacacuguauaccacacuuuccccuugcgacauguguaccggagccaucauuauguacggcaucccgagaugcguggucggggagaacgugaauuuuaagucuaaaggagagaaguaucugcagacacggggccacgaaguuguggucguggaugacgagcgcuguaaaaagaucaugaaacaguucauugaugaaagaccccaggacugguuugaggauaucggcgaguga

SEQ ID NO: 5392 - RNA, 477 nt, Artificial Sequence
  derived and/or modified sequence opt6 from Cytosine_Deaminase_fcy1__Saccharomyces_cerevisiae__AHY78226
augguaacaggaggaauggcaagcaaaugggaucaaaaaggaauggacauagcauaugaagaagcagcguuaggauauaaagaaggaggaguaccaauaggaggauguuuaauaaauaauaaagauggaagcguauuaggaagaggacauaauaugagauuucaaaaaggaagugcaacauuacauggagaaauaaguacauuagaaaauuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaaggggacaugaaguaguaguaguagaugacgaaagauguaaaaaaauaaugaaacaauuuauagaugaaagaccacaagauugguuugaagauauaggagaauag

SEQ ID NO: 5393 - protein, 158 aa, Artificial Sequence; identical to SEQ ID NO: 5385
  Cytosine_Deaminase_fcy1__Saccharomyces_cerevisiae__A0A024XGF7

SEQ ID NO: 5394 - RNA, 477 nt, Artificial Sequence; identical to SEQ ID NO: 5386
  Cytosine_Deaminase_fcy1__Saccharomyces_cerevisiae__EWG88187

SEQ ID NO: 5395 - RNA, 477 nt, Artificial Sequence; identical to SEQ ID NO: 5387
  derived and/or modified sequence opt1 from Cytosine_Deaminase_fcy1__Saccharomyces_cerevisiae__EWG88187

SEQ ID NO: 5396 - RNA, 477 nt, Artificial Sequence; identical to SEQ ID NO: 5388
  derived and/or modified sequence opt2 from Cytosine_Deaminase_fcy1__Saccharomyces_cerevisiae__EWG88187

SEQ ID NO: 5397 - RNA, 477 nt, Artificial Sequence; identical to SEQ ID NO: 5389
  derived and/or modified sequence opt3 from Cytosine_Deaminase_fcy1__Saccharomyces_cerevisiae__EWG88187

SEQ ID NO: 5398 - RNA, 477 nt, Artificial Sequence; identical to SEQ ID NO: 5390
  derived and/or modified sequence opt4 from Cytosine_Deaminase_fcy1__Saccharomyces_cerevisiae__EWG88187

SEQ ID NO: 5399 - RNA, 477 nt, Artificial Sequence; identical to SEQ ID NO: 5391
  derived and/or modified sequence opt5 from Cytosine_Deaminase_fcy1__Saccharomyces_cerevisiae__EWG88187

SEQ ID NO: 5400 - RNA, 477 nt, Artificial Sequence
  derived and/or modified sequence opt6 from Cytosine_Deaminase_fcy1__Saccharomyces_cerevisiae__EWG88187
augguaacaggaggaauggcaaguaaaugggaucaaaaaggaauggacauagcauaugaagaagcagcacuaggauauaaagaaggaggaguaccaauaggaggaugcuuaauaaauaauaaagaugggaguguauuaggaagaggacauaauaugagauuucaaaaaggaagugcaacauuacacggagaaauaaguacauuagaaaacuguggaaggcuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauaucuacaaacaagaggacaugaaguaguaguaguagaugacgaaagauguaaaaaaauaaugaaacaauuuauagaugaaagaccacaagauugguuugaagauauaggagaauaa

SEQ ID NO: 5401 - protein, 158 aa, Artificial Sequence; identical to SEQ ID NO: 5385
  Cytosine_Deaminase_fcy1__Saccharomyces_cerevisiae__A0A024XUW9

SEQ ID NO: 5402 - RNA, 477 nt, Artificial Sequence; identical to SEQ ID NO: 5386
  Cytosine_Deaminase_fcy1__Saccharomyces_cerevisiae__EWG92959

SEQ ID NO: 5403 - RNA, 477 nt, Artificial Sequence; identical to SEQ ID NO: 5387
  derived and/or modified sequence opt1 from Cytosine_Deaminase_fcy1__Saccharomyces_cerevisiae__EWG92959

SEQ ID NO: 5404 - RNA, 477 nt, Artificial Sequence; identical to SEQ ID NO: 5388
  derived and/or modified sequence opt2 from Cytosine_Deaminase_fcy1__Saccharomyces_cerevisiae__EWG92959

SEQ ID NO: 5405 - RNA, 477 nt, Artificial Sequence; identical to SEQ ID NO: 5389
  derived and/or modified sequence opt3 from Cytosine_Deaminase_fcy1__Saccharomyces_cerevisiae__EWG92959

SEQ ID NO: 5406 - RNA, 477 nt, Artificial Sequence; identical to SEQ ID NO: 5390
  derived and/or modified sequence opt4 from Cytosine_Deaminase_fcy1__Saccharomyces_cerevisiae__EWG92959

SEQ ID NO: 5407 - RNA, 477 nt, Artificial Sequence; identical to SEQ ID NO: 5391
  derived and/or modified sequence opt5 from Cytosine_Deaminase_fcy1__Saccharomyces_cerevisiae__EWG92959

SEQ ID NO: 5408 - RNA, 477 nt, Artificial Sequence
  derived and/or modified sequence opt6 from Cytosine_Deaminase_fcy1__Saccharomyces_cerevisiae__EWG92959
augguaacaggaggaauggcaaguaaaugggaucaaaaaggaauggacauagcauaugaagaagcagcauuaggauauaaagaaggaggaguaccaauaggaggaugccuaauaaauaauaaagacggaaguguauuaggaagaggacauaauaugagauuucaaaaaggaagugcaacauuacacggagaaauaaguacauuagaaaacuguggaagauuagaaggaaaaguauauaaagauacaacauuauauacaacauuaaguccaugugacaugugcacaggagcaauaauaauguauggaauaccaagaugugugguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5409 - protein, 158 aa, Artificial Sequence; identical to SEQ ID NO: 5385
  Cytosine_Deaminase_fcy1__Saccharomyces_cerevisiae__A0A0C5ITD0

SEQ ID NO: 5410 - RNA, 477 nt, Artificial Sequence; identical to SEQ ID NO: 5386
  Cytosine_Deaminase_fcy1__Saccharomyces_cerevisiae__AJP42194

SEQ ID NO: 5411 - RNA, 477 nt, Artificial Sequence; identical to SEQ ID NO: 5387
  derived and/or modified sequence opt1 from Cytosine_Deaminase_fcy1__Saccharomyces_cerevisiae__AJP42194

SEQ ID NO: 5412 - RNA, 477 nt, Artificial Sequence; identical to SEQ ID NO: 5388
  derived and/or modified sequence opt2 from Cytosine_Deaminase_fcy1__Saccharomyces_cerevisiae__AJP42194

SEQ ID NO: 5413 - RNA, 477 nt, Artificial Sequence; identical to SEQ ID NO: 5389
  derived and/or modified sequence opt3 from Cytosine_Deaminase_fcy1__Saccharomyces_cerevisiae__AJP42194

SEQ ID NO: 5414 - RNA, 477 nt, Artificial Sequence; identical to SEQ ID NO: 5390
  derived and/or modified sequence opt4 from Cytosine_Deaminase_fcy1__Saccharomyces_cerevisiae__AJP42194

SEQ ID NO: 5415 - RNA, 477 nt, Artificial Sequence; identical to SEQ ID NO: 5391
  derived and/or modified sequence opt5 from Cytosine_Deaminase_fcy1__Saccharomyces_cerevisiae__AJP42194

SEQ ID NO: 5416 - RNA, 477 nt, Artificial Sequence
  derived and/or modified sequence opt6 from Cytosine_Deaminase_fcy1__Saccharomyces_cerevisiae__AJP42194
augguaacaggaggaauggcaaguaaaugggaucaaaaaggaauggacauagcauaugaagaagcagcauuaggauauaaagaaggaggaguaccaauaggaggguguuuaauaaauaauaaagacggaaguguauuaggaagagggcauaauaugagauuucaaaaaggaagugcaacauuacacggagaaauaaguacacuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagaugcaaaaaaauaaugaaacaauuuauagaugaaagaccacaagauugguuugaagauauaggagaauaa

SEQ ID NO: 5417 - protein, 158 aa, Artificial Sequence; identical to SEQ ID NO: 5385
  Cytosine_Deaminase_fcy1__Saccharomyces_cerevisiae__A0A0D4WVI5

SEQ ID NO: 5418 - RNA, 477 nt, Artificial Sequence
  Cytosine_Deaminase_fcy1__Saccharomyces_cerevisiae__AJV91284
auggugacagggggaauggcaagcaagugggaucagaaggguauggacauugccuaugaggaggcggccuuagguuacaaagagggugguguuccaauuggcggaugucuuaucaauaacaaagacggaaguguucucggucguggucacaacaugagauuucaaaagggauccgccacacuacauggugagaucuccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauucaucgaugaaagaccucaggauugguuugaagauauuggugaguag

SEQ ID NO: 5419 - RNA, 477 nt, Artificial Sequence; identical to SEQ ID NO: 5387
  derived and/or modified sequence opt1 from Cytosine_Deaminase_fcy1__Saccharomyces_cerevisiae__AJV91284

SEQ ID NO: 5420 - RNA, 477 nt, Artificial Sequence; identical to SEQ ID NO: 5388
  derived and/or modified sequence opt2 from Cytosine_Deaminase_fcy1__Saccharomyces_cerevisiae__AJV91284

SEQ ID NO: 5421 - RNA, 477 nt, Artificial Sequence; identical to SEQ ID NO: 5389
  derived and/or modified sequence opt3 from Cytosine_Deaminase_fcy1__Saccharomyces_cerevisiae__AJV91284

SEQ ID NO: 5422 - RNA, 477 nt, Artificial Sequence; identical to SEQ ID NO: 5390
  derived and/or modified sequence opt4 from Cytosine_Deaminase_fcy1__Saccharomyces_cerevisiae__AJV91284

SEQ ID NO: 5423 - RNA, 477 nt, Artificial Sequence; identical to SEQ ID NO: 5391
  derived and/or modified sequence opt5 from Cytosine_Deaminase_fcy1__Saccharomyces_cerevisiae__AJV91284

SEQ ID NO: 5424 - RNA, 477 nt, Artificial Sequence
  derived and/or modified sequence opt6 from Cytosine_Deaminase_fcy1__Saccharomyces_cerevisiae__AJV91284
augguaacaggaggaauggcgaguaaaugggaccaaaaaggaauggauauagcauaugaagaagcagcauuaggauauaaagaaggaggaguaccaauaggagggugucuaauaaauaauaaagacggaaguguauuaggaagaggacauaauaugagauuucaaaaaggaagugcaacauuacauggagaaauaaguacauuagaaaauuguggaagacuagaaggaaaaguauauaaagauacaacauuauauacaacauuaaguccaugugauauguguacaggggcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5425 - protein, 158 aa, Artificial Sequence; identical to SEQ ID NO: 5385
  Cytosine_Deaminase_fcy1__Saccharomyces_cerevisiae__A0A0D4WY08

SEQ ID NO: 5426 - RNA, 477 nt, Artificial Sequence; identical to SEQ ID NO: 5386
  Cytosine_Deaminase_fcy1__Saccharomyces_cerevisiae__AJV91722

SEQ ID NO: 5427 - RNA, 477 nt, Artificial Sequence; identical to SEQ ID NO: 5387
  derived and/or modified sequence opt1 from Cytosine_Deaminase_fcy1__Saccharomyces_cerevisiae__AJV91722

SEQ ID NO: 5428 - RNA, 477 nt, Artificial Sequence; identical to SEQ ID NO: 5388
  derived and/or modified sequence opt2 from Cytosine_Deaminase_fcy1__Saccharomyces_cerevisiae__AJV91722

SEQ ID NO: 5429 - RNA, 477 nt, Artificial Sequence; identical to SEQ ID NO: 5389
  derived and/or modified sequence opt3 from Cytosine_Deaminase_fcy1__Saccharomyces_cerevisiae__AJV91722

SEQ ID NO: 5430 - RNA, 477 nt, Artificial Sequence; identical to SEQ ID NO: 5390
  derived and/or modified sequence opt4 from Cytosine_Deaminase_fcy1__Saccharomyces_cerevisiae__AJV91722

SEQ ID NO: 5431 - RNA, 477 nt, Artificial Sequence; identical to SEQ ID NO: 5391
  derived and/or modified sequence opt5 from Cytosine_Deaminase_fcy1__Saccharomyces_cerevisiae__AJV91722

SEQ ID NO: 5432 - RNA, 477 nt, Artificial Sequence
  derived and/or modified sequence opt6 from Cytosine_Deaminase_fcy1__Saccharomyces_cerevisiae__AJV91722
augguaacaggaggaauggcaaguaaaugggaucaaaaaggaauggacauagcauaugaagaagcagcauuaggauauaaagaaggaggaguaccaauaggaggaugcuuaauaaauaauaaagauggaaguguauuaggaagaggacauaauaugagauuucaaaaaggaagugcaacauuacauggagaaauaagcacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugaugaaagaugcaaaaaaauaaugaaacaauuuauagaugaaagaccacaagauugguuugaagauauaggagaauaa

SEQ ID NO: 5433 - protein, 158 aa, Artificial Sequence; identical to SEQ ID NO: 5385
  Cytosine_Deaminase_fcy1__Saccharomyces_cerevisiae__A0A0D4WZA2

SEQ ID NO: 5434 - RNA, 477 nt, Artificial Sequence; identical to SEQ ID NO: 5386
  Cytosine_Deaminase_fcy1__Saccharomyces_cerevisiae__AJV92162

SEQ ID NO: 5435 - RNA, 477 nt, Artificial Sequence; identical to SEQ ID NO: 5387
  derived and/or modified sequence opt1 from Cytosine_Deaminase_fcy1__Saccharomyces_cerevisiae__AJV92162

SEQ ID NO: 5436 - RNA, 477 nt, Artificial Sequence; identical to SEQ ID NO: 5388
  derived and/or modified sequence opt2 from Cytosine_Deaminase_fcy1__Saccharomyces_cerevisiae__AJV92162

SEQ ID NO: 5437 - RNA, 477 nt, Artificial Sequence; identical to SEQ ID NO: 5389
  derived and/or modified sequence opt3 from Cytosine_Deaminase_fcy1__Saccharomyces_cerevisiae__AJV92162

SEQ ID NO: 5438 - RNA, 477 nt, Artificial Sequence; identical to SEQ ID NO: 5390
  derived and/or modified sequence opt4 from Cytosine_Deaminase_fcy1__Saccharomyces_cerevisiae__AJV92162

SEQ ID NO: 5439 - RNA, 477 nt, Artificial Sequence; identical to SEQ ID NO: 5391
  derived and/or modified sequence opt5 from Cytosine_Deaminase_fcy1__Saccharomyces_cerevisiae__AJV92162

SEQ ID NO: 5440 - RNA, 477 nt, Artificial Sequence
  derived and/or modified sequence opt6 from Cytosine_Deaminase_fcy1__Saccharomyces_cerevisiae__AJV92162
augguaacaggaggaauggcaaguaaaugggaucaaaaaggaauggacauagcauaugaagaagcagcauuaggauauaaagaaggaggaguaccaauaggaggaugcuuaauaaauaauaaagacggaucaguauuaggaagaggacauaauaugagauuucaaaaaggaagugcaacauuacacggagaaauaaguacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5441 - protein, 158 aa, Artificial Sequence; identical to SEQ ID NO: 5385
  Cytosine_Deaminase_fcy1__Saccharomyces_cerevisiae__A0A0D4WZQ5

SEQ ID NO: 5442 - RNA, 477 nt, Artificial Sequence; identical to SEQ ID NO: 5386
  Cytosine_Deaminase_fcy1__Saccharomyces_cerevisiae__AJV92601

SEQ ID NO: 5443 - RNA, 477 nt, Artificial Sequence; identical to SEQ ID NO: 5387
  derived and/or modified sequence opt1 from Cytosine_Deaminase_fcy1__Saccharomyces_cerevisiae__AJV92601

SEQ ID NO: 5444 - RNA, 477 nt, Artificial Sequence; identical to SEQ ID NO: 5388
  derived and/or modified sequence opt2 from Cytosine_Deaminase_fcy1__Saccharomyces_cerevisiae__AJV92601

SEQ ID NO: 5445 - RNA, 477 nt, Artificial Sequence; identical to SEQ ID NO: 5389
  derived and/or modified sequence opt3 from Cytosine_Deaminase_fcy1__Saccharomyces_cerevisiae__AJV92601

SEQ ID NO: 5446 - RNA, 477 nt, Artificial Sequence; identical to SEQ ID NO: 5390
  derived and/or modified sequence opt4 from Cytosine_Deaminase_fcy1__Saccharomyces_cerevisiae__AJV92601

SEQ ID NO: 5447 - RNA, 477 nt, Artificial Sequence; identical to SEQ ID NO: 5391
  derived and/or modified sequence opt5 from Cytosine_Deaminase_fcy1__Saccharomyces_cerevisiae__AJV92601

SEQ ID NO: 5448 - RNA, 477 nt, Artificial Sequence
  derived and/or modified sequence opt6 from Cytosine_Deaminase_fcy1__Saccharomyces_cerevisiae__AJV92601
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguauuaggaagaggacauaauaugagauuucaaaaaggaagugcaacauuacauggagaaauaaguacauuagaaaauuguggaagauuagaagggaaaguauauaaagauacaacauuauauacaacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5449 - protein, 158 aa, Artificial Sequence; identical to SEQ ID NO: 5385
  Cytosine_Deaminase_fcy1__Saccharomyces_cerevisiae__A0A0D4X0R8

SEQ ID NO: 5450 - RNA, 477 nt, Artificial Sequence; identical to SEQ ID NO: 5418
  Cytosine_Deaminase_fcy1__Saccharomyces_cerevisiae__AJV93034

SEQ ID NO: 5451 - RNA, 477 nt, Artificial Sequence; identical to SEQ ID NO: 5387
  derived and/or modified sequence opt1 from Cytosine_Deaminase_fcy1__Saccharomyces_cerevisiae__AJV93034

SEQ ID NO: 5452 - RNA, 477 nt, Artificial Sequence; identical to SEQ ID NO: 5388
  derived and/or modified sequence opt2 from Cytosine_Deaminase_fcy1__Saccharomyces_cerevisiae__AJV93034

SEQ ID NO: 5453 - RNA, 477 nt, Artificial Sequence; identical to SEQ ID NO: 5389
  derived and/or modified sequence opt3 from Cytosine_Deaminase_fcy1__Saccharomyces_cerevisiae__AJV93034

SEQ ID NO: 5454 - RNA, 477 nt, Artificial Sequence; identical to SEQ ID NO: 5390
  derived and/or modified sequence opt4 from Cytosine_Deaminase_fcy1__Saccharomyces_cerevisiae__AJV93034

SEQ ID NO: 5455 - RNA, 477 nt, Artificial Sequence; identical to SEQ ID NO: 5391
  derived and/or modified sequence opt5 from Cytosine_Deaminase_fcy1__Saccharomyces_cerevisiae__AJV93034

SEQ ID NO: 5456 - RNA, 477 nt, Artificial Sequence
  derived and/or modified sequence opt6 from Cytosine_Deaminase_fcy1__Saccharomyces_cerevisiae__AJV93034
augguaacaggaggaauggcaaguaaaugggaucaaaaaggaauggauauagcauaugaagaagcagcauuaggauauaaagaaggaggaguaccaauaggaggauguuuaauaaauaauaaagacggaaguguauuaggaagaggacauaauaugagauuucaaaaaggaagcgcaacauuacauggagaaauaaguacauuagaaaauuguggaagauuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguggacgaugaaagauguaaaaaaauaaugaaacaauuuauagaugaaagaccacaagauugguuugaagauauaggagaauag

SEQ ID NO: 5457 - protein, 158 aa, Artificial Sequence; identical to SEQ ID NO: 5385
  Cytosine_Deaminase_fcy1__Saccharomyces_cerevisiae__A0A0D4X195

SEQ ID NO: 5458 - RNA, 477 nt, Artificial Sequence; identical to SEQ ID NO: 5386
  Cytosine_Deaminase_fcy1__Saccharomyces_cerevisiae__AJV93300

SEQ ID NO: 5459 - RNA, 477 nt, Artificial Sequence; identical to SEQ ID NO: 5387
  derived and/or modified sequence opt1 from Cytosine_Deaminase_fcy1__Saccharomyces_cerevisiae__AJV93300

SEQ ID NO: 5460 - RNA, 477 nt, Artificial Sequence; identical to SEQ ID NO: 5388
  derived and/or modified sequence opt2 from Cytosine_Deaminase_fcy1__Saccharomyces_cerevisiae__AJV93300

SEQ ID NO: 5461 - RNA, 477 nt, Artificial Sequence; identical to SEQ ID NO: 5389
  derived and/or modified sequence opt3 from Cytosine_Deaminase_fcy1__Saccharomyces_cerevisiae__AJV93300

SEQ ID NO: 5462 - RNA, 477 nt, Artificial Sequence; identical to SEQ ID NO: 5390
  derived and/or modified sequence opt4 from Cytosine_Deaminase_fcy1__Saccharomyces_cerevisiae__AJV93300

SEQ ID NO: 5463 - RNA, 477 nt, Artificial Sequence; identical to SEQ ID NO: 5391
  derived and/or modified sequence opt5 from Cytosine_Deaminase_fcy1__Saccharomyces_cerevisiae__AJV93300

SEQ ID NO: 5464 - RNA, 477 nt, Artificial Sequence
  derived and/or modified sequence opt6 from Cytosine_Deaminase_fcy1__Saccharomyces_cerevisiae__AJV93300
augguaacaggaggaauggcaaguaaaugggaucaaaaaggaauggauauagcauaugaagaagcagcacuaggauauaaagaaggaggaguaccaauaggaggaugucuaauaaauaauaaagauggaaguguauuaggaagaggacauaauaugagauuucaaaaaggaagugcaacauuacauggagaaauaaguacauuagaaaauuguggaagacuagaaggaaaaguauauaaagauacaacauuauauacaacauuaaguccgugugauaugugcacaggagcaauaauaauguauggaauaccaagauguguaguaggagaaaauguaaauuuuaaaagcaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5465 - protein, 158 aa, Artificial Sequence; identical to SEQ ID NO: 5385
  Cytosine_Deaminase_fcy1__Saccharomyces_cerevisiae__A0A0D4X2R9

SEQ ID NO: 5466 - RNA, 477 nt, Artificial Sequence
  Cytosine_Deaminase_fcy1__Saccharomyces_cerevisiae__AJV93739
auggugacagggggaauggcaagcaagugggaucagaaggguauggacauugccuaugaggaggcggccuuagguuacaaagagggugguguuccaauuggcggaugucuuaucaauaacaaagacggaaguguucucggucguggucacaacaugagguuucaaaagggauccgccacacuacauggugagaucuccacuuuggaaaacugugggagauuagagggcaaaguguacaaagauaccacuuuguauacgacgcuguccccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauuuaucgaugaaagaccucaggauugguuugaagauauuggugaguag

SEQ ID NO: 5467 - RNA, 477 nt, Artificial Sequence; identical to SEQ ID NO: 5387
  derived and/or modified sequence opt1 from Cytosine_Deaminase_fcy1__Saccharomyces_cerevisiae__AJV93739

SEQ ID NO: 5468 - RNA, 477 nt, Artificial Sequence; identical to SEQ ID NO: 5388
  derived and/or modified sequence opt2 from Cytosine_Deaminase_fcy1__Saccharomyces_cerevisiae__AJV93739

SEQ ID NO: 5469 - RNA, 477 nt, Artificial Sequence; identical to SEQ ID NO: 5389
  derived and/or modified sequence opt3 from Cytosine_Deaminase_fcy1__Saccharomyces_cerevisiae__AJV93739

SEQ ID NO: 5470 - RNA, 477 nt, Artificial Sequence; identical to SEQ ID NO: 5390
  derived and/or modified sequence opt4 from Cytosine_Deaminase_fcy1__Saccharomyces_cerevisiae__AJV93739

SEQ ID NO: 5471 - RNA, 477 nt, Artificial Sequence; identical to SEQ ID NO: 5391
  derived and/or modified sequence opt5 from Cytosine_Deaminase_fcy1__Saccharomyces_cerevisiae__AJV93739

SEQ ID NO: 5472 - RNA, 477 nt, Artificial Sequence
  derived and/or modified sequence opt6 from Cytosine_Deaminase_fcy1__Saccharomyces_cerevisiae__AJV93739
augguaacaggaggaauggcaaguaaaugggaucaaaaaggaauggacauagcauaugaagaagcagcauuaggauauaaggaaggaggaguaccaauaggaggaugcuuaauaaauaauaaagacggaaguguauuaggaagaggacauaauaugagauuucaaaaaggaagugcaacacuacacggagaaauaaguacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5473 - protein, 158 aa, Artificial Sequence; identical to SEQ ID NO: 5385
  Cytosine_Deaminase_fcy1__Saccharomyces_cerevisiae__A0A0D4X3Q1

SEQ ID NO: 5474 - RNA, 477 nt, Artificial Sequence; identical to SEQ ID NO: 5418
  Cytosine_Deaminase_fcy1__Saccharomyces_cerevisiae__AJV94006

SEQ ID NO: 5475 - RNA, 477 nt, Artificial Sequence; identical to SEQ ID NO: 5387
  derived and/or modified sequence opt1 from Cytosine_Deaminase_fcy1__Saccharomyces_cerevisiae__AJV94006

SEQ ID NO: 5476 - RNA, 477 nt, Artificial Sequence; identical to SEQ ID NO: 5388
  derived and/or modified sequence opt2 from Cytosine_Deaminase_fcy1__Saccharomyces_cerevisiae__AJV94006

SEQ ID NO: 5477 - RNA, 477 nt, Artificial Sequence; identical to SEQ ID NO: 5389
  derived and/or modified sequence opt3 from Cytosine_Deaminase_fcy1__Saccharomyces_cerevisiae__AJV94006

SEQ ID NO: 5478 - RNA, 477 nt, Artificial Sequence; identical to SEQ ID NO: 5390
  derived and/or modified sequence opt4 from Cytosine_Deaminase_fcy1__Saccharomyces_cerevisiae__AJV94006

SEQ ID NO: 5479 - RNA, 477 nt, Artificial Sequence; identical to SEQ ID NO: 5391
  derived and/or modified sequence opt5 from Cytosine_Deaminase_fcy1__Saccharomyces_cerevisiae__AJV94006

SEQ ID NO: 5480 - RNA, 477 nt, Artificial Sequence
  derived and/or modified sequence opt6 from Cytosine_Deaminase_fcy1__Saccharomyces_cerevisiae__AJV94006
augguaacaggaggaauggcaaguaaaugggaucaaaaaggaauggacauagcauaugaagaagcagcauuaggauauaaagaaggaggaguaccaauaggaggaugcuuaauaaauaauaaagacggaagcguauuaggaagaggacauaauaugagauuucaaaaaggaagugcaacauuacacggagaaauaaguacauuagaaaacuguggaagauuagaaggaaaaguauauaaagauacaacacuauauacaacauuaaguccaugugacaugugcacaggagcgauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5481 - protein, 158 aa, Artificial Sequence; identical to SEQ ID NO: 5385
  Cytosine_Deaminase_fcy1__Saccharomyces_cerevisiae__A0A0D4X4K1

SEQ ID NO: 5482 - RNA, 477 nt, Artificial Sequence; identical to SEQ ID NO: 5386
  Cytosine_Deaminase_fcy1__Saccharomyces_cerevisiae__AJV94445

SEQ ID NO: 5483 - RNA, 477 nt, Artificial Sequence; identical to SEQ ID NO: 5387
  derived and/or modified sequence opt1 from Cytosine_Deaminase_fcy1__Saccharomyces_cerevisiae__AJV94445

SEQ ID NO: 5484 - RNA, 477 nt, Artificial Sequence; identical to SEQ ID NO: 5388
  derived and/or modified sequence opt2 from Cytosine_Deaminase_fcy1__Saccharomyces_cerevisiae__AJV94445

SEQ ID NO: 5485 - RNA, 477 nt, Artificial Sequence; identical to SEQ ID NO: 5389
  derived and/or modified sequence opt3 from Cytosine_Deaminase_fcy1__Saccharomyces_cerevisiae__AJV94445

SEQ ID NO: 5486 - RNA, 477 nt, Artificial Sequence; identical to SEQ ID NO: 5390
  derived and/or modified sequence opt4 from Cytosine_Deaminase_fcy1__Saccharomyces_cerevisiae__AJV94445

SEQ ID NO: 5487 - RNA, 477 nt, Artificial Sequence; identical to SEQ ID NO: 5391
  derived and/or modified sequence opt5 from Cytosine_Deaminase_fcy1__Saccharomyces_cerevisiae__AJV94445

SEQ ID NO: 5488 - RNA, 477 nt, Artificial Sequence
  derived and/or modified sequence opt6 from Cytosine_Deaminase_fcy1__Saccharomyces_cerevisiae__AJV94445
augguaacaggaggaauggcaaguaaaugggaucaaaaaggaauggauauagcauaugaagaagcagcauuaggauauaaagaaggaggaguaccaauaggaggauguuuaauaaauaauaaagauggaagcguacuaggaagaggacauaauaugagguuucaaaaaggaagcgcaacauuacauggagaaauaagcacauuagaaaauugugggagguuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5489 - protein, 158 aa, Artificial Sequence; identical to SEQ ID NO: 5385
  Cytosine_Deaminase_fcy1__Saccharomyces_cerevisiae__A0A0D4X5B7

SEQ ID NO: 5490 - RNA, 477 nt, Artificial Sequence; identical to SEQ ID NO: 5386
  Cytosine_Deaminase_fcy1__Saccharomyces_cerevisiae__AJV94715

SEQ ID NO: 5491 - RNA, 477 nt, Artificial Sequence; identical to SEQ ID NO: 5387
  derived and/or modified sequence opt1 from Cytosine_Deaminase_fcy1__Saccharomyces_cerevisiae__AJV94715

SEQ ID NO: 5492 - RNA, 477 nt, Artificial Sequence; identical to SEQ ID NO: 5388
  derived and/or modified sequence opt2 from Cytosine_Deaminase_fcy1__Saccharomyces_cerevisiae__AJV94715

SEQ ID NO: 5493 - RNA, 477 nt, Artificial Sequence; identical to SEQ ID NO: 5389
  derived and/or modified sequence opt3 from Cytosine_Deaminase_fcy1__Saccharomyces_cerevisiae__AJV94715

SEQ ID NO: 5494 - RNA, 477 nt, Artificial Sequence; identical to SEQ ID NO: 5390
  derived and/or modified sequence opt4 from Cytosine_Deaminase_fcy1__Saccharomyces_cerevisiae__AJV94715

SEQ ID NO: 5495 - RNA, 477 nt, Artificial Sequence; identical to SEQ ID NO: 5391
  derived and/or modified sequence opt5 from Cytosine_Deaminase_fcy1__Saccharomyces_cerevisiae__AJV94715

SEQ ID NO: 5496 - RNA, 477 nt, Artificial Sequence
  derived and/or modified sequence opt6 from Cytosine_Deaminase_fcy1__Saccharomyces_cerevisiae__AJV94715
augguaacgggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaacuguggaagacuagaaggaaaaguauauaaagauacaacacuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5497 - protein, 158 aa, Artificial Sequence; identical to SEQ ID NO: 5385
  Cytosine_Deaminase_fcy1__Saccharomyces_cerevisiae__A0A0D4X7R4

SEQ ID NO: 5498 - RNA, 477 nt, Artificial Sequence
  Cytosine_Deaminase_fcy1__Saccharomyces_cerevisiae__AJV95147
auggugacagggggaauggcaagcaaaugggaucagaaggguauggacauugccuaugaggaggcggccuuagguuacaaagagggugguguuccaauuggcggaugucuuaucaauaacaaagacggaaguguucucggucguggucacaacaugagauuucaaaagggauccgccacacuacauggugagaucuccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauucaucgaugaaagaccucaggauugguuugaagauauuggugaguag

SEQ ID NO: 5499 - RNA, 477 nt, Artificial Sequence; identical to SEQ ID NO: 5387
  derived and/or modified sequence opt1 from Cytosine_Deaminase_fcy1__Saccharomyces_cerevisiae__AJV95147

SEQ ID NO: 5500 - RNA, 477 nt, Artificial Sequence; identical to SEQ ID NO: 5388
  derived and/or modified sequence opt2 from Cytosine_Deaminase_fcy1__Saccharomyces_cerevisiae__AJV95147

SEQ ID NO: 5501 - RNA, 477 nt, Artificial Sequence; identical to SEQ ID NO: 5389
  derived and/or modified sequence opt3 from Cytosine_Deaminase_fcy1__Saccharomyces_cerevisiae__AJV95147

SEQ ID NO: 5502 - RNA, 477 nt, Artificial Sequence; identical to SEQ ID NO: 5390
  derived and/or modified sequence opt4 from Cytosine_Deaminase_fcy1__Saccharomyces_cerevisiae__AJV95147

SEQ ID NO: 5503 - RNA, 477 nt, Artificial Sequence; identical to SEQ ID NO: 5391
  derived and/or modified sequence opt5 from Cytosine_Deaminase_fcy1__Saccharomyces_cerevisiae__AJV95147

SEQ ID NO: 5504 - RNA, 477 nt, Artificial Sequence
  derived and/or modified sequence opt6 from Cytosine_Deaminase_fcy1__Saccharomyces_cerevisiae__AJV95147
augguaacaggaggaauggcaaguaaaugggaucaaaaaggaauggacauagcauaugaagaagcagcauuaggauauaaagaaggaggaguaccaauaggaggauguuuaauaaauaauaaagauggaaguguauuaggaagaggacauaauaugagauuucaaaaaggaagugcaacauugcauggagaaauaaguacauuagaaaauuguggaagauuagaaggaaaaguauauaaagauacaacacuauauacaacauuaagcccaugugauauguguacaggagcaauaauaauguauggaauaccaagauguguaguaggagaaaauguaaauuuuaaaagcaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5505 - protein, 158 aa, Artificial Sequence; identical to SEQ ID NO: 5385
  Cytosine_Deaminase_fcy1__Saccharomyces_cerevisiae__A0A0D4X7X4

SEQ ID NO: 5506 - RNA, 477 nt, Artificial Sequence; identical to SEQ ID NO: 5386
  Cytosine_Deaminase_fcy1__Saccharomyces_cerevisiae__AJV95584

SEQ ID NO: 5507 - RNA, 477 nt, Artificial Sequence; identical to SEQ ID NO: 5387
  derived and/or modified sequence opt1 from Cytosine_Deaminase_fcy1__Saccharomyces_cerevisiae__AJV95584

SEQ ID NO: 5508 - RNA, 477 nt, Artificial Sequence; identical to SEQ ID NO: 5388
  derived and/or modified sequence opt2 from Cytosine_Deaminase_fcy1__Saccharomyces_cerevisiae__AJV95584

SEQ ID NO: 5509 - RNA, 477 nt, Artificial Sequence; identical to SEQ ID NO: 5389
  derived and/or modified sequence opt3 from Cytosine_Deaminase_fcy1__Saccharomyces_cerevisiae__AJV95584

SEQ ID NO: 5510 - RNA, 477 nt, Artificial Sequence; identical to SEQ ID NO: 5390
  derived and/or modified sequence opt4 from Cytosine_Deaminase_fcy1__Saccharomyces_cerevisiae__AJV95584

SEQ ID NO: 5511 - RNA, 477 nt, Artificial Sequence; identical to SEQ ID NO: 5391
  derived and/or modified sequence opt5 from Cytosine_Deaminase_fcy1__Saccharomyces_cerevisiae__AJV95584

SEQ ID NO: 5512 - RNA, 477 nt, Artificial Sequence
  derived and/or modified sequence opt6 from Cytosine_Deaminase_fcy1__Saccharomyces_cerevisiae__AJV95584
augguaacaggaggaauggcaaguaaaugggaucaaaaaggaauggauauagcauaugaagaagcagcauuaggauauaaagaaggaggaguaccaauagggggauguuuaauaaauaauaaagauggaaguguauuaggaaggggacauaauaugagauuucaaaaaggaagugcaacauuacauggagaaauaaguacauuagaaaauuguggaagacuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauaucuacaaacaaggggacaugaaguaguaguaguagaugaugaaagauguaaaaaaauaaugaaacaauuuauagaugaaagaccacaagauugguuugaagauauaggagaauag

SEQ ID NO: 5513 - protein, 158 aa, Artificial Sequence; identical to SEQ ID NO: 5385
  Cytosine_Deaminase_fcy1__Saccharomyces_cerevisiae__A0A0D4XA07

SEQ ID NO: 5514 - RNA, 477 nt, Artificial Sequence; identical to SEQ ID NO: 5386
  Cytosine_Deaminase_fcy1__Saccharomyces_cerevisiae__AJV95852

SEQ ID NO: 5515 - RNA, 477 nt, Artificial Sequence; identical to SEQ ID NO: 5387
  derived and/or modified sequence opt1 from Cytosine_Deaminase_fcy1__Saccharomyces_cerevisiae__AJV95852

SEQ ID NO: 5516 - RNA, 477 nt, Artificial Sequence; identical to SEQ ID NO: 5388
  derived and/or modified sequence opt2 from Cytosine_Deaminase_fcy1__Saccharomyces_cerevisiae__AJV95852

SEQ ID NO: 5517 - RNA, 477 nt, Artificial Sequence; identical to SEQ ID NO: 5389
  derived and/or modified sequence opt3 from Cytosine_Deaminase_fcy1__Saccharomyces_cerevisiae__AJV95852

SEQ ID NO: 5518 - RNA, 477 nt, Artificial Sequence; identical to SEQ ID NO: 5390
  derived and/or modified sequence opt4 from Cytosine_Deaminase_fcy1__Saccharomyces_cerevisiae__AJV95852

SEQ ID NO: 5519 - RNA, 477 nt, Artificial Sequence; identical to SEQ ID NO: 5391
  derived and/or modified sequence opt5 from Cytosine_Deaminase_fcy1__Saccharomyces_cerevisiae__AJV95852

SEQ ID NO: 5520 - RNA, 477 nt, Artificial Sequence
  derived and/or modified sequence opt6 from Cytosine_Deaminase_fcy1__Saccharomyces_cerevisiae__AJV95852
augguaacaggaggaauggcaaguaaaugggaucaaaaaggaauggacauagcauaugaagaagcagcacuaggauauaaagaaggaggaguaccaauaggaggaugcuuaauaaauaauaaagacggaaguguauuaggaagaggacauaauaugagauuucaaaaaggaagugcaacauuacauggagaaauaaguacauuagaaaacugcggaagauuagaaggaaaaguauauaaagauacaacauuauauacaacauuaaguccaugugacaugugcacaggagcaauaauaauguauggaauaccaagguguguaguaggagaaaauguaaauuuuaaaaguaaaggagaaaaauaucuacaaacaagaggacaugaaguaguaguaguagaugacgaaagauguaaaaaaauaaugaaacaauuuauagaugaaagaccacaagauugguuugaagauauaggagaauaa

SEQ ID NO: 5521 - protein, 158 aa, Artificial Sequence; identical to SEQ ID NO: 5385
  Cytosine_Deaminase_fcy1__Saccharomyces_cerevisiae__A0A0D4XA25

SEQ ID NO: 5522 - RNA, 477 nt, Artificial Sequence; identical to SEQ ID NO: 5386
  Cytosine_Deaminase_fcy1__Saccharomyces_cerevisiae__AJV96293

SEQ ID NO: 5523 - RNA, 477 nt, Artificial Sequence; identical to SEQ ID NO: 5387
  derived and/or modified sequence opt1 from Cytosine_Deaminase_fcy1__Saccharomyces_cerevisiae__AJV96293

SEQ ID NO: 5524 - RNA, 477 nt, Artificial Sequence; identical to SEQ ID NO: 5388
  derived and/or modified sequence opt2 from Cytosine_Deaminase_fcy1__Saccharomyces_cerevisiae__AJV96293

SEQ ID NO: 5525 - RNA, 477 nt, Artificial Sequence; identical to SEQ ID NO: 5389
  derived and/or modified sequence opt3 from Cytosine_Deaminase_fcy1__Saccharomyces_cerevisiae__AJV96293

SEQ ID NO: 5526 - RNA, 477 nt, Artificial Sequence; identical to SEQ ID NO: 5390
  derived and/or modified sequence opt4 from Cytosine_Deaminase_fcy1__Saccharomyces_cerevisiae__AJV96293

SEQ ID NO: 5527 - RNA, 477 nt, Artificial Sequence; identical to SEQ ID NO: 5391
  derived and/or modified sequence opt5 from Cytosine_Deaminase_fcy1__Saccharomyces_cerevisiae__AJV96293

SEQ ID NO: 5528 - RNA, 477 nt, Artificial Sequence
  derived and/or modified sequence opt6 from Cytosine_Deaminase_fcy1__Saccharomyces_cerevisiae__AJV96293
augguaacaggaggaauggcaagcaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaacuguggaagauuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguagugguagaugacgaaagauguaaaaaaauaaugaaacaauuuauagaugaaagaccacaagauugguuugaagauauaggagaauaa

SEQ ID NO: 5529 - protein, 158 aa, Artificial Sequence
  Cytosine_Deaminase_fcy1__Saccharomyces_cerevisiae__A0A0D4XAV6
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFINERPQDWFEDIGE

SEQ ID NO: 5530 - RNA, 477 nt, Artificial Sequence
  Cytosine_Deaminase_fcy1__Saccharomyces_cerevisiae__AJV96709
auggugacagggggaauggcaagcaagugggaucagaaggguauggacauugccuaugaggaggcggccuuagguuacaaagagggugguguuccuauuggcggaugucuuaucaauaacaaagacggaaguguucucggucguggucacaacaugagauuucaaaagggauccgccacacuacauggugagaucuccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauuuaucaaugaaagaccucaggauugguuugaagauauuggugaguag

SEQ ID NO: 5531 - RNA, 477 nt, Artificial Sequence
  derived and/or modified sequence opt1 from Cytosine_Deaminase_fcy1__Saccharomyces_cerevisiae__AJV96709
auggugaccggcgggauggccagcaagugggaccagaagggcauggacaucgccuacgaggaggcggcccugggguacaaggagggcgggguccccaucggcggcugccucaucaacaacaaggacggguccgugcugggccgcgggcacaacaugcgguuccagaagggcagcgccacccugcacggggagaucuccacgcucgagaacugcggccgccuggagggcaagguguacaaggacaccacccuguacaccacgcucagcccgugcgacaugugcaccggggccaucaucauguacggcaucccccggugcgucgugggggagaacgugaacuucaaguccaagggcgagaaguaccugcagacccgcggccacgaggucgugguggucgacgacgagcggugcaagaagaucaugaagcaguucaucaacgagcgcccccaggacugguucgaggacaucggggaguga

SEQ ID NO: 5532 - RNA, 477 nt, Artificial Sequence
  derived and/or modified sequence opt2 from Cytosine_Deaminase_fcy1__Saccharomyces_cerevisiae__AJV96709
auggucaccggcggcauggccuccaagugggaccagaagggcauggacaucgccuacgaggaggccgcccucggcuacaaggagggcggcguccccaucggcggcugccucaucaacaacaaggacggcuccguccucggccgcggccacaacaugcgcuuccagaagggcuccgccacccuccacggcgagaucuccacccucgagaacugcggccgccucgagggcaaggucuacaaggacaccacccucuacaccacccucucccccugcgacaugugcaccggcgccaucaucauguacggcaucccccgcugcgucgucggcgagaacgucaacuucaaguccaagggcgagaaguaccuccagacccgcggccacgaggucgucgucgucgacgacgagcgcugcaagaagaucaugaagcaguucaucaacgagcgcccccaggacugguucgaggacaucggcgaguga

SEQ ID NO: 5533 - RNA, 477 nt, Artificial Sequence
  derived and/or modified sequence opt3 from Cytosine_Deaminase_fcy1__Saccharomyces_cerevisiae__AJV96709
auggugaccggcgggauggccagcaagugggaccagaaaggaauggauaucgcuuacgaggaagcagcccuggguuauaaggagggcgggguccccauuggaggcugccucauaaacaauaaagacgguuccguucuugggagaggacacaacaugagguuccaaaagggcucugcgacacugcauggcgaaaucucaacuuuggagaauugugggcgguuagaaggaaaaguguacaaggauacgacccuguauacaacucuaaguccuugcgacauguguaccggugcuauuaucauguacggcauuccacgcugcguagugggggagaacgucaauuuuaagagcaaaggagagaaguaucuccagacacgaggccacgaagugguuguggucgaugacgagcguuguaaaaagaucaugaaacaguucauaaacgaaagaccgcaggauugguuugaggacaucggugaguga

SEQ ID NO: 5534 - RNA, 477 nt, Artificial Sequence
  derived and/or modified sequence opt4 from Cytosine_Deaminase_fcy1__Saccharomyces_cerevisiae__AJV96709
auggugaccggcggcauggccagcaagugggaccagaagggcauggacaucgccuacgaggaggccgcccugggcuacaaggagggcggcgugcccaucggcggcugccugaucaacaacaaggacggcagcgugcugggcagaggccacaacaugagauuccagaagggcagcgccacccugcacggcgagaucagcacccuggagaacugcggcagacuggagggcaagguguacaaggacaccacccuguacaccacccugagccccugcgacaugugcaccggcgccaucaucauguacggcauccccagaugcguggugggcgagaacgugaacuucaagagcaagggcgagaaguaccugcagaccagaggccacgaggugguggugguggacgacgagagaugcaagaagaucaugaagcaguucaucaacgagagaccccaggacugguucgaggacaucggcgaguga

SEQ ID NO: 5535 - RNA, 477 nt, Artificial Sequence
  derived and/or modified sequence opt5 from Cytosine_Deaminase_fcy1__Saccharomyces_cerevisiae__AJV96709
auggugaccggcgggauggccagcaagugggaccagaaaggaauggauaucgcuuacgaggaagccgcgcugggcuauaaggaagggggaguccccauuggcgggugccucaucaacaauaaagacggauccguucugggcagaggccacaacaugcgguuccaaaaggggucugcuacacuucauggagagauuagcacgcuggagaauuguggccgccucgaagggaaaguguacaaggauaccacacuguauaccacacuuuccccuugcgacauguguaccggagccaucauuauguacggcaucccgagaugcguggucggggagaacgugaauuuuaagucuaaaggagagaaguaucugcagacacggggccacgaaguuguggucguggaugacgagcgcuguaaaaagaucaugaaacaguucauuaacgaaagaccccaggauugguuugaggacaucggcgaguga

SEQ ID NO: 5536 - RNA, 477 nt, Artificial Sequence
  derived and/or modified sequence opt6 from Cytosine_Deaminase_fcy1__Saccharomyces_cerevisiae__AJV96709
augguaacaggaggaauggcaagcaaaugggaucaaaaaggaauggacauagcauaugaagaagcagcguuaggauauaaagaaggaggaguaccaauaggaggaugcuuaauaaauaacaaagacggaagcguguuaggaagaggacauaauaugagauuccaaaaaggaagugcaacauuacacggagaaauaagcacacuagaaaacuguggaagacuagaaggaaaaguauauaaagacacaacauuauauacaacacuaaguccaugugacaugugcacaggagcaauaauaauguauggaauaccaagaugcguaguaggagaaaauguaaauuucaaaaguaaaggagaaaaauaucuacaaacaagaggacaugaaguaguaguaguagaugacgaaagauguaaaaaaauaaugaaacaauuuauaaaugaaagaccacaagauugguuugaagauauaggagaauaa

SEQ ID NO: 5537 - protein, 158 aa, Artificial Sequence; identical to SEQ ID NO: 5385
  Cytosine_Deaminase_fcy1__Saccharomyces_cerevisiae__A0A0D4XCJ5

SEQ ID NO: 5538 - RNA, 477 nt, Artificial Sequence; identical to SEQ ID NO: 5386
  Cytosine_Deaminase_fcy1__Saccharomyces_cerevisiae__AJV97145

SEQ ID NO: 5539 - RNA, 477 nt, Artificial Sequence; identical to SEQ ID NO: 5387
  derived and/or modified sequence opt1 from Cytosine_Deaminase_fcy1__Saccharomyces_cerevisiae__AJV97145

SEQ ID NO: 5540 - RNA, 477 nt, Artificial Sequence; identical to SEQ ID NO: 5388
  derived and/or modified sequence opt2 from Cytosine_Deaminase_fcy1__Saccharomyces_cerevisiae__AJV97145

SEQ ID NO: 5541 - RNA, 477 nt, Artificial Sequence; identical to SEQ ID NO: 5389
  derived and/or modified sequence opt3 from Cytosine_Deaminase_fcy1__Saccharomyces_cerevisiae__AJV97145

SEQ ID NO: 5542 - RNA, 477 nt, Artificial Sequence; identical to SEQ ID NO: 5390
  derived and/or modified sequence opt4 from Cytosine_Deaminase_fcy1__Saccharomyces_cerevisiae__AJV97145

SEQ ID NO: 5543 - RNA, 477 nt, Artificial Sequence; identical to SEQ ID NO: 5391
  derived and/or modified sequence opt5 from Cytosine_Deaminase_fcy1__Saccharomyces_cerevisiae__AJV97145

SEQ ID NO: 5544 - RNA, 477 nt, Artificial Sequence
  derived and/or modified sequence opt6 from Cytosine_Deaminase_fcy1__Saccharomyces_cerevisiae__AJV97145
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguauuaggaagaggacauaauaugagauuucaaaaaggaagcgcaacauuacauggagaaauaaguacauuagaaaauugcggaagacuagaaggaaaaguauauaaagauacaacauuauauacaacauuaaguccaugugauauguguacaggagcaauaauaauguauggaauaccaagauguguaguaggagaaaauguaaauuuuaaaagcaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5545 - protein, 158 aa, Artificial Sequence; identical to SEQ ID NO: 5385
  Cytosine_Deaminase_fcy1__Saccharomyces_cerevisiae__A0A0D4XDL4

SEQ ID NO: 5546 - RNA, 477 nt, Artificial Sequence; identical to SEQ ID NO: 5386
  Cytosine_Deaminase_fcy1__Saccharomyces_cerevisiae__AJV97588

SEQ ID NO: 5547 - RNA, 477 nt, Artificial Sequence; identical to SEQ ID NO: 5387
  derived and/or modified sequence opt1 from Cytosine_Deaminase_fcy1__Saccharomyces_cerevisiae__AJV97588

SEQ ID NO: 5548 - RNA, 477 nt, Artificial Sequence; identical to SEQ ID NO: 5388
  derived and/or modified sequence opt2 from Cytosine_Deaminase_fcy1__Saccharomyces_cerevisiae__AJV97588

SEQ ID NO: 5549 - RNA, 477 nt, Artificial Sequence; identical to SEQ ID NO: 5389
  derived and/or modified sequence opt3 from Cytosine_Deaminase_fcy1__Saccharomyces_cerevisiae__AJV97588

SEQ ID NO: 5550 - RNA, 477 nt, Artificial Sequence; identical to SEQ ID NO: 5390
  derived and/or modified sequence opt4 from Cytosine_Deaminase_fcy1__Saccharomyces_cerevisiae__AJV97588

SEQ ID NO: 5551 - RNA, 477 nt, Artificial Sequence; identical to SEQ ID NO: 5391
  derived and/or modified sequence opt5 from Cytosine_Deaminase_fcy1__Saccharomyces_cerevisiae__AJV97588

SEQ ID NO: 5552 - RNA, 477 nt, Artificial Sequence
  derived and/or modified sequence opt6 from Cytosine_Deaminase_fcy1__Saccharomyces_cerevisiae__AJV97588
augguaacaggaggaauggcaagcaaaugggaucaaaaaggaauggauauagcauaugaagaagcagcauuaggauauaaagaaggaggaguaccaauaggaggauguuuaauaaauaauaaagauggaaguguauuaggaagaggacauaauaugagauuucaaaaagggagugcaacauuacauggagaaauaaguacauuagaaaauuguggaagacuagaaggaaaaguauauaaagauacgacauuauauacaacauuaaguccaugugauauguguacaggagcaauaauaauguauggaauaccaagguguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5553 - protein, 158 aa, Artificial Sequence; identical to SEQ ID NO: 5385
  Cytosine_Deaminase_fcy1__Saccharomyces_cerevisiae__A0A0D4XG53

SEQ ID NO: 5554 - RNA, 477 nt, Artificial Sequence; identical to SEQ ID NO: 5386
  Cytosine_Deaminase_fcy1__Saccharomyces_cerevisiae__AJV98027

SEQ ID NO: 5555 - RNA, 477 nt, Artificial Sequence; identical to SEQ ID NO: 5387
  derived and/or modified sequence opt1 from Cytosine_Deaminase_fcy1__Saccharomyces_cerevisiae__AJV98027

SEQ ID NO: 5556 - RNA, 477 nt, Artificial Sequence; identical to SEQ ID NO: 5388
  derived and/or modified sequence opt2 from Cytosine_Deaminase_fcy1__Saccharomyces_cerevisiae__AJV98027

SEQ ID NO: 5557 - RNA, 477 nt, Artificial Sequence; identical to SEQ ID NO: 5389
  derived and/or modified sequence opt3 from Cytosine_Deaminase_fcy1__Saccharomyces_cerevisiae__AJV98027

SEQ ID NO: 5558 - RNA, 477 nt, Artificial Sequence; identical to SEQ ID NO: 5390
  derived and/or modified sequence opt4 from Cytosine_Deaminase_fcy1__Saccharomyces_cerevisiae__AJV98027

SEQ ID NO: 5559 - RNA, 477 nt, Artificial Sequence; identical to SEQ ID NO: 5391
  derived and/or modified sequence opt5 from Cytosine_Deaminase_fcy1__Saccharomyces_cerevisiae__AJV98027

SEQ ID NO: 5560 - RNA, 477 nt, Artificial Sequence
  derived and/or modified sequence opt6 from Cytosine_Deaminase_fcy1__Saccharomyces_cerevisiae__AJV98027
augguaacaggaggaauggcgaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacacuacacggagaaauaagcacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5561 - protein, 158 aa, Artificial Sequence; identical to SEQ ID NO: 5385
  Cytosine_Deaminase_fcy1__Saccharomyces_cerevisiae__A0A0D4XGH3

SEQ ID NO: 5562 - RNA, 477 nt, Artificial Sequence; identical to SEQ ID NO: 5386
  Cytosine_Deaminase_fcy1__Saccharomyces_cerevisiae__AJV98465

SEQ ID NO: 5563 - RNA, 477 nt, Artificial Sequence; identical to SEQ ID NO: 5387
  derived and/or modified sequence opt1 from Cytosine_Deaminase_fcy1__Saccharomyces_cerevisiae__AJV98465

SEQ ID NO: 5564 - RNA, 477 nt, Artificial Sequence; identical to SEQ ID NO: 5388
  derived and/or modified sequence opt2 from Cytosine_Deaminase_fcy1__Saccharomyces_cerevisiae__AJV98465

SEQ ID NO: 5565 - RNA, 477 nt, Artificial Sequence; identical to SEQ ID NO: 5389
  derived and/or modified sequence opt3 from Cytosine_Deaminase_fcy1__Saccharomyces_cerevisiae__AJV98465

SEQ ID NO: 5566 - RNA, 477 nt, Artificial Sequence; identical to SEQ ID NO: 5390
  derived and/or modified sequence opt4 from Cytosine_Deaminase_fcy1__Saccharomyces_cerevisiae__AJV98465

SEQ ID NO: 5567 - RNA, 477 nt, Artificial Sequence; identical to SEQ ID NO: 5391
  derived and/or modified sequence opt5 from Cytosine_Deaminase_fcy1__Saccharomyces_cerevisiae__AJV98465

SEQ ID NO: 5568 - RNA, 477 nt, Artificial Sequence
  derived and/or modified sequence opt6 from Cytosine_Deaminase_fcy1__Saccharomyces_cerevisiae__AJV98465
augguaacaggagggauggcaaguaaaugggaucaaaaaggaauggacauagcauaugaagaagcagcguuaggauauaaagaaggaggaguaccaauaggaggauguuuaauaaauaauaaagacggaaguguacuaggaagaggacauaauaugagauuucaaaaaggaagugcaacauuacauggagaaauaaguacauuagaaaacuguggaagacuagaaggaaaaguauauaaagauacaacacuauauacaacauuaaguccaugugacaugugcacaggagcaauaauaauguauggaauaccaagauguguaguaggagaaaauguaaauuuuaaaaguaaaggagaaaaauaucuacaaacaagaggacaugaaguaguaguaguagaugacgaaagauguaaaaaaauaaugaaacaauuuauagaugaaagaccacaagauugguuugaagauauaggagaauaa

SEQ ID NO: 5569 - protein, 158 aa, Artificial Sequence; identical to SEQ ID NO: 5385
  Cytosine_Deaminase_fcy1__Saccharomyces_cerevisiae__A0A0D4XHD4

SEQ ID NO: 5570 - RNA, 477 nt, Artificial Sequence; identical to SEQ ID NO: 5386
  Cytosine_Deaminase_fcy1__Saccharomyces_cerevisiae__AJV98898

SEQ ID NO: 5571 - RNA, 477 nt, Artificial Sequence; identical to SEQ ID NO: 5387
  derived and/or modified sequence opt1 from Cytosine_Deaminase_fcy1__Saccharomyces_cerevisiae__AJV98898

SEQ ID NO: 5572 - RNA, 477 nt, Artificial Sequence; identical to SEQ ID NO: 5388
  derived and/or modified sequence opt2 from Cytosine_Deaminase_fcy1__Saccharomyces_cerevisiae__AJV98898

SEQ ID NO: 5573 - RNA, 477 nt, Artificial Sequence; identical to SEQ ID NO: 5389
  derived and/or modified sequence opt3 from Cytosine_Deaminase_fcy1__Saccharomyces_cerevisiae__AJV98898

SEQ ID NO: 5574 - RNA, 477 nt, Artificial Sequence; identical to SEQ ID NO: 5390
  derived and/or modified sequence opt4 from Cytosine_Deaminase_fcy1__Saccharomyces_cerevisiae__AJV98898

SEQ ID NO: 5575 - RNA, 477 nt, Artificial Sequence; identical to SEQ ID NO: 5391
  derived and/or modified sequence opt5 from Cytosine_Deaminase_fcy1__Saccharomyces_cerevisiae__AJV98898

SEQ ID NO: 5576 - RNA, 477 nt, Artificial Sequence
  derived and/or modified sequence opt6 from Cytosine_Deaminase_fcy1__Saccharomyces_cerevisiae__AJV98898
augguaacaggaggaauggcaaguaaaugggaucaaaaaggaauggacauagcauaugaagaagcagcauuaggauauaaagaagggggaguaccaauaggaggaugcuuaauaaauaauaaagacggaaguguauuaggaagaggacauaauaugagauuucaaaaaggaagugcaacacuacacggagaaauaagcacauuagaaaacuguggaagauuagaaggaaaaguauauaaagauacaacauuauauacaacauuaaguccaugugacaugugcacaggagcaauaauaauguauggaauaccaagauguguaguaggagaaaauguaaauuuuaaaaguaaaggagagaaauaucuacaaacaagaggacaugaaguaguaguaguagaugacgaaagauguaaaaaaauaaugaaacaauuuauagaugaaagaccacaagauugguuugaagauauaggagaauaa

SEQ ID NO: 5577 - protein, 158 aa, Artificial Sequence; identical to SEQ ID NO: 5385
  Cytosine_Deaminase_fcy1__Saccharomyces_cerevisiae__A0A0D4XIK5

SEQ ID NO: 5578 - RNA, 477 nt, Artificial Sequence; identical to SEQ ID NO: 5418
  Cytosine_Deaminase_fcy1__Saccharomyces_cerevisiae__AJV99338

SEQ ID NO: 5579 - RNA, 477 nt, Artificial Sequence; identical to SEQ ID NO: 5387
  derived and/or modified sequence opt1 from Cytosine_Deaminase_fcy1__Saccharomyces_cerevisiae__AJV99338

SEQ ID NO: 5580 - RNA, 477 nt, Artificial Sequence; identical to SEQ ID NO: 5388
  derived and/or modified sequence opt2 from Cytosine_Deaminase_fcy1__Saccharomyces_cerevisiae__AJV99338

SEQ ID NO: 5581 - RNA, 477 nt, Artificial Sequence; identical to SEQ ID NO: 5389
  derived and/or modified sequence opt3 from Cytosine_Deaminase_fcy1__Saccharomyces_cerevisiae__AJV99338

SEQ ID NO: 5582 - RNA, 477 nt, Artificial Sequence; identical to SEQ ID NO: 5390
  derived and/or modified sequence opt4 from Cytosine_Deaminase_fcy1__Saccharomyces_cerevisiae__AJV99338

SEQ ID NO: 5583 - RNA, 477 nt, Artificial Sequence; identical to SEQ ID NO: 5391
  derived and/or modified sequence opt5 from Cytosine_Deaminase_fcy1__Saccharomyces_cerevisiae__AJV99338

SEQ ID NO: 5584 - RNA, 477 nt, Artificial Sequence
  derived and/or modified sequence opt6 from Cytosine_Deaminase_fcy1__Saccharomyces_cerevisiae__AJV99338
augguaacaggaggaauggcaaguaaaugggaucaaaaaggaauggauauagcauaugaagaagcagcauuaggauauaaagaaggaggaguaccaauaggaggauguuuaauaaauaauaaagauggaagcguauugggaaggggacauaauaugagauuucaaaaaggaagugcgacacuacauggagaaauaaguacacuagaaaauuguggaagacuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguggaugaugaaagauguaaaaaaauaaugaaacaauuuauagaugaaagaccacaagauugguuugaagauauaggagaauaa

SEQ ID NO: 5585 - protein, 158 aa, Artificial Sequence; identical to SEQ ID NO: 5385
  Cytosine_Deaminase_fcy1__Saccharomyces_cerevisiae__A0A0D4XJR4

SEQ ID NO: 5586 - RNA, 477 nt, Artificial Sequence; identical to SEQ ID NO: 5466
  Cytosine_Deaminase_fcy1__Saccharomyces_cerevisiae__AJV99779

SEQ ID NO: 5587 - RNA, 477 nt, Artificial Sequence; identical to SEQ ID NO: 5387
  derived and/or modified sequence opt1 from Cytosine_Deaminase_fcy1__Saccharomyces_cerevisiae__AJV99779

SEQ ID NO: 5588 - RNA, 477 nt, Artificial Sequence; identical to SEQ ID NO: 5388
  derived and/or modified sequence opt2 from Cytosine_Deaminase_fcy1__Saccharomyces_cerevisiae__AJV99779

SEQ ID NO: 5589 - RNA, 477 nt, Artificial Sequence; identical to SEQ ID NO: 5389
  derived and/or modified sequence opt3 from Cytosine_Deaminase_fcy1__Saccharomyces_cerevisiae__AJV99779

SEQ ID NO: 5590 - RNA, 477 nt, Artificial Sequence; identical to SEQ ID NO: 5390
  derived and/or modified sequence opt4 from Cytosine_Deaminase_fcy1__Saccharomyces_cerevisiae__AJV99779

SEQ ID NO: 5591 - RNA, 477 nt, Artificial Sequence; identical to SEQ ID NO: 5391
  derived and/or modified sequence opt5 from Cytosine_Deaminase_fcy1__Saccharomyces_cerevisiae__AJV99779

SEQ ID NO: 5592 - RNA, 477 nt, Artificial Sequence
  derived and/or modified sequence opt6 from Cytosine_Deaminase_fcy1__Saccharomyces_cerevisiae__AJV99779
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguguuaggaagaggacauaauaugagauuucaaaaaggaagcgcaacauuacacggagaaauaaguacauuagaaaacuguggaagacuagaaggaaaaguauauaaagauacaacacuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguucgaagauauaggagaauaa

SEQ ID NO: 5593 - protein, 158 aa, Artificial Sequence; identical to SEQ ID NO: 5385
  Cytosine_Deaminase_fcy1__Saccharomyces_cerevisiae__A0A0D4XL36

SEQ ID NO: 5594 - RNA, 477 nt, Artificial Sequence; identical to SEQ ID NO: 5386
  Cytosine_Deaminase_fcy1__Saccharomyces_cerevisiae__AJW00204

SEQ ID NO: 5595 - RNA, 477 nt, Artificial Sequence; identical to SEQ ID NO: 5387
  derived and/or modified sequence opt1 from Cytosine_Deaminase_fcy1__Saccharomyces_cerevisiae__AJW00204

SEQ ID NO: 5596 - RNA, 477 nt, Artificial Sequence; identical to SEQ ID NO: 5388
  derived and/or modified sequence opt2 from Cytosine_Deaminase_fcy1__Saccharomyces_cerevisiae__AJW00204

SEQ ID NO: 5597 - RNA, 477 nt, Artificial Sequence; identical to SEQ ID NO: 5389
  derived and/or modified sequence opt3 from Cytosine_Deaminase_fcy1__Saccharomyces_cerevisiae__AJW00204

SEQ ID NO: 5598 - RNA, 477 nt, Artificial Sequence; identical to SEQ ID NO: 5390
  derived and/or modified sequence opt4 from Cytosine_Deaminase_fcy1__Saccharomyces_cerevisiae__AJW00204

SEQ ID NO: 5599 - RNA, 477 nt, Artificial Sequence; identical to SEQ ID NO: 5391
  derived and/or modified sequence opt5 from Cytosine_Deaminase_fcy1__Saccharomyces_cerevisiae__AJW00204

SEQ ID NO: 5600 - RNA, 477 nt, Artificial Sequence
  derived and/or modified sequence opt6 from Cytosine_Deaminase_fcy1__Saccharomyces_cerevisiae__AJW00204
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguauuaggaagaggacauaauaugagauuucaaaaaggaagugcaacauuacauggagaaauaagcacauuagaaaauuguggaagauuagaaggaaaaguauauaaagauacaacauuauauacaacacuaaguccaugugauauguguacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaaggccacaagauugguuugaagauauaggagaauaa

SEQ ID NO: 5601 - protein, 158 aa, Artificial Sequence; identical to SEQ ID NO: 5385
  Cytosine_Deaminase_fcy1__Saccharomyces_cerevisiae__A0A0D4XNH2

SEQ ID NO: 5602 - RNA, 477 nt, Artificial Sequence; identical to SEQ ID NO: 5386
  Cytosine_Deaminase_fcy1__Saccharomyces_cerevisiae__AJW00633

SEQ ID NO: 5603 - RNA, 477 nt, Artificial Sequence; identical to SEQ ID NO: 5387
  derived and/or modified sequence opt1 from Cytosine_Deaminase_fcy1__Saccharomyces_cerevisiae__AJW00633

SEQ ID NO: 5604 - RNA, 477 nt, Artificial Sequence; identical to SEQ ID NO: 5388
  derived and/or modified sequence opt2 from Cytosine_Deaminase_fcy1__Saccharomyces_cerevisiae__AJW00633

SEQ ID NO: 5605 - RNA, 477 nt, Artificial Sequence; identical to SEQ ID NO: 5389
  derived and/or modified sequence opt3 from Cytosine_Deaminase_fcy1__Saccharomyces_cerevisiae__AJW00633

SEQ ID NO: 5606 - RNA, 477 nt, Artificial Sequence; identical to SEQ ID NO: 5390
  derived and/or modified sequence opt4 from Cytosine_Deaminase_fcy1__Saccharomyces_cerevisiae__AJW00633

SEQ ID NO: 5607 - RNA, 477 nt, Artificial Sequence; identical to SEQ ID NO: 5391
  derived and/or modified sequence opt5 from Cytosine_Deaminase_fcy1__Saccharomyces_cerevisiae__AJW00633

SEQ ID NO: 5608 - RNA, 477 nt, Artificial Sequence
  derived and/or modified sequence opt6 from Cytosine_Deaminase_fcy1__Saccharomyces_cerevisiae__AJW00633
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacacuacacggagaaauaaguacacuagaaaacuguggaagacuagaaggaaaaguauauaaagauacaacauuauauacaacauuaaguccaugugauaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5609 - protein, 158 aa, Artificial Sequence; identical to SEQ ID NO: 5385
  Cytosine_Deaminase_fcy1__Saccharomyces_cerevisiae__A0A0D4XNS1

SEQ ID NO: 5610 - RNA, 477 nt, Artificial Sequence; identical to SEQ ID NO: 5386
  Cytosine_Deaminase_fcy1__Saccharomyces_cerevisiae__AJW01072

SEQ ID NO: 5611 - RNA, 477 nt, Artificial Sequence; identical to SEQ ID NO: 5387
  derived and/or modified sequence opt1 from Cytosine_Deaminase_fcy1__Saccharomyces_cerevisiae__AJW01072

SEQ ID NO: 5612 - RNA, 477 nt, Artificial Sequence; identical to SEQ ID NO: 5388
  derived and/or modified sequence opt2 from Cytosine_Deaminase_fcy1__Saccharomyces_cerevisiae__AJW01072

SEQ ID NO: 5613 - RNA, 477 nt, Artificial Sequence; identical to SEQ ID NO: 5389
  derived and/or modified sequence opt3 from Cytosine_Deaminase_fcy1__Saccharomyces_cerevisiae__AJW01072

SEQ ID NO: 5614 - RNA, 477 nt, Artificial Sequence; identical to SEQ ID NO: 5390
  derived and/or modified sequence opt4 from Cytosine_Deaminase_fcy1__Saccharomyces_cerevisiae__AJW01072

SEQ ID NO: 5615 - RNA, 477 nt, Artificial Sequence; identical to SEQ ID NO: 5391
  derived and/or modified sequence opt5 from Cytosine_Deaminase_fcy1__Saccharomyces_cerevisiae__AJW01072

SEQ ID NO: 5616 - RNA, 477 nt, Artificial Sequence
  derived and/or modified sequence opt6 from Cytosine_Deaminase_fcy1__Saccharomyces_cerevisiae__AJW01072
augguaacaggaggaauggcaagcaaaugggaucaaaaaggaauggauauagcauaugaagaagcagcauuaggauauaaagaaggaggaguaccaauaggaggauguuuaauaaauaauaaagauggaaguguauuaggaagagggcauaauaugagauuucaaaaaggaagugcaacauuacauggagaaauaaguacauuagaaaauuguggaagguuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauauuuacaaacaaggggacaugaaguaguaguaguagaugaugaaagauguaaaaaaauaaugaaacaauuuauagaugaaagaccacaagauugguuugaagauauaggagaauaa

SEQ ID NO: 5617 - protein, 158 aa, Artificial Sequence; identical to SEQ ID NO: 5385
  Cytosine_Deaminase_fcy1__Saccharomyces_cerevisiae__A0A0D4XQY5

SEQ ID NO: 5618 - RNA, 477 nt, Artificial Sequence; identical to SEQ ID NO: 5386
  Cytosine_Deaminase_fcy1__Saccharomyces_cerevisiae__AJW01508

SEQ ID NO: 5619 - RNA, 477 nt, Artificial Sequence; identical to SEQ ID NO: 5387
  derived and/or modified sequence opt1 from Cytosine_Deaminase_fcy1__Saccharomyces_cerevisiae__AJW01508

SEQ ID NO: 5620 - RNA, 477 nt, Artificial Sequence; identical to SEQ ID NO: 5388
  derived and/or modified sequence opt2 from Cytosine_Deaminase_fcy1__Saccharomyces_cerevisiae__AJW01508

SEQ ID NO: 5621 - RNA, 477 nt, Artificial Sequence; identical to SEQ ID NO: 5389
  derived and/or modified sequence opt3 from Cytosine_Deaminase_fcy1__Saccharomyces_cerevisiae__AJW01508

SEQ ID NO: 5622 - RNA, 477 nt, Artificial Sequence; identical to SEQ ID NO: 5390
  derived and/or modified sequence opt4 from Cytosine_Deaminase_fcy1__Saccharomyces_cerevisiae__AJW01508

SEQ ID NO: 5623 - RNA, 477 nt, Artificial Sequence; identical to SEQ ID NO: 5391
  derived and/or modified sequence opt5 from Cytosine_Deaminase_fcy1__Saccharomyces_cerevisiae__AJW01508

SEQ ID NO: 5624 - RNA, 477 nt, Artificial Sequence
  derived and/or modified sequence opt6 from Cytosine_Deaminase_fcy1__Saccharomyces_cerevisiae__AJW01508
augguaacaggagggauggcaaguaaaugggaucaaaaaggaauggacauagcauaugaagaagcagcauuaggauauaaagaaggaggaguaccaauaggaggaugcuuaauaaauaauaaagacgggaguguauuaggaagaggacauaauaugagauuucaaaaaggaagugcaacauuacacggagaaauaaguacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauacuuacaaacaagaggacaugaaguaguaguaguagaugacgaaagauguaaaaaaauaaugaaacaguuuauagaugaaagaccacaagauugguuugaagauauaggagaauaa

SEQ ID NO: 5625 - protein, 158 aa, Artificial Sequence; identical to SEQ ID NO: 5385
  Cytosine_Deaminase_fcy1__Saccharomyces_cerevisiae__A0A0D4XS80

SEQ ID NO: 5626 - RNA, 477 nt, Artificial Sequence; identical to SEQ ID NO: 5386
  Cytosine_Deaminase_fcy1__Saccharomyces_cerevisiae__AJW02360

SEQ ID NO: 5627 - RNA, 477 nt, Artificial Sequence; identical to SEQ ID NO: 5387
  derived and/or modified sequence opt1 from Cytosine_Deaminase_fcy1__Saccharomyces_cerevisiae__AJW02360

SEQ ID NO: 5628 - RNA, 477 nt, Artificial Sequence; identical to SEQ ID NO: 5388
  derived and/or modified sequence opt2 from Cytosine_Deaminase_fcy1__Saccharomyces_cerevisiae__AJW02360

SEQ ID NO: 5629 - RNA, 477 nt, Artificial Sequence; identical to SEQ ID NO: 5389
  derived and/or modified sequence opt3 from Cytosine_Deaminase_fcy1__Saccharomyces_cerevisiae__AJW02360

SEQ ID NO: 5630 - RNA, 477 nt, Artificial Sequence; identical to SEQ ID NO: 5390
  derived and/or modified sequence opt4 from Cytosine_Deaminase_fcy1__Saccharomyces_cerevisiae__AJW02360

SEQ ID NO: 5631 - RNA, 477 nt, Artificial Sequence; identical to SEQ ID NO: 5391
  derived and/or modified sequence opt5 from Cytosine_Deaminase_fcy1__Saccharomyces_cerevisiae__AJW02360

SEQ ID NO: 5632 - RNA, 477 nt, Artificial Sequence
  derived and/or modified sequence opt6 from Cytosine_Deaminase_fcy1__Saccharomyces_cerevisiae__AJW02360
augguaacaggaggaauggcaaguaaaugggaucaaaaaggaauggacauagcauaugaagaagcagcacuaggauauaaagaaggaggaguaccaauaggaggaugcuuaauaaauaacaaagacggaaguguacuaggaagaggacauaauaugagauuucaaaaaggaagugcaacauuacacggagaaauaagcacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuucaaaagcaaaggagaaaaauauuuacaaacaagaggacaugaaguaguaguaguagaugacgaaagauguaaaaaaauaaugaaacaauuuauagacgaaagaccacaagauugguuugaagauauaggagaauaa

SEQ ID NO: 5633 - protein, 158 aa, Artificial Sequence; identical to SEQ ID NO: 5385
  Cytosine_Deaminase_fcy1__Saccharomyces_cerevisiae__A0A0D4XS82

SEQ ID NO: 5634 - RNA, 477 nt, Artificial Sequence; identical to SEQ ID NO: 5386
  Cytosine_Deaminase_fcy1__Saccharomyces_cerevisiae__AJW01943

SEQ ID NO: 5635 - RNA, 477 nt, Artificial Sequence; identical to SEQ ID NO: 5387
  derived and/or modified sequence opt1 from Cytosine_Deaminase_fcy1__Saccharomyces_cerevisiae__AJW01943

SEQ ID NO: 5636 - RNA, 477 nt, Artificial Sequence; identical to SEQ ID NO: 5388
  derived and/or modified sequence opt2 from Cytosine_Deaminase_fcy1__Saccharomyces_cerevisiae__AJW01943

SEQ ID NO: 5637 - RNA, 477 nt, Artificial Sequence; identical to SEQ ID NO: 5389
  derived and/or modified sequence opt3 from Cytosine_Deaminase_fcy1__Saccharomyces_cerevisiae__AJW01943

SEQ ID NO: 5638 - RNA, 477 nt, Artificial Sequence; identical to SEQ ID NO: 5390
  derived and/or modified sequence opt4 from Cytosine_Deaminase_fcy1__Saccharomyces_cerevisiae__AJW01943

SEQ ID NO: 5639 - RNA, 477 nt, Artificial Sequence; identical to SEQ ID NO: 5391
  derived and/or modified sequence opt5 from Cytosine_Deaminase_fcy1__Saccharomyces_cerevisiae__AJW01943

SEQ ID NO: 5640 - RNA, 477 nt, Artificial Sequence
  derived and/or modified sequence opt6 from Cytosine_Deaminase_fcy1__Saccharomyces_cerevisiae__AJW01943
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguguugggaagaggacauaauaugagauuucaaaaaggaagugcaacauuacauggagaaauaaguacauuagaaaauuguggaagauuagaaggaaaaguauauaaagauacaacauuauauacaacauuaaguccaugugauauguguacaggagcaauaauaauguauggaauaccaagauguguaguaggagaaaauguaaauuuuaaaagcaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5641 - protein, 158 aa, Artificial Sequence; identical to SEQ ID NO: 5385
  Cytosine_Deaminase_fcy1__Saccharomyces_cerevisiae__A0A0D4XTC2

SEQ ID NO: 5642 - RNA, 477 nt, Artificial Sequence; identical to SEQ ID NO: 5386
  Cytosine_Deaminase_fcy1__Saccharomyces_cerevisiae__AJW02785

SEQ ID NO: 5643 - RNA, 477 nt, Artificial Sequence; identical to SEQ ID NO: 5387
  derived and/or modified sequence opt1 from Cytosine_Deaminase_fcy1__Saccharomyces_cerevisiae__AJW02785

SEQ ID NO: 5644 - RNA, 477 nt, Artificial Sequence; identical to SEQ ID NO: 5388
  derived and/or modified sequence opt2 from Cytosine_Deaminase_fcy1__Saccharomyces_cerevisiae__AJW02785

SEQ ID NO: 5645 - RNA, 477 nt, Artificial Sequence; identical to SEQ ID NO: 5389
  derived and/or modified sequence opt3 from Cytosine_Deaminase_fcy1__Saccharomyces_cerevisiae__AJW02785

SEQ ID NO: 5646 - RNA, 477 nt, Artificial Sequence; identical to SEQ ID NO: 5390
  derived and/or modified sequence opt4 from Cytosine_Deaminase_fcy1__Saccharomyces_cerevisiae__AJW02785

SEQ ID NO: 5647 - RNA, 477 nt, Artificial Sequence; identical to SEQ ID NO: 5391
  derived and/or modified sequence opt5 from Cytosine_Deaminase_fcy1__Saccharomyces_cerevisiae__AJW02785

SEQ ID NO: 5648 - RNA, 477 nt, Artificial Sequence
  derived and/or modified sequence opt6 from Cytosine_Deaminase_fcy1__Saccharomyces_cerevisiae__AJW02785
augguaacaggaggaauggcaaguaaaugggaucaaaaaggaauggauauagcauaugaagaagcagcauuaggauauaaagaaggaggaguaccaauaggaggauguuuaauaaauaauaaagaugggaguguauuaggaagaggacacaauaugagauuucaaaaaggaagugcaacguuacauggagaaauaaguacauuagaaaauuguggaagauuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5649 - protein, 158 aa, Artificial Sequence; identical to SEQ ID NO: 5385
  Cytosine_Deaminase_fcy1__Saccharomyces_cerevisiae__A0A0D4XUZ4

SEQ ID NO: 5650 - RNA, 477 nt, Artificial Sequence; identical to SEQ ID NO: 5418
  Cytosine_Deaminase_fcy1__Saccharomyces_cerevisiae__AJW03227

SEQ ID NO: 5651 - RNA, 477 nt, Artificial Sequence; identical to SEQ ID NO: 5387
  derived and/or modified sequence opt1 from Cytosine_Deaminase_fcy1__Saccharomyces_cerevisiae__AJW03227

SEQ ID NO: 5652 - RNA, 477 nt, Artificial Sequence; identical to SEQ ID NO: 5388
  derived and/or modified sequence opt2 from Cytosine_Deaminase_fcy1__Saccharomyces_cerevisiae__AJW03227

SEQ ID NO: 5653 - RNA, 477 nt, Artificial Sequence; identical to SEQ ID NO: 5389
  derived and/or modified sequence opt3 from Cytosine_Deaminase_fcy1__Saccharomyces_cerevisiae__AJW03227

SEQ ID NO: 5654 - RNA, 477 nt, Artificial Sequence; identical to SEQ ID NO: 5390
  derived and/or modified sequence opt4 from Cytosine_Deaminase_fcy1__Saccharomyces_cerevisiae__AJW03227

SEQ ID NO: 5655 - RNA, 477 nt, Artificial Sequence; identical to SEQ ID NO: 5391
  derived and/or modified sequence opt5 from Cytosine_Deaminase_fcy1__Saccharomyces_cerevisiae__AJW03227

SEQ ID NO: 5656 - RNA, 477 nt, Artificial Sequence
  derived and/or modified sequence opt6 from Cytosine_Deaminase_fcy1__Saccharomyces_cerevisiae__AJW03227
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguauuaggaaggggacauaauaugagauuucaaaaaggaagugcaacauugcauggagaaauaaguacauuagaaaauuguggaagauuagaaggaaaaguauauaaagauacaacauuauauacaacauuaaguccaugugauaugugcacaggagcaauaauaauguauggaauaccaagauguguaguaggagaaaauguaaauuuuaaaaguaaaggagaaaaauauuuacaaacaagaggacaugaaguaguagugguagaugaugaaagauguaaaaaaauaaugaaacaauuuauagaugaaagaccacaagauugguuugaagauauaggagaauaa

SEQ ID NO: 5657 - protein, 158 aa, Artificial Sequence; identical to SEQ ID NO: 5385
  Cytosine_Deaminase_fcy1__Saccharomyces_cerevisiae__A0A0D4XW26

SEQ ID NO: 5658 - RNA, 477 nt, Artificial Sequence; identical to SEQ ID NO: 5498
  Cytosine_Deaminase_fcy1__Saccharomyces_cerevisiae__AJW03664

SEQ ID NO: 5659 - RNA, 477 nt, Artificial Sequence; identical to SEQ ID NO: 5387
  derived and/or modified sequence opt1 from Cytosine_Deaminase_fcy1__Saccharomyces_cerevisiae__AJW03664

SEQ ID NO: 5660 - RNA, 477 nt, Artificial Sequence; identical to SEQ ID NO: 5388
  derived and/or modified sequence opt2 from Cytosine_Deaminase_fcy1__Saccharomyces_cerevisiae__AJW03664

SEQ ID NO: 5661 - RNA, 477 nt, Artificial Sequence; identical to SEQ ID NO: 5389
  derived and/or modified sequence opt3 from Cytosine_Deaminase_fcy1__Saccharomyces_cerevisiae__AJW03664

SEQ ID NO: 5662 - RNA, 477 nt, Artificial Sequence; identical to SEQ ID NO: 5390
  derived and/or modified sequence opt4 from Cytosine_Deaminase_fcy1__Saccharomyces_cerevisiae__AJW03664

SEQ ID NO: 5663 - RNA, 477 nt, Artificial Sequence; identical to SEQ ID NO: 5391
  derived and/or modified sequence opt5 from Cytosine_Deaminase_fcy1__Saccharomyces_cerevisiae__AJW03664

SEQ ID NO: 5664 - RNA, 477 nt, Artificial Sequence
  derived and/or modified sequence opt6 from Cytosine_Deaminase_fcy1__Saccharomyces_cerevisiae__AJW03664
augguaacaggaggaauggcaaguaaaugggaucaaaaaggaauggacauagcauaugaagaagcagcacuaggauauaaagaaggaggaguaccaauaggaggaugcuuaauaaauaauaaagacggaaguguauuaggaagaggacauaauaugagauuucaaaaaggaagugcaacacuacauggagaaauaaguacacuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5665 - protein, 158 aa, Artificial Sequence; identical to SEQ ID NO: 5385
  Cytosine_Deaminase_fcy1__Saccharomyces_cerevisiae__A0A0D4XXD1

SEQ ID NO: 5666 - RNA, 477 nt, Artificial Sequence
  Cytosine_Deaminase_fcy1__Saccharomyces_cerevisiae__AJW04100
auggugacagggggaauggcaagcaagugggaucagaaggguauggacauugccuaugaggaggcggccuuagguuacaaagagggugguguuccuauuggcggaugucuuaucaauaacaaagacggaaguguucucggucguggucacaacaugagauuucaaaagggauccgccacacuacauggugagaucuccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauuuaucgaugaaagaccccaggauugguuugaagauauuggugaguag

SEQ ID NO: 5667 - RNA, 477 nt, Artificial Sequence; identical to SEQ ID NO: 5387
  derived and/or modified sequence opt1 from Cytosine_Deaminase_fcy1__Saccharomyces_cerevisiae__AJW04100

SEQ ID NO: 5668 - RNA, 477 nt, Artificial Sequence; identical to SEQ ID NO: 5388
  derived and/or modified sequence opt2 from Cytosine_Deaminase_fcy1__Saccharomyces_cerevisiae__AJW04100

SEQ ID NO: 5669 - RNA, 477 nt, Artificial Sequence; identical to SEQ ID NO: 5389
  derived and/or modified sequence opt3 from Cytosine_Deaminase_fcy1__Saccharomyces_cerevisiae__AJW04100

SEQ ID NO: 5670 - RNA, 477 nt, Artificial Sequence; identical to SEQ ID NO: 5390
  derived and/or modified sequence opt4 from Cytosine_Deaminase_fcy1__Saccharomyces_cerevisiae__AJW04100

SEQ ID NO: 5671 - RNA, 477 nt, Artificial Sequence; identical to SEQ ID NO: 5391
  derived and/or modified sequence opt5 from Cytosine_Deaminase_fcy1__Saccharomyces_cerevisiae__AJW04100

SEQ ID NO: 5672 - RNA, 477 nt, Artificial Sequence
  derived and/or modified sequence opt6 from Cytosine_Deaminase_fcy1__Saccharomyces_cerevisiae__AJW04100
augguaacaggaggaauggcaaguaaaugggaucaaaagggaauggacauagcauaugaagaagcagcauuaggauauaaagaaggaggaguaccaauaggaggaugcuuaauaaauaauaaagacggaagcguauuaggaagaggacauaauaugagauuucaaaaaggaagugcaacauuacauggagaaauaaguacacuagaaaacuguggaagauuagaaggaaaaguauauaaagauacaacauuauauacaacauuaaguccaugugacaugugcacaggagcaauaauaauguauggaauaccaagauguguaguaggagaaaauguaaauuuuaaaagcaaaggagaaaaauauuuacaaacaagaggacaugaaguaguaguaguagaugacgaaagauguaaaaaaauaaugaaacaauuuauagaugaaagaccacaagauugguucgaagauauaggagaauaa

SEQ ID NO: 5673 - protein, 158 aa, Artificial Sequence; identical to SEQ ID NO: 5385
  Cytosine_Deaminase_fcy1__Saccharomyces_cerevisiae__A0A0D4XYH3

SEQ ID NO: 5674 - RNA, 477 nt, Artificial Sequence; identical to SEQ ID NO: 5418
  Cytosine_Deaminase_fcy1__Saccharomyces_cerevisiae__AJW04531

SEQ ID NO: 5675 - RNA, 477 nt, Artificial Sequence; identical to SEQ ID NO: 5387
  derived and/or modified sequence opt1 from Cytosine_Deaminase_fcy1__Saccharomyces_cerevisiae__AJW04531

SEQ ID NO: 5676 - RNA, 477 nt, Artificial Sequence; identical to SEQ ID NO: 5388
  derived and/or modified sequence opt2 from Cytosine_Deaminase_fcy1__Saccharomyces_cerevisiae__AJW04531

SEQ ID NO: 5677 - RNA, 477 nt, Artificial Sequence; identical to SEQ ID NO: 5389
  derived and/or modified sequence opt3 from Cytosine_Deaminase_fcy1__Saccharomyces_cerevisiae__AJW04531

SEQ ID NO: 5678 - RNA, 477 nt, Artificial Sequence; identical to SEQ ID NO: 5390
  derived and/or modified sequence opt4 from Cytosine_Deaminase_fcy1__Saccharomyces_cerevisiae__AJW04531

SEQ ID NO: 5679 - RNA, 477 nt, Artificial Sequence; identical to SEQ ID NO: 5391
  derived and/or modified sequence opt5 from Cytosine_Deaminase_fcy1__Saccharomyces_cerevisiae__AJW04531

SEQ ID NO: 5680 - RNA, 477 nt, Artificial Sequence
  derived and/or modified sequence opt6 from Cytosine_Deaminase_fcy1__Saccharomyces_cerevisiae__AJW04531
augguaacaggaggaauggcaaguaaaugggaucaaaaaggaauggauauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaauuguggaagauuagaaggaaaaguauauaaagauacaacauuauauacaacauuaaguccaugugacaugugcacaggagcaauaauaauguauggaauaccaagauguguaguaggagaaaauguaaauuuuaaaagcaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5681 - protein, 158 aa, Artificial Sequence; identical to SEQ ID NO: 5385
  Cytosine_Deaminase_fcy1__Saccharomyces_cerevisiae__A0A0D4XZT0

SEQ ID NO: 5682 - RNA, 477 nt, Artificial Sequence; identical to SEQ ID NO: 5418
  Cytosine_Deaminase_fcy1__Saccharomyces_cerevisiae__AJW04966

SEQ ID NO: 5683 - RNA, 477 nt, Artificial Sequence; identical to SEQ ID NO: 5387
  derived and/or modified sequence opt1 from Cytosine_Deaminase_fcy1__Saccharomyces_cerevisiae__AJW04966

SEQ ID NO: 5684 - RNA, 477 nt, Artificial Sequence; identical to SEQ ID NO: 5388
  derived and/or modified sequence opt2 from Cytosine_Deaminase_fcy1__Saccharomyces_cerevisiae__AJW04966

SEQ ID NO: 5685 - RNA, 477 nt, Artificial Sequence; identical to SEQ ID NO: 5389
  derived and/or modified sequence opt3 from Cytosine_Deaminase_fcy1__Saccharomyces_cerevisiae__AJW04966

SEQ ID NO: 5686 - RNA, 477 nt, Artificial Sequence; identical to SEQ ID NO: 5390
  derived and/or modified sequence opt4 from Cytosine_Deaminase_fcy1__Saccharomyces_cerevisiae__AJW04966

SEQ ID NO: 5687 - RNA, 477 nt, Artificial Sequence; identical to SEQ ID NO: 5391
  derived and/or modified sequence opt5 from Cytosine_Deaminase_fcy1__Saccharomyces_cerevisiae__AJW04966

SEQ ID NO: 5688 - RNA, 477 nt, Artificial Sequence
  derived and/or modified sequence opt6 from Cytosine_Deaminase_fcy1__Saccharomyces_cerevisiae__AJW04966
augguaacaggaggaauggcaaguaaaugggaucaaaaaggaauggacauagcauaugaagaagcagcauuaggauauaaagaaggaggaguaccaauaggaggaugucuaauaaauaauaaagacggaaguguauuaggaagaggacauaauaugagauuucaaaaaggaagugcgacauuacacggagaaauaaguacacuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaagcaaaggagaaaaauaucuacaaacaagaggacaugaaguaguaguaguagaugacgaaagauguaaaaaaauaaugaaacaauuuauagaugaaagaccacaagauugguuugaagauauaggagaauaa

SEQ ID NO: 5689 - protein, 158 aa, Artificial Sequence; identical to SEQ ID NO: 5385
  Cytosine_Deaminase_fcy1__Saccharomyces_cerevisiae__A0A0D4Y164

SEQ ID NO: 5690 - RNA, 477 nt, Artificial Sequence; identical to SEQ ID NO: 5386
  Cytosine_Deaminase_fcy1__Saccharomyces_cerevisiae__AJW05404

SEQ ID NO: 5691 - RNA, 477 nt, Artificial Sequence; identical to SEQ ID NO: 5387
  derived and/or modified sequence opt1 from Cytosine_Deaminase_fcy1__Saccharomyces_cerevisiae__AJW05404

SEQ ID NO: 5692 - RNA, 477 nt, Artificial Sequence; identical to SEQ ID NO: 5388
  derived and/or modified sequence opt2 from Cytosine_Deaminase_fcy1__Saccharomyces_cerevisiae__AJW05404

SEQ ID NO: 5693 - RNA, 477 nt, Artificial Sequence; identical to SEQ ID NO: 5389
  derived and/or modified sequence opt3 from Cytosine_Deaminase_fcy1__Saccharomyces_cerevisiae__AJW05404

SEQ ID NO: 5694 - RNA, 477 nt, Artificial Sequence; identical to SEQ ID NO: 5390
  derived and/or modified sequence opt4 from Cytosine_Deaminase_fcy1__Saccharomyces_cerevisiae__AJW05404

SEQ ID NO: 5695 - RNA, 477 nt, Artificial Sequence; identical to SEQ ID NO: 5391
  derived and/or modified sequence opt5 from Cytosine_Deaminase_fcy1__Saccharomyces_cerevisiae__AJW05404

SEQ ID NO: 5696 - RNA, 477 nt, Artificial Sequence
  derived and/or modified sequence opt6 from Cytosine_Deaminase_fcy1__Saccharomyces_cerevisiae__AJW05404
augguaacaggaggaauggcaaguaaaugggaucaaaaagggauggauauagcauaugaagaagcagcauuaggauauaaagaaggaggaguaccaauaggaggauguuuaauaaauaauaaagauggaaguguauuaggaagaggacauaauaugagauuucaaaaaggaagugcaacauuacauggagaaauaaguacauuagaaaauuguggaagauuagaaggaaaaguauauaaagauacaacacuauauacaacauuaaguccaugugauauguguacaggagcaauaauaauguauggaauaccaagauguguaguaggagaaaauguaaauuuuaaaaguaaaggagaaaaauauuuacaaacaaggggacaugaaguaguaguaguagaugaugaaagauguaaaaaaauaaugaaacaauuuauagaugaaagaccacaagauugguuugaagauauaggagaauga

SEQ ID NO: 5697 - protein, 158 aa, Artificial Sequence; identical to SEQ ID NO: 5385
  Cytosine_Deaminase_fcy1__Saccharomyces_cerevisiae__A0A0D4Y2A8

SEQ ID NO: 5698 - RNA, 477 nt, Artificial Sequence; identical to SEQ ID NO: 5386
  Cytosine_Deaminase_fcy1__Saccharomyces_cerevisiae__AJW05846

SEQ ID NO: 5699 - RNA, 477 nt, Artificial Sequence; identical to SEQ ID NO: 5387
  derived and/or modified sequence opt1 from Cytosine_Deaminase_fcy1__Saccharomyces_cerevisiae__AJW05846

SEQ ID NO: 5700 - RNA, 477 nt, Artificial Sequence; identical to SEQ ID NO: 5388
  derived and/or modified sequence opt2 from Cytosine_Deaminase_fcy1__Saccharomyces_cerevisiae__AJW05846

SEQ ID NO: 5701 - RNA, 477 nt, Artificial Sequence; identical to SEQ ID NO: 5389
  derived and/or modified sequence opt3 from Cytosine_Deaminase_fcy1__Saccharomyces_cerevisiae__AJW05846

SEQ ID NO: 5702 - RNA, 477 nt, Artificial Sequence; identical to SEQ ID NO: 5390
  derived and/or modified sequence opt4 from Cytosine_Deaminase_fcy1__Saccharomyces_cerevisiae__AJW05846

SEQ ID NO: 5703 - RNA, 477 nt, Artificial Sequence; identical to SEQ ID NO: 5391
  derived and/or modified sequence opt5 from Cytosine_Deaminase_fcy1__Saccharomyces_cerevisiae__AJW05846

SEQ ID NO: 5704 - RNA, 477 nt, Artificial Sequence
  derived and/or modified sequence opt6 from Cytosine_Deaminase_fcy1__Saccharomyces_cerevisiae__AJW05846
augguaacaggaggaauggcaaguaaaugggaucaaaaaggaauggauauagcauaugaagaagcagcauuaggauauaaagaaggaggaguaccaauaggaggaugcuuaauaaauaauaaagauggaaguguauuaggaagaggacauaauaugagauuucaaaaaggaagugcaacauugcacggagaaauaagcacauuagaaaacuguggaagacuagaaggaaaaguauauaaagauacaacauuauauacaacauuaaguccaugugacauguguacaggagcaauaauaauguauggaauaccaagauguguaguaggagaaaauguaaauuuuaaaagcaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5705 - protein, 158 aa, Artificial Sequence; identical to SEQ ID NO: 5385
  Cytosine_Deaminase_fcy1__Saccharomyces_cerevisiae__A0A0D4Y3N1

SEQ ID NO: 5706 - RNA, 477 nt, Artificial Sequence; identical to SEQ ID NO: 5386
  Cytosine_Deaminase_fcy1__Saccharomyces_cerevisiae__AJW06284

SEQ ID NO: 5707 - RNA, 477 nt, Artificial Sequence; identical to SEQ ID NO: 5387
  derived and/or modified sequence opt1 from Cytosine_Deaminase_fcy1__Saccharomyces_cerevisiae__AJW06284

SEQ ID NO: 5708 - RNA, 477 nt, Artificial Sequence; identical to SEQ ID NO: 5388
  derived and/or modified sequence opt2 from Cytosine_Deaminase_fcy1__Saccharomyces_cerevisiae__AJW06284

SEQ ID NO: 5709 - RNA, 477 nt, Artificial Sequence; identical to SEQ ID NO: 5389
  derived and/or modified sequence opt3 from Cytosine_Deaminase_fcy1__Saccharomyces_cerevisiae__AJW06284

SEQ ID NO: 5710 - RNA, 477 nt, Artificial Sequence; identical to SEQ ID NO: 5390
  derived and/or modified sequence opt4 from Cytosine_Deaminase_fcy1__Saccharomyces_cerevisiae__AJW06284

SEQ ID NO: 5711 - RNA, 477 nt, Artificial Sequence; identical to SEQ ID NO: 5391
  derived and/or modified sequence opt5 from Cytosine_Deaminase_fcy1__Saccharomyces_cerevisiae__AJW06284

SEQ ID NO: 5712 - RNA, 477 nt, Artificial Sequence
  derived and/or modified sequence opt6 from Cytosine_Deaminase_fcy1__Saccharomyces_cerevisiae__AJW06284
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguacuaggaagaggacauaauaugagauuucaaaaaggaagugcaacacuacacggagaaauaaguacauuagaaaacuguggaagauuagaaggaaaaguauauaaagauacaacauuauauacaacacuaagcccaugugacaugugcacaggagcaauaauaauguauggaauaccaagauguguaguaggagaaaacguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5713 - protein, 158 aa, Artificial Sequence; identical to SEQ ID NO: 5385
  Cytosine_Deaminase_fcy1__Saccharomyces_cerevisiae__A0A0D4Y5S3

SEQ ID NO: 5714 - RNA, 477 nt, Artificial Sequence
  Cytosine_Deaminase_fcy1__Saccharomyces_cerevisiae__AJW06723
auggugacagggggaauggcaagcaagugggaucagaaggguauggacauugccuaugaggaggcggccuuagguuacaaagagggugguguuccuauuggcggaugucuuaucaauaacaaagacggaaguguucucggucguggucacaacaugagauuucaaaagggauccgccacacuacauggugagaucuccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauucaucgaugaaagaccucaggauugguuugaagauauuggugaguag

SEQ ID NO: 5715 - RNA, 477 nt, Artificial Sequence; identical to SEQ ID NO: 5387
  derived and/or modified sequence opt1 from Cytosine_Deaminase_fcy1__Saccharomyces_cerevisiae__AJW06723

SEQ ID NO: 5716 - RNA, 477 nt, Artificial Sequence; identical to SEQ ID NO: 5388
  derived and/or modified sequence opt2 from Cytosine_Deaminase_fcy1__Saccharomyces_cerevisiae__AJW06723

SEQ ID NO: 5717 - RNA, 477 nt, Artificial Sequence; identical to SEQ ID NO: 5389
  derived and/or modified sequence opt3 from Cytosine_Deaminase_fcy1__Saccharomyces_cerevisiae__AJW06723

SEQ ID NO: 5718 - RNA, 477 nt, Artificial Sequence; identical to SEQ ID NO: 5390
  derived and/or modified sequence opt4 from Cytosine_Deaminase_fcy1__Saccharomyces_cerevisiae__AJW06723

SEQ ID NO: 5719 - RNA, 477 nt, Artificial Sequence; identical to SEQ ID NO: 5391
  derived and/or modified sequence opt5 from Cytosine_Deaminase_fcy1__Saccharomyces_cerevisiae__AJW06723

SEQ ID NO: 5720 - RNA, 477 nt, Artificial Sequence
  derived and/or modified sequence opt6 from Cytosine_Deaminase_fcy1__Saccharomyces_cerevisiae__AJW06723
augguaacaggaggaauggcaagcaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaauuguggaagauuagaaggaaaaguauauaaagauacaacauuauauacaacacuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5721 - protein, 158 aa, Artificial Sequence; identical to SEQ ID NO: 5385
  Cytosine_Deaminase_fcy1__Saccharomyces_cerevisiae__A0A0D4Y5Y1

SEQ ID NO: 5722 - RNA, 477 nt, Artificial Sequence; identical to SEQ ID NO: 5386
  Cytosine_Deaminase_fcy1__Saccharomyces_cerevisiae__AJW07156

SEQ ID NO: 5723 - RNA, 477 nt, Artificial Sequence; identical to SEQ ID NO: 5387
  derived and/or modified sequence opt1 from Cytosine_Deaminase_fcy1__Saccharomyces_cerevisiae__AJW07156

SEQ ID NO: 5724 - RNA, 477 nt, Artificial Sequence; identical to SEQ ID NO: 5388
  derived and/or modified sequence opt2 from Cytosine_Deaminase_fcy1__Saccharomyces_cerevisiae__AJW07156

SEQ ID NO: 5725 - RNA, 477 nt, Artificial Sequence; identical to SEQ ID NO: 5389
  derived and/or modified sequence opt3 from Cytosine_Deaminase_fcy1__Saccharomyces_cerevisiae__AJW07156

SEQ ID NO: 5726 - RNA, 477 nt, Artificial Sequence; identical to SEQ ID NO: 5390
  derived and/or modified sequence opt4 from Cytosine_Deaminase_fcy1__Saccharomyces_cerevisiae__AJW07156

SEQ ID NO: 5727 - RNA, 477 nt, Artificial Sequence; identical to SEQ ID NO: 5391
  derived and/or modified sequence opt5 from Cytosine_Deaminase_fcy1__Saccharomyces_cerevisiae__AJW07156

SEQ ID NO: 5728 - RNA, 477 nt, Artificial Sequence
  derived and/or modified sequence opt6 from Cytosine_Deaminase_fcy1__Saccharomyces_cerevisiae__AJW07156
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuccaaaaaggaagugcaacacuacauggagaaauaaguacauuagaaaacuguggaagacuagaaggaaaaguauauaaagauacaacacuauauacaacauuaaguccaugugacaugugcacaggagcaauaauaauguauggaauaccaagauguguaguaggagaaaauguaaauuuuaaaaguaaaggagaaaaauaucuacaaacaagaggacaugaaguaguaguaguagaugacgaaagauguaaaaaaauaaugaaacaauucauagaugaaagaccacaagauugguuugaagauauaggagaauaa

SEQ ID NO: 5729 - protein, 158 aa, Artificial Sequence; identical to SEQ ID NO: 5385
  Cytosine_Deaminase_fcy1__Saccharomyces_cerevisiae__A0A0D4Y7I2

SEQ ID NO: 5730 - RNA, 477 nt, Artificial Sequence; identical to SEQ ID NO: 5714
  Cytosine_Deaminase_fcy1__Saccharomyces_cerevisiae__AJW07594

SEQ ID NO: 5731 - RNA, 477 nt, Artificial Sequence; identical to SEQ ID NO: 5387
  derived and/or modified sequence opt1 from Cytosine_Deaminase_fcy1__Saccharomyces_cerevisiae__AJW07594

SEQ ID NO: 5732 - RNA, 477 nt, Artificial Sequence; identical to SEQ ID NO: 5388
  derived and/or modified sequence opt2 from Cytosine_Deaminase_fcy1__Saccharomyces_cerevisiae__AJW07594

SEQ ID NO: 5733 - RNA, 477 nt, Artificial Sequence; identical to SEQ ID NO: 5389
  derived and/or modified sequence opt3 from Cytosine_Deaminase_fcy1__Saccharomyces_cerevisiae__AJW07594

SEQ ID NO: 5734 - RNA, 477 nt, Artificial Sequence; identical to SEQ ID NO: 5390
  derived and/or modified sequence opt4 from Cytosine_Deaminase_fcy1__Saccharomyces_cerevisiae__AJW07594

SEQ ID NO: 5735 - RNA, 477 nt, Artificial Sequence; identical to SEQ ID NO: 5391
  derived and/or modified sequence opt5 from Cytosine_Deaminase_fcy1__Saccharomyces_cerevisiae__AJW07594

SEQ ID NO: 5736 - RNA, 477 nt, Artificial Sequence
  derived and/or modified sequence opt6 from Cytosine_Deaminase_fcy1__Saccharomyces_cerevisiae__AJW07594
augguaacaggaggaauggcaaguaaaugggaucaaaaaggaauggacauagcauaugaagaagcagcguuaggauauaaagaagggggaguaccaauaggaggauguuuaauaaauaauaaagacggaaguguauuaggaagaggacauaauaugagauuucaaaaaggaagugcaacauuacacggagaaauaaguacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuucaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5737 - protein, 158 aa, Artificial Sequence; identical to SEQ ID NO: 5385
  Cytosine_Deaminase_fcy1__Saccharomyces_cerevisiae__A0A0D4Y8S5

SEQ ID NO: 5738 - RNA, 477 nt, Artificial Sequence; identical to SEQ ID NO: 5386
  Cytosine_Deaminase_fcy1__Saccharomyces_cerevisiae__AJW08024

SEQ ID NO: 5739 - RNA, 477 nt, Artificial Sequence; identical to SEQ ID NO: 5387
  derived and/or modified sequence opt1 from Cytosine_Deaminase_fcy1__Saccharomyces_cerevisiae__AJW08024

SEQ ID NO: 5740 - RNA, 477 nt, Artificial Sequence; identical to SEQ ID NO: 5388
  derived and/or modified sequence opt2 from Cytosine_Deaminase_fcy1__Saccharomyces_cerevisiae__AJW08024

SEQ ID NO: 5741 - RNA, 477 nt, Artificial Sequence; identical to SEQ ID NO: 5389
  derived and/or modified sequence opt3 from Cytosine_Deaminase_fcy1__Saccharomyces_cerevisiae__AJW08024

SEQ ID NO: 5742 - RNA, 477 nt, Artificial Sequence; identical to SEQ ID NO: 5390
  derived and/or modified sequence opt4 from Cytosine_Deaminase_fcy1__Saccharomyces_cerevisiae__AJW08024

SEQ ID NO: 5743 - RNA, 477 nt, Artificial Sequence; identical to SEQ ID NO: 5391
  derived and/or modified sequence opt5 from Cytosine_Deaminase_fcy1__Saccharomyces_cerevisiae__AJW08024

SEQ ID NO: 5744 - RNA, 477 nt, Artificial Sequence
  derived and/or modified sequence opt6 from Cytosine_Deaminase_fcy1__Saccharomyces_cerevisiae__AJW08024
augguaacaggaggaauggcaaguaaaugggaucaaaaaggaauggauauagcauaugaagaagcagcauuaggauauaaagaaggaggaguaccaauaggaggaugcuuaauaaauaauaaagauggaaguguauuaggaagaggacauaauaugagauuucaaaaaggaagugcaacacuacauggggaaauaaguacauuagaaaauuguggaagauuagaaggaaaaguauauaaagauacaacauuauauacaacauuaagcccaugugacauguguacaggagcaauaauaauguauggaauaccaagauguguaguaggagaaaauguaaauuuuaaaagcaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5745 - protein, 158 aa, Artificial Sequence; identical to SEQ ID NO: 5385
  Cytosine_Deaminase_fcy1__Saccharomyces_cerevisiae__A0A0D4YAR2

SEQ ID NO: 5746 - RNA, 477 nt, Artificial Sequence
  Cytosine_Deaminase_fcy1__Saccharomyces_cerevisiae__AJW08463
auggugacagggggaauggcaagcaagugggaucagaaggguauggacauugccuaugaggaggcggccuuagguuacaaagagggugguguuccuauuggcggaugucuuaucaauaacaaggacggaaguguucucggucguggucacaacaugagauuucaaaagggauccgccacacuacauggugagaucuccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauuuaucgaugaaagaccucaggauugguuugaagauauuggugaguag

SEQ ID NO: 5747 - RNA, 477 nt, Artificial Sequence; identical to SEQ ID NO: 5387
  derived and/or modified sequence opt1 from Cytosine_Deaminase_fcy1__Saccharomyces_cerevisiae__AJW08463

SEQ ID NO: 5748 - RNA, 477 nt, Artificial Sequence; identical to SEQ ID NO: 5388
  derived and/or modified sequence opt2 from Cytosine_Deaminase_fcy1__Saccharomyces_cerevisiae__AJW08463

SEQ ID NO: 5749 - RNA, 477 nt, Artificial Sequence; identical to SEQ ID NO: 5389
  derived and/or modified sequence opt3 from Cytosine_Deaminase_fcy1__Saccharomyces_cerevisiae__AJW08463

SEQ ID NO: 5750 - RNA, 477 nt, Artificial Sequence; identical to SEQ ID NO: 5390
  derived and/or modified sequence opt4 from Cytosine_Deaminase_fcy1__Saccharomyces_cerevisiae__AJW08463

SEQ ID NO: 5751 - RNA, 477 nt, Artificial Sequence; identical to SEQ ID NO: 5391
  derived and/or modified sequence opt5 from Cytosine_Deaminase_fcy1__Saccharomyces_cerevisiae__AJW08463

SEQ ID NO: 5752 - RNA, 477 nt, Artificial Sequence
  derived and/or modified sequence opt6 from Cytosine_Deaminase_fcy1__Saccharomyces_cerevisiae__AJW08463
augguaacaggaggaauggcaaguaaaugggaucaaaaaggaauggacauagcauaugaagaagcagcauuaggauauaaagaaggaggaguaccaauaggaggauguuuaauaaauaauaaagacggaaguguauuaggaagaggacauaauaugagauuucaaaaaggaagugcgacauuacauggagaaauaaguacauuagaaaacuguggaagacuagaaggaaaaguauauaaagauacaacacuauauacaacacuaaguccaugugauaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccgcaagauugguuugaagauauaggagaauaa

SEQ ID NO: 5753 - protein, 158 aa, Artificial Sequence; identical to SEQ ID NO: 5385
  Cytosine_Deaminase_fcy1__Saccharomyces_cerevisiae__A0A0D4YBY2

SEQ ID NO: 5754 - RNA, 477 nt, Artificial Sequence; identical to SEQ ID NO: 5386
  Cytosine_Deaminase_fcy1__Saccharomyces_cerevisiae__AJW08888

SEQ ID NO: 5755 - RNA, 477 nt, Artificial Sequence; identical to SEQ ID NO: 5387
  derived and/or modified sequence opt1 from Cytosine_Deaminase_fcy1__Saccharomyces_cerevisiae__AJW08888

SEQ ID NO: 5756 - RNA, 477 nt, Artificial Sequence; identical to SEQ ID NO: 5388
  derived and/or modified sequence opt2 from Cytosine_Deaminase_fcy1__Saccharomyces_cerevisiae__AJW08888

SEQ ID NO: 5757 - RNA, 477 nt, Artificial Sequence; identical to SEQ ID NO: 5389
  derived and/or modified sequence opt3 from Cytosine_Deaminase_fcy1__Saccharomyces_cerevisiae__AJW08888

SEQ ID NO: 5758 - RNA, 477 nt, Artificial Sequence; identical to SEQ ID NO: 5390
  derived and/or modified sequence opt4 from Cytosine_Deaminase_fcy1__Saccharomyces_cerevisiae__AJW08888

SEQ ID NO: 5759 - RNA, 477 nt, Artificial Sequence; identical to SEQ ID NO: 5391
  derived and/or modified sequence opt5 from Cytosine_Deaminase_fcy1__Saccharomyces_cerevisiae__AJW08888

SEQ ID NO: 5760 - RNA, 477 nt, Artificial Sequence
  derived and/or modified sequence opt6 from Cytosine_Deaminase_fcy1__Saccharomyces_cerevisiae__AJW08888
augguaacaggaggaauggcaaguaaaugggaucaaaaaggaauggauauagcauaugaagaagcagcauuaggauauaaagaaggaggaguaccaauaggaggaugucuaauaaauaauaaagauggaaguguauuaggaagaggacauaauaugagauuucaaaaaggaagcgcaacauuacauggagaaauaaguacauuagaaaauuguggaagauuagaaggaaaaguauauaaagauacgacacuauauacaacauuaaguccaugugauauguguacaggagcaauaauaauguauggaauaccaagauguguaguaggagaaaauguaaauuuuaaaaguaaaggagaaaaauaucuacaaacaagaggacaugaaguaguaguaguagaugaugaaagauguaaaaaaauaaugaaacaauuuauagaugaaagaccacaagauugguuugaagauauaggagaauag

SEQ ID NO: 5761 - protein, 158 aa, Artificial Sequence; identical to SEQ ID NO: 5385
  Cytosine_Deaminase_fcy1__Saccharomyces_cerevisiae__A0A0D4YCB3

SEQ ID NO: 5762 - RNA, 477 nt, Artificial Sequence; identical to SEQ ID NO: 5386
  Cytosine_Deaminase_fcy1__Saccharomyces_cerevisiae__AJW09327

SEQ ID NO: 5763 - RNA, 477 nt, Artificial Sequence; identical to SEQ ID NO: 5387
  derived and/or modified sequence opt1 from Cytosine_Deaminase_fcy1__Saccharomyces_cerevisiae__AJW09327

SEQ ID NO: 5764 - RNA, 477 nt, Artificial Sequence; identical to SEQ ID NO: 5388
  derived and/or modified sequence opt2 from Cytosine_Deaminase_fcy1__Saccharomyces_cerevisiae__AJW09327

SEQ ID NO: 5765 - RNA, 477 nt, Artificial Sequence; identical to SEQ ID NO: 5389
  derived and/or modified sequence opt3 from Cytosine_Deaminase_fcy1__Saccharomyces_cerevisiae__AJW09327

SEQ ID NO: 5766 - RNA, 477 nt, Artificial Sequence; identical to SEQ ID NO: 5390
  derived and/or modified sequence opt4 from Cytosine_Deaminase_fcy1__Saccharomyces_cerevisiae__AJW09327

SEQ ID NO: 5767 - RNA, 477 nt, Artificial Sequence; identical to SEQ ID NO: 5391
  derived and/or modified sequence opt5 from Cytosine_Deaminase_fcy1__Saccharomyces_cerevisiae__AJW09327

SEQ ID NO: 5768 - RNA, 477 nt, Artificial Sequence
  derived and/or modified sequence opt6 from Cytosine_Deaminase_fcy1__Saccharomyces_cerevisiae__AJW09327
augguaacaggaggaauggcaagcaaaugggaucaaaaaggaauggacauagcauaugaagaagcagcauuaggauauaaagaaggaggaguaccaauaggaggaugcuuaauaaauaauaaagacggaaguguauuaggaagaggacacaauaugagauuucaaaaaggaagugcaacauuacacggagaaauaaguacauuagaaaacuguggaagacuagaaggaaaaguauauaaagauacaacauuauauacaacacuaaguccaugugacaugugcacaggagcaauaauaauguauggaauaccaagauguguaguaggggaaaauguaaauuuuaaaagcaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5769 - protein, 158 aa, Artificial Sequence; identical to SEQ ID NO: 5385
  Cytosine_Deaminase_fcy1__Saccharomyces_cerevisiae__A0A0D4YEC2

SEQ ID NO: 5770 - RNA, 477 nt, Artificial Sequence
  Cytosine_Deaminase_fcy1__Saccharomyces_cerevisiae__AJW09763
auggugacagggggaauggcaagcaagugggaucagaaggguauggacauugccuaugaggaggcggccuuagguuacaaagagggugguguuccaauuggcggaugucuuaucaauaacaaagacggaaguguucucggucguggucacaacaugagauuucaaaagggauccgccacacuacauggugagaucuccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauuuaucgaugaaagaccucaggauugguuugaagauauuggugaguag

SEQ ID NO: 5771 - RNA, 477 nt, Artificial Sequence; identical to SEQ ID NO: 5387
  derived and/or modified sequence opt1 from Cytosine_Deaminase_fcy1__Saccharomyces_cerevisiae__AJW09763

SEQ ID NO: 5772 - RNA, 477 nt, Artificial Sequence; identical to SEQ ID NO: 5388
  derived and/or modified sequence opt2 from Cytosine_Deaminase_fcy1__Saccharomyces_cerevisiae__AJW09763

SEQ ID NO: 5773 - RNA, 477 nt, Artificial Sequence; identical to SEQ ID NO: 5389
  derived and/or modified sequence opt3 from Cytosine_Deaminase_fcy1__Saccharomyces_cerevisiae__AJW09763

SEQ ID NO: 5774 - RNA, 477 nt, Artificial Sequence; identical to SEQ ID NO: 5390
  derived and/or modified sequence opt4 from Cytosine_Deaminase_fcy1__Saccharomyces_cerevisiae__AJW09763

SEQ ID NO: 5775 - RNA, 477 nt, Artificial Sequence; identical to SEQ ID NO: 5391
  derived and/or modified sequence opt5 from Cytosine_Deaminase_fcy1__Saccharomyces_cerevisiae__AJW09763

SEQ ID NO: 5776 - RNA, 477 nt, Artificial Sequence
  derived and/or modified sequence opt6 from Cytosine_Deaminase_fcy1__Saccharomyces_cerevisiae__AJW09763
augguaacaggaggaauggcaagcaaaugggaucaaaaaggaauggacauagcauaugaagaagcagcacuaggauauaaagaaggaggaguaccaauaggaggaugcuuaauaaauaacaaagacggaaguguacuaggaagaggacauaauaugagauuccaaaaaggaagugcaacacuacacggagaaauaagcacauuagaaaacuguggaagauuagaaggaaaaguauauaaagauacaacacuauauacaacacuaucaccaugugacaugugcacaggagcaauaauaauguauggaauaccaagauguguaguaggggaaaauguaaauuucaaaaguaaaggagaaaaauaucuacaaacaagaggacaugaaguaguaguaguagaugacgaaagauguaaaaaaauaaugaaacaauuuauagacgaaagaccacaagauugguuugaagauauaggagaauaa

SEQ ID NO: 5777 - protein, 158 aa, Artificial Sequence; identical to SEQ ID NO: 5385
  Cytosine_Deaminase_fcy1__Saccharomyces_cerevisiae__A0A0D4YF30

SEQ ID NO: 5778 - RNA, 477 nt, Artificial Sequence; identical to SEQ ID NO: 5386
  Cytosine_Deaminase_fcy1__Saccharomyces_cerevisiae__AJW10199

SEQ ID NO: 5779 - RNA, 477 nt, Artificial Sequence; identical to SEQ ID NO: 5387
  derived and/or modified sequence opt1 from Cytosine_Deaminase_fcy1__Saccharomyces_cerevisiae__AJW10199

SEQ ID NO: 5780 - RNA, 477 nt, Artificial Sequence; identical to SEQ ID NO: 5388
  derived and/or modified sequence opt2 from Cytosine_Deaminase_fcy1__Saccharomyces_cerevisiae__AJW10199

SEQ ID NO: 5781 - RNA, 477 nt, Artificial Sequence; identical to SEQ ID NO: 5389
  derived and/or modified sequence opt3 from Cytosine_Deaminase_fcy1__Saccharomyces_cerevisiae__AJW10199

SEQ ID NO: 5782 - RNA, 477 nt, Artificial Sequence; identical to SEQ ID NO: 5390
  derived and/or modified sequence opt4 from Cytosine_Deaminase_fcy1__Saccharomyces_cerevisiae__AJW10199

SEQ ID NO: 5783 - RNA, 477 nt, Artificial Sequence; identical to SEQ ID NO: 5391
  derived and/or modified sequence opt5 from Cytosine_Deaminase_fcy1__Saccharomyces_cerevisiae__AJW10199

SEQ ID NO: 5784 - RNA, 477 nt, Artificial Sequence
  derived and/or modified sequence opt6 from Cytosine_Deaminase_fcy1__Saccharomyces_cerevisiae__AJW10199
augguaacaggaggaauggcaaguaaaugggaucaaaaaggaauggacauagcauaugaagaagcagcacuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaacuguggaagacuagaaggaaaaguauauaaagauacaacacuauauacaacauuaaguccaugcgacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5785 - protein, 158 aa, Artificial Sequence; identical to SEQ ID NO: 5385
  Cytosine_Deaminase_fcy1__Saccharomyces_cerevisiae__A0A0D4YGU2

SEQ ID NO: 5786 - RNA, 477 nt, Artificial Sequence; identical to SEQ ID NO: 5386
  Cytosine_Deaminase_fcy1__Saccharomyces_cerevisiae__AJW10633

SEQ ID NO: 5787 - RNA, 477 nt, Artificial Sequence; identical to SEQ ID NO: 5387
  derived and/or modified sequence opt1 from Cytosine_Deaminase_fcy1__Saccharomyces_cerevisiae__AJW10633

SEQ ID NO: 5788 - RNA, 477 nt, Artificial Sequence; identical to SEQ ID NO: 5388
  derived and/or modified sequence opt2 from Cytosine_Deaminase_fcy1__Saccharomyces_cerevisiae__AJW10633

SEQ ID NO: 5789 - RNA, 477 nt, Artificial Sequence; identical to SEQ ID NO: 5389
  derived and/or modified sequence opt3 from Cytosine_Deaminase_fcy1__Saccharomyces_cerevisiae__AJW10633

SEQ ID NO: 5790 - RNA, 477 nt, Artificial Sequence; identical to SEQ ID NO: 5390
  derived and/or modified sequence opt4 from Cytosine_Deaminase_fcy1__Saccharomyces_cerevisiae__AJW10633

SEQ ID NO: 5791 - RNA, 477 nt, Artificial Sequence; identical to SEQ ID NO: 5391
  derived and/or modified sequence opt5 from Cytosine_Deaminase_fcy1__Saccharomyces_cerevisiae__AJW10633

SEQ ID NO: 5792 - RNA, 477 nt, Artificial Sequence
  derived and/or modified sequence opt6 from Cytosine_Deaminase_fcy1__Saccharomyces_cerevisiae__AJW10633
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaacuguggaagacuagaaggaaaaguauauaaagauacaacauuauacacaacauuaaguccaugugacaugugcacgggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccgcaagauugguuugaagauauaggagaauaa

SEQ ID NO: 5793 - protein, 158 aa, Artificial Sequence; identical to SEQ ID NO: 5385
  Cytosine_Deaminase_fcy1__Saccharomyces_cerevisiae__A0A0D4YHN3

SEQ ID NO: 5794 - RNA, 477 nt, Artificial Sequence; identical to SEQ ID NO: 5386
  Cytosine_Deaminase_fcy1__Saccharomyces_cerevisiae__AJW10903

SEQ ID NO: 5795 - RNA, 477 nt, Artificial Sequence; identical to SEQ ID NO: 5387
  derived and/or modified sequence opt1 from Cytosine_Deaminase_fcy1__Saccharomyces_cerevisiae__AJW10903

SEQ ID NO: 5796 - RNA, 477 nt, Artificial Sequence; identical to SEQ ID NO: 5388
  derived and/or modified sequence opt2 from Cytosine_Deaminase_fcy1__Saccharomyces_cerevisiae__AJW10903

SEQ ID NO: 5797 - RNA, 477 nt, Artificial Sequence; identical to SEQ ID NO: 5389
  derived and/or modified sequence opt3 from Cytosine_Deaminase_fcy1__Saccharomyces_cerevisiae__AJW10903

SEQ ID NO: 5798 - RNA, 477 nt, Artificial Sequence; identical to SEQ ID NO: 5390
  derived and/or modified sequence opt4 from Cytosine_Deaminase_fcy1__Saccharomyces_cerevisiae__AJW10903

SEQ ID NO: 5799 - RNA, 477 nt, Artificial Sequence; identical to SEQ ID NO: 5391
  derived and/or modified sequence opt5 from Cytosine_Deaminase_fcy1__Saccharomyces_cerevisiae__AJW10903

SEQ ID NO: 5800 - RNA, 477 nt, Artificial Sequence
  derived and/or modified sequence opt6 from Cytosine_Deaminase_fcy1__Saccharomyces_cerevisiae__AJW10903
augguaacaggaggaauggcaaguaaaugggaucaaaaaggaauggacauagcauaugaagaagcagcauuaggauauaaagaaggaggaguaccaauaggaggaugucuaauaaauaauaaagauggaaguguauuaggaagaggacauaauaugagauuucaaaaaggaagugcaacauuacauggagaaauaaguacauuagaaaauuguggaagauuagaaggaaaaguauauaaagauacaacacuauauacaacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaaggccacaagauugguuugaagauauaggagaauaa

SEQ ID NO: 5801 - protein, 158 aa, Artificial Sequence; identical to SEQ ID NO: 5385
  Cytosine_Deaminase_fcy1__Saccharomyces_cerevisiae__A0A0D4YIU4

SEQ ID NO: 5802 - RNA, 477 nt, Artificial Sequence; identical to SEQ ID NO: 5386
  Cytosine_Deaminase_fcy1__Saccharomyces_cerevisiae__AJW11343

SEQ ID NO: 5803 - RNA, 477 nt, Artificial Sequence; identical to SEQ ID NO: 5387
  derived and/or modified sequence opt1 from Cytosine_Deaminase_fcy1__Saccharomyces_cerevisiae__AJW11343

SEQ ID NO: 5804 - RNA, 477 nt, Artificial Sequence; identical to SEQ ID NO: 5388
  derived and/or modified sequence opt2 from Cytosine_Deaminase_fcy1__Saccharomyces_cerevisiae__AJW11343

SEQ ID NO: 5805 - RNA, 477 nt, Artificial Sequence; identical to SEQ ID NO: 5389
  derived and/or modified sequence opt3 from Cytosine_Deaminase_fcy1__Saccharomyces_cerevisiae__AJW11343

SEQ ID NO: 5806 - RNA, 477 nt, Artificial Sequence; identical to SEQ ID NO: 5390
  derived and/or modified sequence opt4 from Cytosine_Deaminase_fcy1__Saccharomyces_cerevisiae__AJW11343

SEQ ID NO: 5807 - RNA, 477 nt, Artificial Sequence; identical to SEQ ID NO: 5391
  derived and/or modified sequence opt5 from Cytosine_Deaminase_fcy1__Saccharomyces_cerevisiae__AJW11343

SEQ ID NO: 5808 - RNA, 477 nt, Artificial Sequence
  derived and/or modified sequence opt6 from Cytosine_Deaminase_fcy1__Saccharomyces_cerevisiae__AJW11343
augguaacaggaggaauggcaaguaaaugggaucaaaaaggaauggacauagcauaugaagaagcagcauuaggauauaaagaaggaggaguaccaauaggaggauguuuaauaaauaauaaagacggaaguguauuaggaagaggacauaauaugagauuucaaaaaggaagugcaacauuacacggagaaauaaguacauuagaaaauuguggaagauuagaaggaaaaguauacaaagauacaacauuauauacaacauuaaguccaugugauauguguacaggagcaauaauaauguauggaauaccaagauguguaguaggagaaaauguaaauuuuaaaaguaaaggagaaaaauauuuacaaacgagaggacaugaaguaguaguaguagaugaugaaagauguaaaaaaauaaugaaacaauuuauagaugaaagaccacaagauugguuugaagauauaggagaauaa

SEQ ID NO: 5809 - protein, 158 aa, Artificial Sequence; identical to SEQ ID NO: 5385
  Cytosine_Deaminase_fcy1__Saccharomyces_cerevisiae__A0A0D4YJ74

SEQ ID NO: 5810 - RNA, 477 nt, Artificial Sequence; identical to SEQ ID NO: 5386
  Cytosine_Deaminase_fcy1__Saccharomyces_cerevisiae__AJW11786

SEQ ID NO: 5811 - RNA, 477 nt, Artificial Sequence; identical to SEQ ID NO: 5387
  derived and/or modified sequence opt1 from Cytosine_Deaminase_fcy1__Saccharomyces_cerevisiae__AJW11786

SEQ ID NO: 5812 - RNA, 477 nt, Artificial Sequence; identical to SEQ ID NO: 5388
  derived and/or modified sequence opt2 from Cytosine_Deaminase_fcy1__Saccharomyces_cerevisiae__AJW11786

SEQ ID NO: 5813 - RNA, 477 nt, Artificial Sequence; identical to SEQ ID NO: 5389
  derived and/or modified sequence opt3 from Cytosine_Deaminase_fcy1__Saccharomyces_cerevisiae__AJW11786

SEQ ID NO: 5814 - RNA, 477 nt, Artificial Sequence; identical to SEQ ID NO: 5390
  derived and/or modified sequence opt4 from Cytosine_Deaminase_fcy1__Saccharomyces_cerevisiae__AJW11786

SEQ ID NO: 5815 - RNA, 477 nt, Artificial Sequence; identical to SEQ ID NO: 5391
  derived and/or modified sequence opt5 from Cytosine_Deaminase_fcy1__Saccharomyces_cerevisiae__AJW11786

SEQ ID NO: 5816 - RNA, 477 nt, Artificial Sequence
  derived and/or modified sequence opt6 from Cytosine_Deaminase_fcy1__Saccharomyces_cerevisiae__AJW11786
augguaacaggaggaauggcaaguaaaugggaucaaaaaggaauggauauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaacuguggaagacuagaaggaaaaguauauaaagauacaacauuauauacaacauuaaguccaugugacauguguacaggagcaauaauaauguauggaauaccaagauguguaguaggagaaaauguaaauuuuaaaagcaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5817 - protein, 158 aa, Artificial Sequence; identical to SEQ ID NO: 5385
  Cytosine_Deaminase_fcy1__Saccharomyces_cerevisiae__A0A0D4YKC5

SEQ ID NO: 5818 - RNA, 477 nt, Artificial Sequence; identical to SEQ ID NO: 5386
  Cytosine_Deaminase_fcy1__Saccharomyces_cerevisiae__AJW12225

SEQ ID NO: 5819 - RNA, 477 nt, Artificial Sequence; identical to SEQ ID NO: 5387
  derived and/or modified sequence opt1 from Cytosine_Deaminase_fcy1__Saccharomyces_cerevisiae__AJW12225

SEQ ID NO: 5820 - RNA, 477 nt, Artificial Sequence; identical to SEQ ID NO: 5388
  derived and/or modified sequence opt2 from Cytosine_Deaminase_fcy1__Saccharomyces_cerevisiae__AJW12225

SEQ ID NO: 5821 - RNA, 477 nt, Artificial Sequence; identical to SEQ ID NO: 5389
  derived and/or modified sequence opt3 from Cytosine_Deaminase_fcy1__Saccharomyces_cerevisiae__AJW12225

SEQ ID NO: 5822 - RNA, 477 nt, Artificial Sequence; identical to SEQ ID NO: 5390
  derived and/or modified sequence opt4 from Cytosine_Deaminase_fcy1__Saccharomyces_cerevisiae__AJW12225

SEQ ID NO: 5823 - RNA, 477 nt, Artificial Sequence; identical to SEQ ID NO: 5391
  derived and/or modified sequence opt5 from Cytosine_Deaminase_fcy1__Saccharomyces_cerevisiae__AJW12225

SEQ ID NO: 5824 - RNA, 477 nt, Artificial Sequence
  derived and/or modified sequence opt6 from Cytosine_Deaminase_fcy1__Saccharomyces_cerevisiae__AJW12225
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguauuaggaagaggacauaauaugagauuucaaaaaggaagugcgacauuacauggagaaauaaguacauuagaaaauuguggaagauuagaaggaaaaguauauaaagauacaacauuauauacaacauuaaguccaugugacauguguacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaggauauaggagaauag

SEQ ID NO: 5825 - protein, 158 aa, Artificial Sequence; identical to SEQ ID NO: 5385
  Cytosine_Deaminase_fcy1__Saccharomyces_cerevisiae__A0A0D4YMN8

SEQ ID NO: 5826 - RNA, 477 nt, Artificial Sequence; identical to SEQ ID NO: 5386
  Cytosine_Deaminase_fcy1__Saccharomyces_cerevisiae__AJW12668

SEQ ID NO: 5827 - RNA, 477 nt, Artificial Sequence; identical to SEQ ID NO: 5387
  derived and/or modified sequence opt1 from Cytosine_Deaminase_fcy1__Saccharomyces_cerevisiae__AJW12668

SEQ ID NO: 5828 - RNA, 477 nt, Artificial Sequence; identical to SEQ ID NO: 5388
  derived and/or modified sequence opt2 from Cytosine_Deaminase_fcy1__Saccharomyces_cerevisiae__AJW12668

SEQ ID NO: 5829 - RNA, 477 nt, Artificial Sequence; identical to SEQ ID NO: 5389
  derived and/or modified sequence opt3 from Cytosine_Deaminase_fcy1__Saccharomyces_cerevisiae__AJW12668

SEQ ID NO: 5830 - RNA, 477 nt, Artificial Sequence; identical to SEQ ID NO: 5390
  derived and/or modified sequence opt4 from Cytosine_Deaminase_fcy1__Saccharomyces_cerevisiae__AJW12668

SEQ ID NO: 5831 - RNA, 477 nt, Artificial Sequence; identical to SEQ ID NO: 5391
  derived and/or modified sequence opt5 from Cytosine_Deaminase_fcy1__Saccharomyces_cerevisiae__AJW12668

SEQ ID NO: 5832 - RNA, 477 nt, Artificial Sequence
  derived and/or modified sequence opt6 from Cytosine_Deaminase_fcy1__Saccharomyces_cerevisiae__AJW12668
augguaacaggaggaauggcaaguaaaugggaucaaaaaggaauggacauagcauaugaagaagcagcacuaggauauaaagaaggaggaguaccaauaggaggaugccuaauaaauaauaaagacggaaguguauuaggaagaggacauaauaugagauuucaaaaaggaagugcaacauuacauggagaaauaaguacauuagaaaacuguggaagacuagaaggaaaaguauauaaagauacaacacuauauacaacauuaaguccaugugacaugugcacaggagcaauaauaauguacggaauaccaagauguguaguaggagaaaauguaaauuuuaaaaguaaaggagaaaaauauuuacaaacaagaggacaugaagugguaguaguagaugacgaaagauguaaaaaaauaaugaaacaauuuauagaugaaagaccacaagauugguuugaagauauaggagaauaa

SEQ ID NO: 5833 - protein, 158 aa, Artificial Sequence; identical to SEQ ID NO: 5385
  Cytosine_Deaminase_fcy1__Saccharomyces_cerevisiae__A0A0D4YMV6

SEQ ID NO: 5834 - RNA, 477 nt, Artificial Sequence; identical to SEQ ID NO: 5386
  Cytosine_Deaminase_fcy1__Saccharomyces_cerevisiae__AJW13105

SEQ ID NO: 5835 - RNA, 477 nt, Artificial Sequence; identical to SEQ ID NO: 5387
  derived and/or modified sequence opt1 from Cytosine_Deaminase_fcy1__Saccharomyces_cerevisiae__AJW13105

SEQ ID NO: 5836 - RNA, 477 nt, Artificial Sequence; identical to SEQ ID NO: 5388
  derived and/or modified sequence opt2 from Cytosine_Deaminase_fcy1__Saccharomyces_cerevisiae__AJW13105

SEQ ID NO: 5837 - RNA, 477 nt, Artificial Sequence; identical to SEQ ID NO: 5389
  derived and/or modified sequence opt3 from Cytosine_Deaminase_fcy1__Saccharomyces_cerevisiae__AJW13105

SEQ ID NO: 5838 - RNA, 477 nt, Artificial Sequence; identical to SEQ ID NO: 5390
  derived and/or modified sequence opt4 from Cytosine_Deaminase_fcy1__Saccharomyces_cerevisiae__AJW13105

SEQ ID NO: 5839 - RNA, 477 nt, Artificial Sequence; identical to SEQ ID NO: 5391
  derived and/or modified sequence opt5 from Cytosine_Deaminase_fcy1__Saccharomyces_cerevisiae__AJW13105

SEQ ID NO: 5840 - RNA, 477 nt, Artificial Sequence
  derived and/or modified sequence opt6 from Cytosine_Deaminase_fcy1__Saccharomyces_cerevisiae__AJW13105
augguaacaggaggaauggcaagcaaaugggaucaaaaaggaauggacauagcauaugaagaagcagcacuaggauauaaagaaggaggaguaccaauaggaggaugcuuaauaaauaauaaagacggaaguguauuaggaagaggacauaauaugagauuucaaaaaggaagugcaacauuacacggagaaauaagcacauuagaaaacuguggaagauuagaaggaaaaguauauaaagauacaacacuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5841 - protein, 158 aa, Artificial Sequence; identical to SEQ ID NO: 5385
  Cytosine_Deaminase_fcy1__Saccharomyces_cerevisiae__A0A0D4YPP6

SEQ ID NO: 5842 - RNA, 477 nt, Artificial Sequence; identical to SEQ ID NO: 5386
  Cytosine_Deaminase_fcy1__Saccharomyces_cerevisiae__AJW13529

SEQ ID NO: 5843 - RNA, 477 nt, Artificial Sequence; identical to SEQ ID NO: 5387
  derived and/or modified sequence opt1 from Cytosine_Deaminase_fcy1__Saccharomyces_cerevisiae__AJW13529

SEQ ID NO: 5844 - RNA, 477 nt, Artificial Sequence; identical to SEQ ID NO: 5388
  derived and/or modified sequence opt2 from Cytosine_Deaminase_fcy1__Saccharomyces_cerevisiae__AJW13529

SEQ ID NO: 5845 - RNA, 477 nt, Artificial Sequence; identical to SEQ ID NO: 5389
  derived and/or modified sequence opt3 from Cytosine_Deaminase_fcy1__Saccharomyces_cerevisiae__AJW13529

SEQ ID NO: 5846 - RNA, 477 nt, Artificial Sequence; identical to SEQ ID NO: 5390
  derived and/or modified sequence opt4 from Cytosine_Deaminase_fcy1__Saccharomyces_cerevisiae__AJW13529

SEQ ID NO: 5847 - RNA, 477 nt, Artificial Sequence; identical to SEQ ID NO: 5391
  derived and/or modified sequence opt5 from Cytosine_Deaminase_fcy1__Saccharomyces_cerevisiae__AJW13529

SEQ ID NO: 5848 - RNA, 477 nt, Artificial Sequence
  derived and/or modified sequence opt6 from Cytosine_Deaminase_fcy1__Saccharomyces_cerevisiae__AJW13529
augguaacaggagggauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaacuguggaagguuagaaggaaaaguauauaaagauacaacauuauauacaacauuaaguccaugugacauguguacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5849 - protein, 158 aa, Artificial Sequence; identical to SEQ ID NO: 5385
  Cytosine_Deaminase_fcy1__Saccharomyces_cerevisiae__A0A0D4YRD4

SEQ ID NO: 5850 - RNA, 477 nt, Artificial Sequence; identical to SEQ ID NO: 5386
  Cytosine_Deaminase_fcy1__Saccharomyces_cerevisiae__AJW13968

SEQ ID NO: 5851 - RNA, 477 nt, Artificial Sequence; identical to SEQ ID NO: 5387
  derived and/or modified sequence opt1 from Cytosine_Deaminase_fcy1__Saccharomyces_cerevisiae__AJW13968

SEQ ID NO: 5852 - RNA, 477 nt, Artificial Sequence; identical to SEQ ID NO: 5388
  derived and/or modified sequence opt2 from Cytosine_Deaminase_fcy1__Saccharomyces_cerevisiae__AJW13968

SEQ ID NO: 5853 - RNA, 477 nt, Artificial Sequence; identical to SEQ ID NO: 5389
  derived and/or modified sequence opt3 from Cytosine_Deaminase_fcy1__Saccharomyces_cerevisiae__AJW13968

SEQ ID NO: 5854 - RNA, 477 nt, Artificial Sequence; identical to SEQ ID NO: 5390
  derived and/or modified sequence opt4 from Cytosine_Deaminase_fcy1__Saccharomyces_cerevisiae__AJW13968

SEQ ID NO: 5855 - RNA, 477 nt, Artificial Sequence; identical to SEQ ID NO: 5391
  derived and/or modified sequence opt5 from Cytosine_Deaminase_fcy1__Saccharomyces_cerevisiae__AJW13968

SEQ ID NO: 5856 - RNA, 477 nt, Artificial Sequence
  derived and/or modified sequence opt6 from Cytosine_Deaminase_fcy1__Saccharomyces_cerevisiae__AJW13968
augguaacaggaggaauggcaaguaaaugggaucaaaaaggaauggacauagcauaugaagaagcagcacuaggauauaaagaaggaggaguaccaauaggaggaugcuuaauaaauaauaaagauggaagcguauuaggaagaggacauaauaugagauuucaaaaaggaagugcaacauuacacggagaaauaaguacauuagaaaacuguggaagauuagaaggaaaaguauauaaagauacaacauuauauacaacauuaaguccaugugacauguguacaggagcgauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5857 - protein, 158 aa, Artificial Sequence; identical to SEQ ID NO: 5385
  Cytosine_Deaminase_fcy1__Saccharomyces_cerevisiae__A0A0D4YS13

SEQ ID NO: 5858 - RNA, 477 nt, Artificial Sequence; identical to SEQ ID NO: 5746
  Cytosine_Deaminase_fcy1__Saccharomyces_cerevisiae__AJW14407

SEQ ID NO: 5859 - RNA, 477 nt, Artificial Sequence; identical to SEQ ID NO: 5387
  derived and/or modified sequence opt1 from Cytosine_Deaminase_fcy1__Saccharomyces_cerevisiae__AJW14407

SEQ ID NO: 5860 - RNA, 477 nt, Artificial Sequence; identical to SEQ ID NO: 5388
  derived and/or modified sequence opt2 from Cytosine_Deaminase_fcy1__Saccharomyces_cerevisiae__AJW14407

SEQ ID NO: 5861 - RNA, 477 nt, Artificial Sequence; identical to SEQ ID NO: 5389
  derived and/or modified sequence opt3 from Cytosine_Deaminase_fcy1__Saccharomyces_cerevisiae__AJW14407

SEQ ID NO: 5862 - RNA, 477 nt, Artificial Sequence; identical to SEQ ID NO: 5390
  derived and/or modified sequence opt4 from Cytosine_Deaminase_fcy1__Saccharomyces_cerevisiae__AJW14407

SEQ ID NO: 5863 - RNA, 477 nt, Artificial Sequence; identical to SEQ ID NO: 5391
  derived and/or modified sequence opt5 from Cytosine_Deaminase_fcy1__Saccharomyces_cerevisiae__AJW14407

SEQ ID NO: 5864 - RNA, 477 nt, Artificial Sequence
  derived and/or modified sequence opt6 from Cytosine_Deaminase_fcy1__Saccharomyces_cerevisiae__AJW14407
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacauggagaaauaaguacauuagaaaacuguggaagacuagaaggaaaaguauauaaagauacaacauuauauacaacacuaaguccaugugacaugugcacaggagcaauaauaauguauggaauaccaagauguguaguaggagaaaauguaaacuuuaaaaguaaaggagaaaaauauuuacaaacaaggggacaugaaguaguaguaguagaugacgaaagauguaaaaaaauaaugaaacaauuuauagaugaaagaccacaagauugguuugaagauauaggagaauaa

SEQ ID NO: 5865 - protein, 158 aa, Artificial Sequence; identical to SEQ ID NO: 5385
  Cytosine_Deaminase_fcy1__Saccharomyces_cerevisiae__A0A0D4YTJ7

SEQ ID NO: 5866 - RNA, 477 nt, Artificial Sequence; identical to SEQ ID NO: 5386
  Cytosine_Deaminase_fcy1__Saccharomyces_cerevisiae__AJW14829

SEQ ID NO: 5867 - RNA, 477 nt, Artificial Sequence; identical to SEQ ID NO: 5387
  derived and/or modified sequence opt1 from Cytosine_Deaminase_fcy1__Saccharomyces_cerevisiae__AJW14829

SEQ ID NO: 5868 - RNA, 477 nt, Artificial Sequence; identical to SEQ ID NO: 5388
  derived and/or modified sequence opt2 from Cytosine_Deaminase_fcy1__Saccharomyces_cerevisiae__AJW14829

SEQ ID NO: 5869 - RNA, 477 nt, Artificial Sequence; identical to SEQ ID NO: 5389
  derived and/or modified sequence opt3 from Cytosine_Deaminase_fcy1__Saccharomyces_cerevisiae__AJW14829

SEQ ID NO: 5870 - RNA, 477 nt, Artificial Sequence; identical to SEQ ID NO: 5390
  derived and/or modified sequence opt4 from Cytosine_Deaminase_fcy1__Saccharomyces_cerevisiae__AJW14829

SEQ ID NO: 5871 - RNA, 477 nt, Artificial Sequence; identical to SEQ ID NO: 5391
  derived and/or modified sequence opt5 from Cytosine_Deaminase_fcy1__Saccharomyces_cerevisiae__AJW14829

SEQ ID NO: 5872 - RNA, 477 nt, Artificial Sequence
  derived and/or modified sequence opt6 from Cytosine_Deaminase_fcy1__Saccharomyces_cerevisiae__AJW14829
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaacuguggaagacuagaaggaaaaguauauaaagauacaacacuauauacaacguuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguucgaagauauaggagaauaa

SEQ ID NO: 5873 - protein, 158 aa, Artificial Sequence; identical to SEQ ID NO: 5385
  Cytosine_Deaminase_fcy1__Saccharomyces_cerevisiae__A0A0D4YUX9

SEQ ID NO: 5874 - RNA, 477 nt, Artificial Sequence; identical to SEQ ID NO: 5386
  Cytosine_Deaminase_fcy1__Saccharomyces_cerevisiae__AJW15253

SEQ ID NO: 5875 - RNA, 477 nt, Artificial Sequence; identical to SEQ ID NO: 5387
  derived and/or modified sequence opt1 from Cytosine_Deaminase_fcy1__Saccharomyces_cerevisiae__AJW15253

SEQ ID NO: 5876 - RNA, 477 nt, Artificial Sequence; identical to SEQ ID NO: 5388
  derived and/or modified sequence opt2 from Cytosine_Deaminase_fcy1__Saccharomyces_cerevisiae__AJW15253

SEQ ID NO: 5877 - RNA, 477 nt, Artificial Sequence; identical to SEQ ID NO: 5389
  derived and/or modified sequence opt3 from Cytosine_Deaminase_fcy1__Saccharomyces_cerevisiae__AJW15253

SEQ ID NO: 5878 - RNA, 477 nt, Artificial Sequence; identical to SEQ ID NO: 5390
  derived and/or modified sequence opt4 from Cytosine_Deaminase_fcy1__Saccharomyces_cerevisiae__AJW15253

SEQ ID NO: 5879 - RNA, 477 nt, Artificial Sequence; identical to SEQ ID NO: 5391
  derived and/or modified sequence opt5 from Cytosine_Deaminase_fcy1__Saccharomyces_cerevisiae__AJW15253

SEQ ID NO: 5880 - RNA, 477 nt, Artificial Sequence
  derived and/or modified sequence opt6 from Cytosine_Deaminase_fcy1__Saccharomyces_cerevisiae__AJW15253
augguaacaggaggaauggcaaguaaaugggaucaaaaaggaauggacauagcauaugaagaagcagcacuaggauauaaagaaggaggaguaccaauaggaggauguuuaauaaauaauaaagacggaaguguauuaggaagaggacauaauaugagauuucaaaaaggaagugcaacauuacacggagaaauaaguacauuagaaaacuguggaagauuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5881 - protein, 158 aa, Artificial Sequence; identical to SEQ ID NO: 5385
  Cytosine_Deaminase_fcy1__Saccharomyces_cerevisiae__A0A0D4YV34

SEQ ID NO: 5882 - RNA, 477 nt, Artificial Sequence; identical to SEQ ID NO: 5386
  Cytosine_Deaminase_fcy1__Saccharomyces_cerevisiae__AJW15690

SEQ ID NO: 5883 - RNA, 477 nt, Artificial Sequence; identical to SEQ ID NO: 5387
  derived and/or modified sequence opt1 from Cytosine_Deaminase_fcy1__Saccharomyces_cerevisiae__AJW15690

SEQ ID NO: 5884 - RNA, 477 nt, Artificial Sequence; identical to SEQ ID NO: 5388
  derived and/or modified sequence opt2 from Cytosine_Deaminase_fcy1__Saccharomyces_cerevisiae__AJW15690

SEQ ID NO: 5885 - RNA, 477 nt, Artificial Sequence; identical to SEQ ID NO: 5389
  derived and/or modified sequence opt3 from Cytosine_Deaminase_fcy1__Saccharomyces_cerevisiae__AJW15690

SEQ ID NO: 5886 - RNA, 477 nt, Artificial Sequence; identical to SEQ ID NO: 5390
  derived and/or modified sequence opt4 from Cytosine_Deaminase_fcy1__Saccharomyces_cerevisiae__AJW15690

SEQ ID NO: 5887 - RNA, 477 nt, Artificial Sequence; identical to SEQ ID NO: 5391
  derived and/or modified sequence opt5 from Cytosine_Deaminase_fcy1__Saccharomyces_cerevisiae__AJW15690

SEQ ID NO: 5888 - RNA, 477 nt, Artificial Sequence
  derived and/or modified sequence opt6 from Cytosine_Deaminase_fcy1__Saccharomyces_cerevisiae__AJW15690
augguaacaggaggaauggcaaguaaaugggaucaaaaaggaauggauauagcauaugaagaagcagcauuaggauauaaagaaggaggaguaccaauaggaggauguuuaauaaauaauaaagauggaagcguauuaggaagagggcauaauaugagauuucaaaaaggaagugcaacacuacacggagaaauaaguacauuagaaaauuguggaagacuagaaggaaaaguauauaaagauacaacauuauauacgacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5889 - protein, 158 aa, Artificial Sequence; identical to SEQ ID NO: 5385
  Cytosine_Deaminase_fcy1__Saccharomyces_cerevisiae__A0A0D4YXE1

SEQ ID NO: 5890 - RNA, 477 nt, Artificial Sequence; identical to SEQ ID NO: 5386
  Cytosine_Deaminase_fcy1__Saccharomyces_cerevisiae__AJW16133

SEQ ID NO: 5891 - RNA, 477 nt, Artificial Sequence; identical to SEQ ID NO: 5387
  derived and/or modified sequence opt1 from Cytosine_Deaminase_fcy1__Saccharomyces_cerevisiae__AJW16133

SEQ ID NO: 5892 - RNA, 477 nt, Artificial Sequence; identical to SEQ ID NO: 5388
  derived and/or modified sequence opt2 from Cytosine_Deaminase_fcy1__Saccharomyces_cerevisiae__AJW16133

SEQ ID NO: 5893 - RNA, 477 nt, Artificial Sequence; identical to SEQ ID NO: 5389
  derived and/or modified sequence opt3 from Cytosine_Deaminase_fcy1__Saccharomyces_cerevisiae__AJW16133

SEQ ID NO: 5894 - RNA, 477 nt, Artificial Sequence; identical to SEQ ID NO: 5390
  derived and/or modified sequence opt4 from Cytosine_Deaminase_fcy1__Saccharomyces_cerevisiae__AJW16133

SEQ ID NO: 5895 - RNA, 477 nt, Artificial Sequence; identical to SEQ ID NO: 5391
  derived and/or modified sequence opt5 from Cytosine_Deaminase_fcy1__Saccharomyces_cerevisiae__AJW16133

SEQ ID NO: 5896 - RNA, 477 nt, Artificial Sequence
  derived and/or modified sequence opt6 from Cytosine_Deaminase_fcy1__Saccharomyces_cerevisiae__AJW16133
augguaacaggaggaauggcaaguaaaugggaucaaaaaggaauggauauagcauaugaagaggcagcauuaggauauaaagaaggaggaguaccaauaggaggauguuuaauaaauaauaaagauggaaguguauuaggaagaggacauaauaugagauuucaaaaaggaagugcaacauuacauggagaaauaagcacguuagaaaauuguggaagauuagaaggaaaaguauauaaagauacaacauuauauacaacauuaaguccaugugauauguguacaggagcaauaauaauguauggaauaccaagauguguaguaggagaaaaugugaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5897 - protein, 158 aa, Artificial Sequence; identical to SEQ ID NO: 5385
  Cytosine_Deaminase_fcy1__Saccharomyces_cerevisiae__A0A0D4YYM6

SEQ ID NO: 5898 - RNA, 477 nt, Artificial Sequence; identical to SEQ ID NO: 5386
  Cytosine_Deaminase_fcy1__Saccharomyces_cerevisiae__AJW16568

SEQ ID NO: 5899 - RNA, 477 nt, Artificial Sequence; identical to SEQ ID NO: 5387
  derived and/or modified sequence opt1 from Cytosine_Deaminase_fcy1__Saccharomyces_cerevisiae__AJW16568

SEQ ID NO: 5900 - RNA, 477 nt, Artificial Sequence; identical to SEQ ID NO: 5388
  derived and/or modified sequence opt2 from Cytosine_Deaminase_fcy1__Saccharomyces_cerevisiae__AJW16568

SEQ ID NO: 5901 - RNA, 477 nt, Artificial Sequence; identical to SEQ ID NO: 5389
  derived and/or modified sequence opt3 from Cytosine_Deaminase_fcy1__Saccharomyces_cerevisiae__AJW16568

SEQ ID NO: 5902 - RNA, 477 nt, Artificial Sequence; identical to SEQ ID NO: 5390
  derived and/or modified sequence opt4 from Cytosine_Deaminase_fcy1__Saccharomyces_cerevisiae__AJW16568

SEQ ID NO: 5903 - RNA, 477 nt, Artificial Sequence; identical to SEQ ID NO: 5391
  derived and/or modified sequence opt5 from Cytosine_Deaminase_fcy1__Saccharomyces_cerevisiae__AJW16568

SEQ ID NO: 5904 - RNA, 477 nt, Artificial Sequence
  derived and/or modified sequence opt6 from Cytosine_Deaminase_fcy1__Saccharomyces_cerevisiae__AJW16568
augguaacaggaggaauggcaaguaaaugggaucaaaaaggaauggacauagcauaugaagaagcagcauuaggauauaaagaaggaggaguaccaauaggaggaugccuaauaaauaauaaagacggaaguguauuaggaagaggacauaauaugagauuucaaaaaggaagcgcaacauuacacggagaaauaaguacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuucaaaagcaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5905 - protein, 158 aa, Artificial Sequence; identical to SEQ ID NO: 5385
  Cytosine_Deaminase_fcy1__Saccharomyces_cerevisiae__A0A0D4YZB7

SEQ ID NO: 5906 - RNA, 477 nt, Artificial Sequence; identical to SEQ ID NO: 5386
  Cytosine_Deaminase_fcy1__Saccharomyces_cerevisiae__AJW17006

SEQ ID NO: 5907 - RNA, 477 nt, Artificial Sequence; identical to SEQ ID NO: 5387
  derived and/or modified sequence opt1 from Cytosine_Deaminase_fcy1__Saccharomyces_cerevisiae__AJW17006

SEQ ID NO: 5908 - RNA, 477 nt, Artificial Sequence; identical to SEQ ID NO: 5388
  derived and/or modified sequence opt2 from Cytosine_Deaminase_fcy1__Saccharomyces_cerevisiae__AJW17006

SEQ ID NO: 5909 - RNA, 477 nt, Artificial Sequence; identical to SEQ ID NO: 5389
  derived and/or modified sequence opt3 from Cytosine_Deaminase_fcy1__Saccharomyces_cerevisiae__AJW17006

SEQ ID NO: 5910 - RNA, 477 nt, Artificial Sequence; identical to SEQ ID NO: 5390
  derived and/or modified sequence opt4 from Cytosine_Deaminase_fcy1__Saccharomyces_cerevisiae__AJW17006

SEQ ID NO: 5911 - RNA, 477 nt, Artificial Sequence; identical to SEQ ID NO: 5391
  derived and/or modified sequence opt5 from Cytosine_Deaminase_fcy1__Saccharomyces_cerevisiae__AJW17006

SEQ ID NO: 5912 - RNA, 477 nt, Artificial Sequence
  derived and/or modified sequence opt6 from Cytosine_Deaminase_fcy1__Saccharomyces_cerevisiae__AJW17006
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguauuaggaagaggacauaauaugagauuucaaaaaggaagugcaacguuacacggagaaauaaguacauuagaaaauuguggaagauuagaaggaaaaguauauaaagauacaacauuauauacaacauuaaguccaugugauauguguacaggagcaauaauaauguauggaauaccaagauguguagugggagaaaauguaaauuuuaaaaguaaaggagaaaaauaucuacaaacaagaggacaugaaguaguaguaguagaugaugaaagauguaaaaaaauaaugaaacaauuuauagaugaaagaccacaagauugguuugaagauauaggagaauaa

SEQ ID NO: 5913 - protein, 158 aa, Artificial Sequence; identical to SEQ ID NO: 5385
  Cytosine_Deaminase_fcy1__Saccharomyces_cerevisiae__A0A0D4Z060

SEQ ID NO: 5914 - RNA, 477 nt, Artificial Sequence; identical to SEQ ID NO: 5418
  Cytosine_Deaminase_fcy1__Saccharomyces_cerevisiae__AJW17430

SEQ ID NO: 5915 - RNA, 477 nt, Artificial Sequence; identical to SEQ ID NO: 5387
  derived and/or modified sequence opt1 from Cytosine_Deaminase_fcy1__Saccharomyces_cerevisiae__AJW17430

SEQ ID NO: 5916 - RNA, 477 nt, Artificial Sequence; identical to SEQ ID NO: 5388
  derived and/or modified sequence opt2 from Cytosine_Deaminase_fcy1__Saccharomyces_cerevisiae__AJW17430

SEQ ID NO: 5917 - RNA, 477 nt, Artificial Sequence; identical to SEQ ID NO: 5389
  derived and/or modified sequence opt3 from Cytosine_Deaminase_fcy1__Saccharomyces_cerevisiae__AJW17430

SEQ ID NO: 5918 - RNA, 477 nt, Artificial Sequence; identical to SEQ ID NO: 5390
  derived and/or modified sequence opt4 from Cytosine_Deaminase_fcy1__Saccharomyces_cerevisiae__AJW17430

SEQ ID NO: 5919 - RNA, 477 nt, Artificial Sequence; identical to SEQ ID NO: 5391
  derived and/or modified sequence opt5 from Cytosine_Deaminase_fcy1__Saccharomyces_cerevisiae__AJW17430

SEQ ID NO: 5920 - RNA, 477 nt, Artificial Sequence
  derived and/or modified sequence opt6 from Cytosine_Deaminase_fcy1__Saccharomyces_cerevisiae__AJW17430
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguacuaggaagaggacauaauaugagauuucaaaaaggaagugcaacauuacauggagaaauaaguacauuagaaaauuguggaagauuagaaggaaaaguauauaaagauacaacauuauauacaacauuaaguccgugugauauguguacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5921 - protein, 158 aa, Artificial Sequence; identical to SEQ ID NO: 5385
  Cytosine_Deaminase_fcy1__Saccharomyces_cerevisiae__A0A0D4Z1S2

SEQ ID NO: 5922 - RNA, 477 nt, Artificial Sequence; identical to SEQ ID NO: 5386
  Cytosine_Deaminase_fcy1__Saccharomyces_cerevisiae__AJW17876

SEQ ID NO: 5923 - RNA, 477 nt, Artificial Sequence; identical to SEQ ID NO: 5387
  derived and/or modified sequence opt1 from Cytosine_Deaminase_fcy1__Saccharomyces_cerevisiae__AJW17876

SEQ ID NO: 5924 - RNA, 477 nt, Artificial Sequence; identical to SEQ ID NO: 5388
  derived and/or modified sequence opt2 from Cytosine_Deaminase_fcy1__Saccharomyces_cerevisiae__AJW17876

SEQ ID NO: 5925 - RNA, 477 nt, Artificial Sequence; identical to SEQ ID NO: 5389
  derived and/or modified sequence opt3 from Cytosine_Deaminase_fcy1__Saccharomyces_cerevisiae__AJW17876

SEQ ID NO: 5926 - RNA, 477 nt, Artificial Sequence; identical to SEQ ID NO: 5390
  derived and/or modified sequence opt4 from Cytosine_Deaminase_fcy1__Saccharomyces_cerevisiae__AJW17876

SEQ ID NO: 5927 - RNA, 477 nt, Artificial Sequence; identical to SEQ ID NO: 5391
  derived and/or modified sequence opt5 from Cytosine_Deaminase_fcy1__Saccharomyces_cerevisiae__AJW17876

SEQ ID NO: 5928 - RNA, 477 nt, Artificial Sequence
  derived and/or modified sequence opt6 from Cytosine_Deaminase_fcy1__Saccharomyces_cerevisiae__AJW17876
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacacaauaugagauuucaaaaaggaagcgcaacauuacacggagaaauaagcacacuagaaaauuguggaagguuagaaggaaaaguauauaaagauacaacauuauauacaacauuaaguccaugcgacaugugcacaggagcaauaauaauguauggaauaccaagauguguaguaggagaaaauguaaauuuuaaaaguaaaggagaaaaauaucuacaaacaagaggacaugaaguaguaguaguagacgacgaaagauguaaaaaaauaaugaaacaauuuauagaugaaagaccacaagauugguuugaagauauaggagaauaa

SEQ ID NO: 5929 - protein, 158 aa, Artificial Sequence; identical to SEQ ID NO: 5385
  Cytosine_Deaminase_fcy1__Saccharomyces_cerevisiae__A0A0D4Z2L6

SEQ ID NO: 5930 - RNA, 477 nt, Artificial Sequence; identical to SEQ ID NO: 5386
  Cytosine_Deaminase_fcy1__Saccharomyces_cerevisiae__AJW18315

SEQ ID NO: 5931 - RNA, 477 nt, Artificial Sequence; identical to SEQ ID NO: 5387
  derived and/or modified sequence opt1 from Cytosine_Deaminase_fcy1__Saccharomyces_cerevisiae__AJW18315

SEQ ID NO: 5932 - RNA, 477 nt, Artificial Sequence; identical to SEQ ID NO: 5388
  derived and/or modified sequence opt2 from Cytosine_Deaminase_fcy1__Saccharomyces_cerevisiae__AJW18315

SEQ ID NO: 5933 - RNA, 477 nt, Artificial Sequence; identical to SEQ ID NO: 5389
  derived and/or modified sequence opt3 from Cytosine_Deaminase_fcy1__Saccharomyces_cerevisiae__AJW18315

SEQ ID NO: 5934 - RNA, 477 nt, Artificial Sequence; identical to SEQ ID NO: 5390
  derived and/or modified sequence opt4 from Cytosine_Deaminase_fcy1__Saccharomyces_cerevisiae__AJW18315

SEQ ID NO: 5935 - RNA, 477 nt, Artificial Sequence; identical to SEQ ID NO: 5391
  derived and/or modified sequence opt5 from Cytosine_Deaminase_fcy1__Saccharomyces_cerevisiae__AJW18315

SEQ ID NO: 5936 - RNA, 477 nt, Artificial Sequence
  derived and/or modified sequence opt6 from Cytosine_Deaminase_fcy1__Saccharomyces_cerevisiae__AJW18315
augguaacaggaggaauggcaaguaaaugggaucaaaaaggaauggacauagcauaugaagaagcagcauuaggguauaaagaaggaggaguaccaauaggaggauguuuaauaaauaauaaagauggaaguguacuaggaagaggacauaauaugagauuucaaaaaggaagugcaacauuacacggagaaauaucaacauuagaaaauuguggaagauuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5937 - protein, 158 aa, Artificial Sequence; identical to SEQ ID NO: 5385
  Cytosine_Deaminase_fcy1__Saccharomyces_cerevisiae__A0A0D4Z4A1

SEQ ID NO: 5938 - RNA, 477 nt, Artificial Sequence; identical to SEQ ID NO: 5466
  Cytosine_Deaminase_fcy1__Saccharomyces_cerevisiae__AJW18752

SEQ ID NO: 5939 - RNA, 477 nt, Artificial Sequence; identical to SEQ ID NO: 5387
  derived and/or modified sequence opt1 from Cytosine_Deaminase_fcy1__Saccharomyces_cerevisiae__AJW18752

SEQ ID NO: 5940 - RNA, 477 nt, Artificial Sequence; identical to SEQ ID NO: 5388
  derived and/or modified sequence opt2 from Cytosine_Deaminase_fcy1__Saccharomyces_cerevisiae__AJW18752

SEQ ID NO: 5941 - RNA, 477 nt, Artificial Sequence; identical to SEQ ID NO: 5389
  derived and/or modified sequence opt3 from Cytosine_Deaminase_fcy1__Saccharomyces_cerevisiae__AJW18752

SEQ ID NO: 5942 - RNA, 477 nt, Artificial Sequence; identical to SEQ ID NO: 5390
  derived and/or modified sequence opt4 from Cytosine_Deaminase_fcy1__Saccharomyces_cerevisiae__AJW18752

SEQ ID NO: 5943 - RNA, 477 nt, Artificial Sequence; identical to SEQ ID NO: 5391
  derived and/or modified sequence opt5 from Cytosine_Deaminase_fcy1__Saccharomyces_cerevisiae__AJW18752

SEQ ID NO: 5944 - RNA, 477 nt, Artificial Sequence
  derived and/or modified sequence opt6 from Cytosine_Deaminase_fcy1__Saccharomyces_cerevisiae__AJW18752
augguaacaggaggaauggcaaguaaaugggaucaaaaaggaauggacauagcauaugaagaagcagcacuaggauauaaagaaggaggaguaccaauaggaggaugcuuaauaaauaauaaagacggaaguguauuaggaagaggacacaauaugagauuccaaaaaggaagugcaacauuacacggagaaauaaguacauuagaaaauuguggaagacuagaaggaaaaguauauaaagauacaacauuauauacaacacuaaguccaugugacaugugcacaggagcaauaauaauguauggaauaccaagauguguaguaggagaaaauguaaauuuuaaaagcaaaggagaaaaauauuuacaaacaagaggacaugaaguaguaguaguagaugacgaaagauguaaaaaaauaaugaaacaauuuauagaugaaagaccacaagauugguuugaagauauaggagaauag

SEQ ID NO: 5945 - protein, 158 aa, Artificial Sequence; identical to SEQ ID NO: 5385
  Cytosine_Deaminase_fcy1__Saccharomyces_cerevisiae__A0A0D4Z552

SEQ ID NO: 5946 - RNA, 477 nt, Artificial Sequence; identical to SEQ ID NO: 5386
  Cytosine_Deaminase_fcy1__Saccharomyces_cerevisiae__AJW19190

SEQ ID NO: 5947 - RNA, 477 nt, Artificial Sequence; identical to SEQ ID NO: 5387
  derived and/or modified sequence opt1 from Cytosine_Deaminase_fcy1__Saccharomyces_cerevisiae__AJW19190

SEQ ID NO: 5948 - RNA, 477 nt, Artificial Sequence; identical to SEQ ID NO: 5388
  derived and/or modified sequence opt2 from Cytosine_Deaminase_fcy1__Saccharomyces_cerevisiae__AJW19190

SEQ ID NO: 5949 - RNA, 477 nt, Artificial Sequence; identical to SEQ ID NO: 5389
  derived and/or modified sequence opt3 from Cytosine_Deaminase_fcy1__Saccharomyces_cerevisiae__AJW19190

SEQ ID NO: 5950 - RNA, 477 nt, Artificial Sequence; identical to SEQ ID NO: 5390
  derived and/or modified sequence opt4 from Cytosine_Deaminase_fcy1__Saccharomyces_cerevisiae__AJW19190

SEQ ID NO: 5951 - RNA, 477 nt, Artificial Sequence; identical to SEQ ID NO: 5391
  derived and/or modified sequence opt5 from Cytosine_Deaminase_fcy1__Saccharomyces_cerevisiae__AJW19190

SEQ ID NO: 5952 - RNA, 477 nt, Artificial Sequence
  derived and/or modified sequence opt6 from Cytosine_Deaminase_fcy1__Saccharomyces_cerevisiae__AJW19190
augguaacaggaggaauggcaaguaaaugggaucaaaaaggaauggauauagcauaugaagaagcagcauuaggauauaaagaaggaggaguaccaauaggaggauguuuaauaaauaauaaggacggaagcguauuaggaagaggacauaauaugagauuucaaaaaggaagugcaacauuacacggagaaauaaguacauuagaaaauuguggaagauuagaaggaaaaguauauaaagauacaacauuauauacaacauuaaguccaugugacauguguacaggagcaauaauaauguauggaauaccaagaugugugguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5953 - protein, 158 aa, Artificial Sequence; identical to SEQ ID NO: 5385
  Cytosine_Deaminase_fcy1__Saccharomyces_cerevisiae__A0A0D4Z6N6

SEQ ID NO: 5954 - RNA, 477 nt, Artificial Sequence; identical to SEQ ID NO: 5386
  Cytosine_Deaminase_fcy1__Saccharomyces_cerevisiae__AJW19616

SEQ ID NO: 5955 - RNA, 477 nt, Artificial Sequence; identical to SEQ ID NO: 5387
  derived and/or modified sequence opt1 from Cytosine_Deaminase_fcy1__Saccharomyces_cerevisiae__AJW19616

SEQ ID NO: 5956 - RNA, 477 nt, Artificial Sequence; identical to SEQ ID NO: 5388
  derived and/or modified sequence opt2 from Cytosine_Deaminase_fcy1__Saccharomyces_cerevisiae__AJW19616

SEQ ID NO: 5957 - RNA, 477 nt, Artificial Sequence; identical to SEQ ID NO: 5389
  derived and/or modified sequence opt3 from Cytosine_Deaminase_fcy1__Saccharomyces_cerevisiae__AJW19616

SEQ ID NO: 5958 - RNA, 477 nt, Artificial Sequence; identical to SEQ ID NO: 5390
  derived and/or modified sequence opt4 from Cytosine_Deaminase_fcy1__Saccharomyces_cerevisiae__AJW19616

SEQ ID NO: 5959 - RNA, 477 nt, Artificial Sequence; identical to SEQ ID NO: 5391
  derived and/or modified sequence opt5 from Cytosine_Deaminase_fcy1__Saccharomyces_cerevisiae__AJW19616

SEQ ID NO: 5960 - RNA, 477 nt, Artificial Sequence
  derived and/or modified sequence opt6 from Cytosine_Deaminase_fcy1__Saccharomyces_cerevisiae__AJW19616
augguaacaggaggaauggcaaguaaaugggaucaaaaaggaauggauauagcauaugaagaagcagcauuaggauauaaagaaggaggaguaccaauaggaggauguuuaauaaauaauaaagauggaagcguauuaggaagaggacauaauaugagauuucaaaaaggaagcgcaacauuacauggagaaauaaguacacuagaaaauuguggaagauuagaaggaaaaguauauaaagauacaacauuauauacaacauuaaguccaugugauauguguacaggagcaauaauaauguauggaauaccaagguguguaguaggagaaaauguaaauuuuaaaaguaaaggagaaaaauauuuacaaacaagaggacaugaagugguagugguagaugaugaaagguguaaaaaaauaaugaaacaauuuauagaugaaagaccacaagauugguuugaagauauaggagaauaa

SEQ ID NO: 5961 - protein, 158 aa, Artificial Sequence; identical to SEQ ID NO: 5385
  Cytosine_Deaminase_fcy1__Saccharomyces_cerevisiae__A0A0D4Z800

SEQ ID NO: 5962 - RNA, 477 nt, Artificial Sequence; identical to SEQ ID NO: 5386
  Cytosine_Deaminase_fcy1__Saccharomyces_cerevisiae__AJW20032

SEQ ID NO: 5963 - RNA, 477 nt, Artificial Sequence; identical to SEQ ID NO: 5387
  derived and/or modified sequence opt1 from Cytosine_Deaminase_fcy1__Saccharomyces_cerevisiae__AJW20032

SEQ ID NO: 5964 - RNA, 477 nt, Artificial Sequence; identical to SEQ ID NO: 5388
  derived and/or modified sequence opt2 from Cytosine_Deaminase_fcy1__Saccharomyces_cerevisiae__AJW20032

SEQ ID NO: 5965 - RNA, 477 nt, Artificial Sequence; identical to SEQ ID NO: 5389
  derived and/or modified sequence opt3 from Cytosine_Deaminase_fcy1__Saccharomyces_cerevisiae__AJW20032

SEQ ID NO: 5966 - RNA, 477 nt, Artificial Sequence; identical to SEQ ID NO: 5390
  derived and/or modified sequence opt4 from Cytosine_Deaminase_fcy1__Saccharomyces_cerevisiae__AJW20032

SEQ ID NO: 5967 - RNA, 477 nt, Artificial Sequence; identical to SEQ ID NO: 5391
  derived and/or modified sequence opt5 from Cytosine_Deaminase_fcy1__Saccharomyces_cerevisiae__AJW20032

SEQ ID NO: 5968 - RNA, 477 nt, Artificial Sequence
  derived and/or modified sequence opt6 from Cytosine_Deaminase_fcy1__Saccharomyces_cerevisiae__AJW20032
augguaacaggaggaauggcaaguaaaugggaucaaaaaggaauggacauagcauaugaagaagcagcauuaggauauaaagaaggaggaguaccaauaggaggaugcuuaauaaauaauaaagauggaaguguacuaggaagaggacauaauaugagauuucaaaaaggaagugcaacacuacauggagaaauaagcacauuagaaaacuguggaagacuagaaggaaaaguauauaaagauacaacauuauauacaacauuaagcccaugugacauguguacaggagcaauaauaauguauggaauaccaagauguguaguaggagaaaauguaaauuuuaaaaguaaaggagaaaaauauuuacaaacaagaggacacgaaguaguaguaguagaugacgaaagauguaaaaaaauaaugaaacaauuuauagaugaaagaccacaagauugguuugaagauauaggagaauaa

SEQ ID NO: 5969 - protein, 158 aa, Artificial Sequence; identical to SEQ ID NO: 5385
  Cytosine_Deaminase_fcy1__Saccharomyces_cerevisiae__A0A0D4Z9V2

SEQ ID NO: 5970 - RNA, 477 nt, Artificial Sequence; identical to SEQ ID NO: 5418
  Cytosine_Deaminase_fcy1__Saccharomyces_cerevisiae__AJW20469

SEQ ID NO: 5971 - RNA, 477 nt, Artificial Sequence; identical to SEQ ID NO: 5387
  derived and/or modified sequence opt1 from Cytosine_Deaminase_fcy1__Saccharomyces_cerevisiae__AJW20469

SEQ ID NO: 5972 - RNA, 477 nt, Artificial Sequence; identical to SEQ ID NO: 5388
  derived and/or modified sequence opt2 from Cytosine_Deaminase_fcy1__Saccharomyces_cerevisiae__AJW20469

SEQ ID NO: 5973 - RNA, 477 nt, Artificial Sequence; identical to SEQ ID NO: 5389
  derived and/or modified sequence opt3 from Cytosine_Deaminase_fcy1__Saccharomyces_cerevisiae__AJW20469

SEQ ID NO: 5974 - RNA, 477 nt, Artificial Sequence; identical to SEQ ID NO: 5390
  derived and/or modified sequence opt4 from Cytosine_Deaminase_fcy1__Saccharomyces_cerevisiae__AJW20469

SEQ ID NO: 5975 - RNA, 477 nt, Artificial Sequence; identical to SEQ ID NO: 5391
  derived and/or modified sequence opt5 from Cytosine_Deaminase_fcy1__Saccharomyces_cerevisiae__AJW20469

SEQ ID NO: 5976 - RNA, 477 nt, Artificial Sequence
  derived and/or modified sequence opt6 from Cytosine_Deaminase_fcy1__Saccharomyces_cerevisiae__AJW20469
augguaacaggaggaauggcaagcaaaugggaucaaaaaggaauggauauagcauaugaagaagcagcauuaggauauaaagaaggaggaguaccaauaggaggaugucuaauaaauaauaaagauggaagcguauuaggaagaggacauaauaugagauuucaaaaaggaagugcaacauuacauggagaaauaaguacauuagaaaauuguggaagauuagaaggaaaaguauauaaagauacaacauuauauacaacauuaaguccaugugauauguguacaggagcaauaauaauguauggaauaccaagauguguaguaggagaaaauguaaauuuuaaaaguaaaggggaaaaauauuuacagacaagaggacaugaaguaguaguaguagaugaugaaagauguaaaaaaauaaugaaacaauuuauagaugaaagaccacaagauugguuugaagauauaggagaauaa

SEQ ID NO: 5977 - protein, 158 aa, Artificial Sequence; identical to SEQ ID NO: 5385
  Cytosine_Deaminase_fcy1__Saccharomyces_cerevisiae__A0A0D4ZB52

SEQ ID NO: 5978 - RNA, 477 nt, Artificial Sequence; identical to SEQ ID NO: 5386
  Cytosine_Deaminase_fcy1__Saccharomyces_cerevisiae__AJW20914

SEQ ID NO: 5979 - RNA, 477 nt, Artificial Sequence; identical to SEQ ID NO: 5387
  derived and/or modified sequence opt1 from Cytosine_Deaminase_fcy1__Saccharomyces_cerevisiae__AJW20914

SEQ ID NO: 5980 - RNA, 477 nt, Artificial Sequence; identical to SEQ ID NO: 5388
  derived and/or modified sequence opt2 from Cytosine_Deaminase_fcy1__Saccharomyces_cerevisiae__AJW20914

SEQ ID NO: 5981 - RNA, 477 nt, Artificial Sequence; identical to SEQ ID NO: 5389
  derived and/or modified sequence opt3 from Cytosine_Deaminase_fcy1__Saccharomyces_cerevisiae__AJW20914

SEQ ID NO: 5982 - RNA, 477 nt, Artificial Sequence; identical to SEQ ID NO: 5390
  derived and/or modified sequence opt4 from Cytosine_Deaminase_fcy1__Saccharomyces_cerevisiae__AJW20914

SEQ ID NO: 5983 - RNA, 477 nt, Artificial Sequence; identical to SEQ ID NO: 5391
  derived and/or modified sequence opt5 from Cytosine_Deaminase_fcy1__Saccharomyces_cerevisiae__AJW20914

SEQ ID NO: 5984 - RNA, 477 nt, Artificial Sequence
  derived and/or modified sequence opt6 from Cytosine_Deaminase_fcy1__Saccharomyces_cerevisiae__AJW20914
augguaacaggaggaauggcaagcaaaugggaucaaaaaggaauggacauagcauaugaagaagcagcauuaggauauaaagaaggaggaguaccaauaggaggaugcuuaauaaauaauaaagacggaagcguauuaggaagaggacauaauaugagauuucaaaaaggaagugcaacacuacacggagaaauaagcacauuagaaaacuguggaaggcuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 5985 - protein, 158 aa, Artificial Sequence; identical to SEQ ID NO: 5385
  Cytosine_Deaminase_fcy1__Saccharomyces_cerevisiae__A0A0D4ZCA2

SEQ ID NO: 5986 - RNA, 477 nt, Artificial Sequence; identical to SEQ ID NO: 5418
  Cytosine_Deaminase_fcy1__Saccharomyces_cerevisiae__AJW21349

SEQ ID NO: 5987 - RNA, 477 nt, Artificial Sequence; identical to SEQ ID NO: 5387
  derived and/or modified sequence opt1 from Cytosine_Deaminase_fcy1__Saccharomyces_cerevisiae__AJW21349

SEQ ID NO: 5988 - RNA, 477 nt, Artificial Sequence; identical to SEQ ID NO: 5388
  derived and/or modified sequence opt2 from Cytosine_Deaminase_fcy1__Saccharomyces_cerevisiae__AJW21349

SEQ ID NO: 5989 - RNA, 477 nt, Artificial Sequence; identical to SEQ ID NO: 5389
  derived and/or modified sequence opt3 from Cytosine_Deaminase_fcy1__Saccharomyces_cerevisiae__AJW21349

SEQ ID NO: 5990 - RNA, 477 nt, Artificial Sequence; identical to SEQ ID NO: 5390
  derived and/or modified sequence opt4 from Cytosine_Deaminase_fcy1__Saccharomyces_cerevisiae__AJW21349

SEQ ID NO: 5991 - RNA, 477 nt, Artificial Sequence; identical to SEQ ID NO: 5391
  derived and/or modified sequence opt5 from Cytosine_Deaminase_fcy1__Saccharomyces_cerevisiae__AJW21349

SEQ ID NO: 5992 - RNA, 477 nt, Artificial Sequence
  derived and/or modified sequence opt6 from Cytosine_Deaminase_fcy1__Saccharomyces_cerevisiae__AJW21349
augguaacaggaggaauggcaaguaaaugggaucaaaaaggaauggacauagcauaugaagaagcagcauuaggguauaaagaaggaggaguaccaauaggaggauguuuaauaaauaauaaagacggaagcguauuaggaagaggacauaauaugagauuucaaaaaggaagugcaacauuacacggagaaauaaguacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 5993 - protein, 158 aa, Artificial Sequence; identical to SEQ ID NO: 5385
  Cytosine_Deaminase_fcy1__Saccharomyces_cerevisiae__A0A0D4ZCG3

SEQ ID NO: 5994 - RNA, 477 nt, Artificial Sequence; identical to SEQ ID NO: 5714
  Cytosine_Deaminase_fcy1__Saccharomyces_cerevisiae__AJW21790

SEQ ID NO: 5995 - RNA, 477 nt, Artificial Sequence; identical to SEQ ID NO: 5387
  derived and/or modified sequence opt1 from Cytosine_Deaminase_fcy1__Saccharomyces_cerevisiae__AJW21790

SEQ ID NO: 5996 - RNA, 477 nt, Artificial Sequence; identical to SEQ ID NO: 5388
  derived and/or modified sequence opt2 from Cytosine_Deaminase_fcy1__Saccharomyces_cerevisiae__AJW21790

SEQ ID NO: 5997 - RNA, 477 nt, Artificial Sequence; identical to SEQ ID NO: 5389
  derived and/or modified sequence opt3 from Cytosine_Deaminase_fcy1__Saccharomyces_cerevisiae__AJW21790

SEQ ID NO: 5998 - RNA, 477 nt, Artificial Sequence; identical to SEQ ID NO: 5390
  derived and/or modified sequence opt4 from Cytosine_Deaminase_fcy1__Saccharomyces_cerevisiae__AJW21790

SEQ ID NO: 5999 - RNA, 477 nt, Artificial Sequence; identical to SEQ ID NO: 5391
  derived and/or modified sequence opt5 from Cytosine_Deaminase_fcy1__Saccharomyces_cerevisiae__AJW21790

SEQ ID NO: 6000 - RNA, 477 nt, Artificial Sequence
  derived and/or modified sequence opt6 from Cytosine_Deaminase_fcy1__Saccharomyces_cerevisiae__AJW21790
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaacuguggaagauuagaaggaaaaguauauaaagauacaacauuauauacaacacuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 6001 - protein, 158 aa, Artificial Sequence; identical to SEQ ID NO: 5385
  Cytosine_Deaminase_fcy1__Saccharomyces_cerevisiae__A0A0D4ZEM2

SEQ ID NO: 6002 - RNA, 477 nt, Artificial Sequence; identical to SEQ ID NO: 5386
  Cytosine_Deaminase_fcy1__Saccharomyces_cerevisiae__AJW22218

SEQ ID NO: 6003 - RNA, 477 nt, Artificial Sequence; identical to SEQ ID NO: 5387
  derived and/or modified sequence opt1 from Cytosine_Deaminase_fcy1__Saccharomyces_cerevisiae__AJW22218

SEQ ID NO: 6004 - RNA, 477 nt, Artificial Sequence; identical to SEQ ID NO: 5388
  derived and/or modified sequence opt2 from Cytosine_Deaminase_fcy1__Saccharomyces_cerevisiae__AJW22218

SEQ ID NO: 6005 - RNA, 477 nt, Artificial Sequence; identical to SEQ ID NO: 5389
  derived and/or modified sequence opt3 from Cytosine_Deaminase_fcy1__Saccharomyces_cerevisiae__AJW22218

SEQ ID NO: 6006 - RNA, 477 nt, Artificial Sequence; identical to SEQ ID NO: 5390
  derived and/or modified sequence opt4 from Cytosine_Deaminase_fcy1__Saccharomyces_cerevisiae__AJW22218

SEQ ID NO: 6007 - RNA, 477 nt, Artificial Sequence; identical to SEQ ID NO: 5391
  derived and/or modified sequence opt5 from Cytosine_Deaminase_fcy1__Saccharomyces_cerevisiae__AJW22218

SEQ ID NO: 6008 - RNA, 477 nt, Artificial Sequence
  derived and/or modified sequence opt6 from Cytosine_Deaminase_fcy1__Saccharomyces_cerevisiae__AJW22218
augguaacaggaggaauggcaaguaaaugggaucaaaaaggaauggacauagcauacgaagaagcagcauuaggauauaaagaaggaggaguaccaauaggaggaugucuaauaaauaauaaagauggaaguguauuaggaagaggacauaauaugagauuccaaaaaggaagugcaacauuacauggagaaauaaguacacuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaagcaaaggagaaaaauauuuacaaacaagaggacaugaaguaguagugguagaugacgaaagauguaaaaaaauaaugaaacaauuuauagaugaaagaccacaagauugguuugaagauauaggagaauaa

SEQ ID NO: 6009 - protein, 158 aa, Artificial Sequence; identical to SEQ ID NO: 5385
  Cytosine_Deaminase_fcy1__Saccharomyces_cerevisiae__A0A0D4ZFD0

SEQ ID NO: 6010 - RNA, 477 nt, Artificial Sequence; identical to SEQ ID NO: 5386
  Cytosine_Deaminase_fcy1__Saccharomyces_cerevisiae__AJW22656

SEQ ID NO: 6011 - RNA, 477 nt, Artificial Sequence; identical to SEQ ID NO: 5387
  derived and/or modified sequence opt1 from Cytosine_Deaminase_fcy1__Saccharomyces_cerevisiae__AJW22656

SEQ ID NO: 6012 - RNA, 477 nt, Artificial Sequence; identical to SEQ ID NO: 5388
  derived and/or modified sequence opt2 from Cytosine_Deaminase_fcy1__Saccharomyces_cerevisiae__AJW22656

SEQ ID NO: 6013 - RNA, 477 nt, Artificial Sequence; identical to SEQ ID NO: 5389
  derived and/or modified sequence opt3 from Cytosine_Deaminase_fcy1__Saccharomyces_cerevisiae__AJW22656

SEQ ID NO: 6014 - RNA, 477 nt, Artificial Sequence; identical to SEQ ID NO: 5390
  derived and/or modified sequence opt4 from Cytosine_Deaminase_fcy1__Saccharomyces_cerevisiae__AJW22656

SEQ ID NO: 6015 - RNA, 477 nt, Artificial Sequence; identical to SEQ ID NO: 5391
  derived and/or modified sequence opt5 from Cytosine_Deaminase_fcy1__Saccharomyces_cerevisiae__AJW22656

SEQ ID NO: 6016 - RNA, 477 nt, Artificial Sequence
  derived and/or modified sequence opt6 from Cytosine_Deaminase_fcy1__Saccharomyces_cerevisiae__AJW22656
augguaacaggaggaauggcaaguaaaugggaucaaaaaggaauggacauagcauaugaagaagcagcauuaggauauaaagaaggaggaguaccaauaggaggaugccuaauaaauaauaaagacggaaguguacuaggaagaggacauaauaugagauuucaaaaaggaagugcaacauuacacggagaaauaaguacauuagaaaauuguggaagacuagaaggaaaaguauauaaagauacaacauuauauacaacauuaaguccaugugauaugugcacaggagcaauaauaauguauggaauaccaagauguguaguaggagaaaauguaaacuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 6017 - protein, 158 aa, Artificial Sequence
  Cytosine_Deaminase_fcy1__Saccharomyces_cerevisiae__A0A0D4ZGR1
MVTGGMASKWDQKGMDIAYEEAALGYKEGGVPIGGCLINNKDGSVLGRGHNMRFQKGSATLHGEITTLENCGRLEGKVYKDTTLYTTLSPCDMCTGAIIMYGIPRCVVGENVNFKSKGEKYLQTRGHEVVVVDDERCKKIMKQFIDERPQDWFEDIGE

SEQ ID NO: 6018 - RNA, 477 nt, Artificial Sequence
  Cytosine_Deaminase_fcy1__Saccharomyces_cerevisiae__AJW23097
auggugacagggggaauggcaagcaagugggaucagaaggguauggacauugccuaugaggaggcggccuuagguuacaaagagggugguguuccaauuggcggaugucuuaucaauaacaaagacggaaguguucucggucguggucacaacaugagauuucaaaagggauccgccacacuacauggugagaucaccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauucaucgaugaaagaccucaggauugguuugaagauauuggugaguag

SEQ ID NO: 6019 - RNA, 477 nt, Artificial Sequence
  derived and/or modified sequence opt1 from Cytosine_Deaminase_fcy1__Saccharomyces_cerevisiae__AJW23097
auggugaccggcgggauggccagcaagugggaccagaagggcauggacaucgccuacgaggaggcggcccugggguacaaggagggcgggguccccaucggcggcugccucaucaacaacaaggacggguccgugcugggccgcgggcacaacaugcgguuccagaagggcagcgccacccugcacggggagaucacgacccucgagaacugcggccgccuggagggcaagguguacaaggacaccacccuguacacgacccucuccccgugcgacaugugcaccggggccaucaucauguacggcaucccccggugcgucgugggggagaacgugaacuucaagagcaagggcgagaaguaccugcagacccgcggccacgaggucgugguggucgacgacgagcggugcaagaagaucaugaagcaguucaucgacgagcgcccccaggacugguucgaggacaucggggaguga

SEQ ID NO: 6020 - RNA, 477 nt, Artificial Sequence
  derived and/or modified sequence opt2 from Cytosine_Deaminase_fcy1__Saccharomyces_cerevisiae__AJW23097
auggucaccggcggcauggccuccaagugggaccagaagggcauggacaucgccuacgaggaggccgcccucggcuacaaggagggcggcguccccaucggcggcugccucaucaacaacaaggacggcuccguccucggccgcggccacaacaugcgcuuccagaagggcuccgccacccuccacggcgagaucaccacccucgagaacugcggccgccucgagggcaaggucuacaaggacaccacccucuacaccacccucucccccugcgacaugugcaccggcgccaucaucauguacggcaucccccgcugcgucgucggcgagaacgucaacuucaaguccaagggcgagaaguaccuccagacccgcggccacgaggucgucgucgucgacgacgagcgcugcaagaagaucaugaagcaguucaucgacgagcgcccccaggacugguucgaggacaucggcgaguga

SEQ ID NO: 6021 - RNA, 477 nt, Artificial Sequence
  derived and/or modified sequence opt3 from Cytosine_Deaminase_fcy1__Saccharomyces_cerevisiae__AJW23097
auggugaccggcgggauggccagcaagugggaccagaaaggaauggauaucgcuuacgaggaagcagcccuggguuauaaggagggcgggguccccauuggaggcugccucauaaacaauaaagacgguuccguucuugggagaggacacaacaugagguuccaaaagggcucugcgacacugcauggcgaaaucacuacguuggagaauugugggcgguuagaaggaaaaguguacaaggauaccacacuguauacuacccuaucaccuugcgacauguguacaggugcuauuaucauguacggcauuccacgcugcguagugggggagaacgucaauuuuaagaguaaaggagagaaguaucuccagacccgaggccacgaagugguuguggucgaugacgagcguuguaaaaagaucaugaaacaguucauagaugaaagaccgcaggacugguuugaggauaucggugaguga

SEQ ID NO: 6022 - RNA, 477 nt, Artificial Sequence
  derived and/or modified sequence opt4 from Cytosine_Deaminase_fcy1__Saccharomyces_cerevisiae__AJW23097
auggugaccggcggcauggccagcaagugggaccagaagggcauggacaucgccuacgaggaggccgcccugggcuacaaggagggcggcgugcccaucggcggcugccugaucaacaacaaggacggcagcgugcugggcagaggccacaacaugagauuccagaagggcagcgccacccugcacggcgagaucaccacccuggagaacugcggcagacuggagggcaagguguacaaggacaccacccuguacaccacccugagccccugcgacaugugcaccggcgccaucaucauguacggcauccccagaugcguggugggcgagaacgugaacuucaagagcaagggcgagaaguaccugcagaccagaggccacgaggugguggugguggacgacgagagaugcaagaagaucaugaagcaguucaucgacgagagaccccaggacugguucgaggacaucggcgaguga

SEQ ID NO: 6023 - RNA, 477 nt, Artificial Sequence
  derived and/or modified sequence opt5 from Cytosine_Deaminase_fcy1__Saccharomyces_cerevisiae__AJW23097
auggugaccggcgggauggccagcaagugggaccagaaaggaauggauaucgcuuacgaggaagccgcgcugggcuauaaggaagggggaguccccauuggcgggugccucaucaacaauaaagacggauccguucugggcagaggccacaacaugcgguuccaaaaggggucugcuacacuucauggagagauuacgacccuggagaauuguggccgccucgaagggaaaguguacaaggauacaacccuguauacaacccuuagcccuugcgacauguguacaggagccaucauuauguacggcaucccgagaugcguggucggggagaacgugaauuuuaaguccaaaggagagaaguaucugcagacccggggccacgaaguuguggucguggaugacgagcgcuguaaaaagaucaugaaacaguucauugaugaaagaccccaggacugguuugaggauaucggcgaguga

SEQ ID NO: 6024 - RNA, 477 nt, Artificial Sequence
  derived and/or modified sequence opt6 from Cytosine_Deaminase_fcy1__Saccharomyces_cerevisiae__AJW23097
augguaacaggaggaauggcaaguaaaugggaucaaaaaggaauggacauagcauaugaagaagcagcacuaggauauaaagaaggaggaguaccaauaggaggauguuuaauaaauaauaaagauggaagcguauuaggaagaggacauaauaugagauuucaaaaaggaagugcaacauuacacggagaaauaacaacauuagaaaacuguggaagauuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauaucuacaaacaagaggacaugaaguaguaguaguagaugaugaaagauguaaaaaaauaaugaaacaauuuauagaugaaaggccacaagauugguuugaagauauaggagaauaa

SEQ ID NO: 6025 - protein, 158 aa, Artificial Sequence; identical to SEQ ID NO: 5385
  Cytosine_Deaminase_fcy1__Saccharomyces_cerevisiae__A0A0D4ZIM2

SEQ ID NO: 6026 - RNA, 477 nt, Artificial Sequence; identical to SEQ ID NO: 5386
  Cytosine_Deaminase_fcy1__Saccharomyces_cerevisiae__AJW23539

SEQ ID NO: 6027 - RNA, 477 nt, Artificial Sequence; identical to SEQ ID NO: 5387
  derived and/or modified sequence opt1 from Cytosine_Deaminase_fcy1__Saccharomyces_cerevisiae__AJW23539

SEQ ID NO: 6028 - RNA, 477 nt, Artificial Sequence; identical to SEQ ID NO: 5388
  derived and/or modified sequence opt2 from Cytosine_Deaminase_fcy1__Saccharomyces_cerevisiae__AJW23539

SEQ ID NO: 6029 - RNA, 477 nt, Artificial Sequence; identical to SEQ ID NO: 5389
  derived and/or modified sequence opt3 from Cytosine_Deaminase_fcy1__Saccharomyces_cerevisiae__AJW23539

SEQ ID NO: 6030 - RNA, 477 nt, Artificial Sequence; identical to SEQ ID NO: 5390
  derived and/or modified sequence opt4 from Cytosine_Deaminase_fcy1__Saccharomyces_cerevisiae__AJW23539

SEQ ID NO: 6031 - RNA, 477 nt, Artificial Sequence; identical to SEQ ID NO: 5391
  derived and/or modified sequence opt5 from Cytosine_Deaminase_fcy1__Saccharomyces_cerevisiae__AJW23539

SEQ ID NO: 6032 - RNA, 477 nt, Artificial Sequence
  derived and/or modified sequence opt6 from Cytosine_Deaminase_fcy1__Saccharomyces_cerevisiae__AJW23539
augguaacaggaggaauggcaaguaaaugggaucaaaaaggaauggauauagcauaugaagaagcagcacuaggauauaaagaaggaggaguaccaauaggaggaugcuuaauaaauaauaaagacggaaguguauuaggaagaggacauaauaugagauuucaaaaaggaagugcaacacuacacggagaaauaaguacauuagaaaacuguggaagacuagaaggaaaaguauauaaagauacaacauuauauacaacauuaaguccaugugauaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 6033 - protein, 158 aa, Artificial Sequence; identical to SEQ ID NO: 5385
  Cytosine_Deaminase_fcy1__Saccharomyces_cerevisiae__A0A0D4ZJC0

SEQ ID NO: 6034 - RNA, 477 nt, Artificial Sequence; identical to SEQ ID NO: 5418
  Cytosine_Deaminase_fcy1__Saccharomyces_cerevisiae__AJW23972

SEQ ID NO: 6035 - RNA, 477 nt, Artificial Sequence; identical to SEQ ID NO: 5387
  derived and/or modified sequence opt1 from Cytosine_Deaminase_fcy1__Saccharomyces_cerevisiae__AJW23972

SEQ ID NO: 6036 - RNA, 477 nt, Artificial Sequence; identical to SEQ ID NO: 5388
  derived and/or modified sequence opt2 from Cytosine_Deaminase_fcy1__Saccharomyces_cerevisiae__AJW23972

SEQ ID NO: 6037 - RNA, 477 nt, Artificial Sequence; identical to SEQ ID NO: 5389
  derived and/or modified sequence opt3 from Cytosine_Deaminase_fcy1__Saccharomyces_cerevisiae__AJW23972

SEQ ID NO: 6038 - RNA, 477 nt, Artificial Sequence; identical to SEQ ID NO: 5390
  derived and/or modified sequence opt4 from Cytosine_Deaminase_fcy1__Saccharomyces_cerevisiae__AJW23972

SEQ ID NO: 6039 - RNA, 477 nt, Artificial Sequence; identical to SEQ ID NO: 5391
  derived and/or modified sequence opt5 from Cytosine_Deaminase_fcy1__Saccharomyces_cerevisiae__AJW23972

SEQ ID NO: 6040 - RNA, 477 nt, Artificial Sequence
  derived and/or modified sequence opt6 from Cytosine_Deaminase_fcy1__Saccharomyces_cerevisiae__AJW23972
augguaacaggaggaauggcgaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaagggagugcaacauuacacggagaaauaaguacauuagaaaacugcggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauaucuacaaacaagaggacaugaaguaguaguaguagaugacgaaagauguaaaaaaauaaugaaacaauuuauagaugaaagaccacaagauugguuugaagauauaggagaauaa

SEQ ID NO: 6041 - protein, 158 aa, Artificial Sequence; identical to SEQ ID NO: 5385
  Cytosine_Deaminase_fcy1__Saccharomyces_cerevisiae__A0A0D4ZK17

SEQ ID NO: 6042 - RNA, 477 nt, Artificial Sequence; identical to SEQ ID NO: 5386
  Cytosine_Deaminase_fcy1__Saccharomyces_cerevisiae__AJW24410

SEQ ID NO: 6043 - RNA, 477 nt, Artificial Sequence; identical to SEQ ID NO: 5387
  derived and/or modified sequence opt1 from Cytosine_Deaminase_fcy1__Saccharomyces_cerevisiae__AJW24410

SEQ ID NO: 6044 - RNA, 477 nt, Artificial Sequence; identical to SEQ ID NO: 5388
  derived and/or modified sequence opt2 from Cytosine_Deaminase_fcy1__Saccharomyces_cerevisiae__AJW24410

SEQ ID NO: 6045 - RNA, 477 nt, Artificial Sequence; identical to SEQ ID NO: 5389
  derived and/or modified sequence opt3 from Cytosine_Deaminase_fcy1__Saccharomyces_cerevisiae__AJW24410

SEQ ID NO: 6046 - RNA, 477 nt, Artificial Sequence; identical to SEQ ID NO: 5390
  derived and/or modified sequence opt4 from Cytosine_Deaminase_fcy1__Saccharomyces_cerevisiae__AJW24410

SEQ ID NO: 6047 - RNA, 477 nt, Artificial Sequence; identical to SEQ ID NO: 5391
  derived and/or modified sequence opt5 from Cytosine_Deaminase_fcy1__Saccharomyces_cerevisiae__AJW24410

SEQ ID NO: 6048 - RNA, 477 nt, Artificial Sequence
  derived and/or modified sequence opt6 from Cytosine_Deaminase_fcy1__Saccharomyces_cerevisiae__AJW24410
augguaacaggaggaauggcaaguaaaugggaucaaaaaggaauggacauagcauaugaagaagcagcauuaggauauaaagaaggaggaguaccaauaggaggaugcuuaauaaauaacaaagacggaagcguauuaggaagaggacauaauaugagauuucaaaaaggaagugcaacauuacacggagaaauaagcacauuagaaaacuguggaagacuagaaggaaaaguauauaaagauacaacauuauauacaacauuaaguccaugcgacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 6049 - protein, 158 aa, Artificial Sequence; identical to SEQ ID NO: 5385
  Cytosine_Deaminase_fcy1__Saccharomyces_cerevisiae__A0A0D4ZMC8

SEQ ID NO: 6050 - RNA, 477 nt, Artificial Sequence; identical to SEQ ID NO: 5386
  Cytosine_Deaminase_fcy1__Saccharomyces_cerevisiae__AJW24849

SEQ ID NO: 6051 - RNA, 477 nt, Artificial Sequence; identical to SEQ ID NO: 5387
  derived and/or modified sequence opt1 from Cytosine_Deaminase_fcy1__Saccharomyces_cerevisiae__AJW24849

SEQ ID NO: 6052 - RNA, 477 nt, Artificial Sequence; identical to SEQ ID NO: 5388
  derived and/or modified sequence opt2 from Cytosine_Deaminase_fcy1__Saccharomyces_cerevisiae__AJW24849

SEQ ID NO: 6053 - RNA, 477 nt, Artificial Sequence; identical to SEQ ID NO: 5389
  derived and/or modified sequence opt3 from Cytosine_Deaminase_fcy1__Saccharomyces_cerevisiae__AJW24849

SEQ ID NO: 6054 - RNA, 477 nt, Artificial Sequence; identical to SEQ ID NO: 5390
  derived and/or modified sequence opt4 from Cytosine_Deaminase_fcy1__Saccharomyces_cerevisiae__AJW24849

SEQ ID NO: 6055 - RNA, 477 nt, Artificial Sequence; identical to SEQ ID NO: 5391
  derived and/or modified sequence opt5 from Cytosine_Deaminase_fcy1__Saccharomyces_cerevisiae__AJW24849

SEQ ID NO: 6056 - RNA, 477 nt, Artificial Sequence
  derived and/or modified sequence opt6 from Cytosine_Deaminase_fcy1__Saccharomyces_cerevisiae__AJW24849
augguaacaggaggaauggcaaguaaaugggaucaaaaaggaauggacauagcauaugaagaagcagcacuaggauauaaagaaggaggaguaccaauaggaggaugccuaauaaauaauaaagacggaaguguauuaggaagaggacauaauaugagauuucaaaaaggaagugcaacauuacacggagaaauaaguacauuagaaaacuguggaagacuagaaggaaaaguauauaaagauacaacauuauauacaacauuaaguccaugugauaugugcacaggagcaauaauaauguauggaauaccaagauguguaguaggagaaaauguaaauuuuaaaagcaaaggagaaaaauaucuacaaacaagaggacaugaaguaguaguaguagaugacgaaagauguaaaaaaauaaugaaacaauuuauagaugaaagaccacaagauugguuugaagauauaggagaauaa

SEQ ID NO: 6057 - protein, 158 aa, Artificial Sequence; identical to SEQ ID NO: 5385
  Cytosine_Deaminase_fcy1__Saccharomyces_cerevisiae__A0A0D4ZMX9

SEQ ID NO: 6058 - RNA, 477 nt, Artificial Sequence; identical to SEQ ID NO: 5386
  Cytosine_Deaminase_fcy1__Saccharomyces_cerevisiae__AJW25291

SEQ ID NO: 6059 - RNA, 477 nt, Artificial Sequence; identical to SEQ ID NO: 5387
  derived and/or modified sequence opt1 from Cytosine_Deaminase_fcy1__Saccharomyces_cerevisiae__AJW25291

SEQ ID NO: 6060 - RNA, 477 nt, Artificial Sequence; identical to SEQ ID NO: 5388
  derived and/or modified sequence opt2 from Cytosine_Deaminase_fcy1__Saccharomyces_cerevisiae__AJW25291

SEQ ID NO: 6061 - RNA, 477 nt, Artificial Sequence; identical to SEQ ID NO: 5389
  derived and/or modified sequence opt3 from Cytosine_Deaminase_fcy1__Saccharomyces_cerevisiae__AJW25291

SEQ ID NO: 6062 - RNA, 477 nt, Artificial Sequence; identical to SEQ ID NO: 5390
  derived and/or modified sequence opt4 from Cytosine_Deaminase_fcy1__Saccharomyces_cerevisiae__AJW25291

SEQ ID NO: 6063 - RNA, 477 nt, Artificial Sequence; identical to SEQ ID NO: 5391
  derived and/or modified sequence opt5 from Cytosine_Deaminase_fcy1__Saccharomyces_cerevisiae__AJW25291

SEQ ID NO: 6064 - RNA, 477 nt, Artificial Sequence
  derived and/or modified sequence opt6 from Cytosine_Deaminase_fcy1__Saccharomyces_cerevisiae__AJW25291
augguaacaggagggauggcaaguaaaugggaccaaaaaggaauggauauagcauaugaagaagcagcauuaggauauaaagaaggaggaguaccaauaggaggauguuuaauaaauaauaaagauggaaguguauuaggaagaggacauaauaugagauuucaaaaaggaagugcgacauuacauggagaaauaaguacauuagaaaauuguggaagacuagaaggaaaaguauauaaagauacaacacuauauacaacauuaaguccaugugacaugugcacaggagcaauaauaauguauggaauaccaagguguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 6065 - protein, 158 aa, Artificial Sequence; identical to SEQ ID NO: 5385
  Cytosine_Deaminase_fcy1__Saccharomyces_cerevisiae__A0A0D4ZP21

SEQ ID NO: 6066 - RNA, 477 nt, Artificial Sequence; identical to SEQ ID NO: 5418
  Cytosine_Deaminase_fcy1__Saccharomyces_cerevisiae__AJW25697

SEQ ID NO: 6067 - RNA, 477 nt, Artificial Sequence; identical to SEQ ID NO: 5387
  derived and/or modified sequence opt1 from Cytosine_Deaminase_fcy1__Saccharomyces_cerevisiae__AJW25697

SEQ ID NO: 6068 - RNA, 477 nt, Artificial Sequence; identical to SEQ ID NO: 5388
  derived and/or modified sequence opt2 from Cytosine_Deaminase_fcy1__Saccharomyces_cerevisiae__AJW25697

SEQ ID NO: 6069 - RNA, 477 nt, Artificial Sequence; identical to SEQ ID NO: 5389
  derived and/or modified sequence opt3 from Cytosine_Deaminase_fcy1__Saccharomyces_cerevisiae__AJW25697

SEQ ID NO: 6070 - RNA, 477 nt, Artificial Sequence; identical to SEQ ID NO: 5390
  derived and/or modified sequence opt4 from Cytosine_Deaminase_fcy1__Saccharomyces_cerevisiae__AJW25697

SEQ ID NO: 6071 - RNA, 477 nt, Artificial Sequence; identical to SEQ ID NO: 5391
  derived and/or modified sequence opt5 from Cytosine_Deaminase_fcy1__Saccharomyces_cerevisiae__AJW25697

SEQ ID NO: 6072 - RNA, 477 nt, Artificial Sequence
  derived and/or modified sequence opt6 from Cytosine_Deaminase_fcy1__Saccharomyces_cerevisiae__AJW25697
augguaacaggaggaauggcaaguaaaugggaucaaaaaggaauggauauagcauaugaagaagcagcauuaggauauaaagaaggaggaguaccgauaggaggauguuuaauaaauaauaaagauggaaguguauuaggaagagggcacaauaugagguuucaaaaaggaagugcaacauuacauggagaaauaaguacacuagaaaauugugggagacuagaaggaaaaguauauaaagauacaacauuauauacaacauuaaguccaugugauauguguacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 6073 - protein, 158 aa, Artificial Sequence; identical to SEQ ID NO: 5385
  Cytosine_Deaminase_fcy1__Saccharomyces_cerevisiae__A0A0D4ZQ62

SEQ ID NO: 6074 - RNA, 477 nt, Artificial Sequence; identical to SEQ ID NO: 5386
  Cytosine_Deaminase_fcy1__Saccharomyces_cerevisiae__AJW26215

SEQ ID NO: 6075 - RNA, 477 nt, Artificial Sequence; identical to SEQ ID NO: 5387
  derived and/or modified sequence opt1 from Cytosine_Deaminase_fcy1__Saccharomyces_cerevisiae__AJW26215

SEQ ID NO: 6076 - RNA, 477 nt, Artificial Sequence; identical to SEQ ID NO: 5388
  derived and/or modified sequence opt2 from Cytosine_Deaminase_fcy1__Saccharomyces_cerevisiae__AJW26215

SEQ ID NO: 6077 - RNA, 477 nt, Artificial Sequence; identical to SEQ ID NO: 5389
  derived and/or modified sequence opt3 from Cytosine_Deaminase_fcy1__Saccharomyces_cerevisiae__AJW26215

SEQ ID NO: 6078 - RNA, 477 nt, Artificial Sequence; identical to SEQ ID NO: 5390
  derived and/or modified sequence opt4 from Cytosine_Deaminase_fcy1__Saccharomyces_cerevisiae__AJW26215

SEQ ID NO: 6079 - RNA, 477 nt, Artificial Sequence; identical to SEQ ID NO: 5391
  derived and/or modified sequence opt5 from Cytosine_Deaminase_fcy1__Saccharomyces_cerevisiae__AJW26215

SEQ ID NO: 6080 - RNA, 477 nt, Artificial Sequence
  derived and/or modified sequence opt6 from Cytosine_Deaminase_fcy1__Saccharomyces_cerevisiae__AJW26215
augguaacaggaggaauggcaaguaaaugggaucaaaaaggaauggauauagcauaugaagaagcagcauuaggauauaaagaaggagggguaccaauaggaggauguuuaauaaauaauaaagauggaaguguauuaggaagaggacauaauaugagauuucaaaaaggaagugcaacauuacauggagaaauaaguacauuagaaaauuguggaagauuagaaggaaaaguauauaaagauacaacauuauauacaacauuaaguccaugugauauguguacaggagcaauaauaauguauggaauaccaagauguguaguaggagaaaauguaaauuuuaaaagcaaaggagagaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 6081 - protein, 158 aa, Artificial Sequence; identical to SEQ ID NO: 5385
  Cytosine_Deaminase_fcy1__Saccharomyces_cerevisiae__A0A0D4ZQ92

SEQ ID NO: 6082 - RNA, 477 nt, Artificial Sequence; identical to SEQ ID NO: 5386
  Cytosine_Deaminase_fcy1__Saccharomyces_cerevisiae__AJW25948

SEQ ID NO: 6083 - RNA, 477 nt, Artificial Sequence; identical to SEQ ID NO: 5387
  derived and/or modified sequence opt1 from Cytosine_Deaminase_fcy1__Saccharomyces_cerevisiae__AJW25948

SEQ ID NO: 6084 - RNA, 477 nt, Artificial Sequence; identical to SEQ ID NO: 5388
  derived and/or modified sequence opt2 from Cytosine_Deaminase_fcy1__Saccharomyces_cerevisiae__AJW25948

SEQ ID NO: 6085 - RNA, 477 nt, Artificial Sequence; identical to SEQ ID NO: 5389
  derived and/or modified sequence opt3 from Cytosine_Deaminase_fcy1__Saccharomyces_cerevisiae__AJW25948

SEQ ID NO: 6086 - RNA, 477 nt, Artificial Sequence; identical to SEQ ID NO: 5390
  derived and/or modified sequence opt4 from Cytosine_Deaminase_fcy1__Saccharomyces_cerevisiae__AJW25948

SEQ ID NO: 6087 - RNA, 477 nt, Artificial Sequence; identical to SEQ ID NO: 5391
  derived and/or modified sequence opt5 from Cytosine_Deaminase_fcy1__Saccharomyces_cerevisiae__AJW25948

SEQ ID NO: 6088 - RNA, 477 nt, Artificial Sequence
  derived and/or modified sequence opt6 from Cytosine_Deaminase_fcy1__Saccharomyces_cerevisiae__AJW25948
augguaacaggaggaauggcaaguaaaugggaucaaaaaggaauggauauagcauaugaagaagcagcauuaggauauaaagaaggaggaguaccaauaggaggaugcuuaauaaauaauaaagacggaaguguauuaggaagaggacauaauaugagauuucaaaaaggaagugcaacacuacauggagaaauaaguacauuagaaaauuguggaagauuagaaggaaaaguauauaaagauacaacacuauauacaacauuaaguccaugugauaugugcacaggagcaauaauaauguauggaauaccaagauguguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 6089 - protein, 158 aa, Artificial Sequence; identical to SEQ ID NO: 5385
  Cytosine_Deaminase_fcy1__Saccharomyces_cerevisiae__A0A0D4ZS31

SEQ ID NO: 6090 - RNA, 477 nt, Artificial Sequence; identical to SEQ ID NO: 5386
  Cytosine_Deaminase_fcy1__Saccharomyces_cerevisiae__AJW26880

SEQ ID NO: 6091 - RNA, 477 nt, Artificial Sequence; identical to SEQ ID NO: 5387
  derived and/or modified sequence opt1 from Cytosine_Deaminase_fcy1__Saccharomyces_cerevisiae__AJW26880

SEQ ID NO: 6092 - RNA, 477 nt, Artificial Sequence; identical to SEQ ID NO: 5388
  derived and/or modified sequence opt2 from Cytosine_Deaminase_fcy1__Saccharomyces_cerevisiae__AJW26880

SEQ ID NO: 6093 - RNA, 477 nt, Artificial Sequence; identical to SEQ ID NO: 5389
  derived and/or modified sequence opt3 from Cytosine_Deaminase_fcy1__Saccharomyces_cerevisiae__AJW26880

SEQ ID NO: 6094 - RNA, 477 nt, Artificial Sequence; identical to SEQ ID NO: 5390
  derived and/or modified sequence opt4 from Cytosine_Deaminase_fcy1__Saccharomyces_cerevisiae__AJW26880

SEQ ID NO: 6095 - RNA, 477 nt, Artificial Sequence; identical to SEQ ID NO: 5391
  derived and/or modified sequence opt5 from Cytosine_Deaminase_fcy1__Saccharomyces_cerevisiae__AJW26880

SEQ ID NO: 6096 - RNA, 477 nt, Artificial Sequence
  derived and/or modified sequence opt6 from Cytosine_Deaminase_fcy1__Saccharomyces_cerevisiae__AJW26880
augguaacaggaggaauggcaaguaaaugggaucaaaaaggaauggacauagcauaugaagaagcagcauuaggauacaaagaagggggaguaccaauaggaggaugcuuaauaaauaauaaagacggaaguguauuaggaagaggacauaauaugagauuucaaaaaggaagugcaacauuacacggagaaauaagcacauuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauaucuacaaacaaggggacaugaaguaguaguaguagaugacgaaagauguaaaaaaauaaugaaacaauuuauagaugaaagaccacaagauugguuugaagauauaggagaauaa

SEQ ID NO: 6097 - protein, 158 aa, Artificial Sequence; identical to SEQ ID NO: 5385
  Cytosine_Deaminase_fcy1__Saccharomyces_cerevisiae__A0A0D4ZS87

SEQ ID NO: 6098 - RNA, 477 nt, Artificial Sequence; identical to SEQ ID NO: 5386
  Cytosine_Deaminase_fcy1__Saccharomyces_cerevisiae__AJW26613

SEQ ID NO: 6099 - RNA, 477 nt, Artificial Sequence; identical to SEQ ID NO: 5387
  derived and/or modified sequence opt1 from Cytosine_Deaminase_fcy1__Saccharomyces_cerevisiae__AJW26613

SEQ ID NO: 6100 - RNA, 477 nt, Artificial Sequence; identical to SEQ ID NO: 5388
  derived and/or modified sequence opt2 from Cytosine_Deaminase_fcy1__Saccharomyces_cerevisiae__AJW26613

SEQ ID NO: 6101 - RNA, 477 nt, Artificial Sequence; identical to SEQ ID NO: 5389
  derived and/or modified sequence opt3 from Cytosine_Deaminase_fcy1__Saccharomyces_cerevisiae__AJW26613

SEQ ID NO: 6102 - RNA, 477 nt, Artificial Sequence; identical to SEQ ID NO: 5390
  derived and/or modified sequence opt4 from Cytosine_Deaminase_fcy1__Saccharomyces_cerevisiae__AJW26613

SEQ ID NO: 6103 - RNA, 477 nt, Artificial Sequence; identical to SEQ ID NO: 5391
  derived and/or modified sequence opt5 from Cytosine_Deaminase_fcy1__Saccharomyces_cerevisiae__AJW26613

SEQ ID NO: 6104 - RNA, 477 nt, Artificial Sequence
  derived and/or modified sequence opt6 from Cytosine_Deaminase_fcy1__Saccharomyces_cerevisiae__AJW26613
augguaacaggaggaauggcaaguaaaugggaucaaaaaggaauggauauagcauaugaagaagcagcauuaggauauaaagaaggaggaguaccaauaggaggaugcuuaauaaauaauaaagacggaaguguacuaggaagaggacauaauaugagauuucaaaaaggaagcgcgacauuacauggagaaauaaguacauuagaaaauugcggaagguuagaaggaaaaguauauaaagauacaacauuauauacaacauuaaguccaugugauauguguacaggagcaauaauaauguauggaauaccaagauguguaguaggagaaaauguaaauuuuaaaagcaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 6105 - protein, 158 aa, Artificial Sequence; identical to SEQ ID NO: 5385
  Cytosine_Deaminase_fcy1__Saccharomyces_cerevisiae__A0A0D4ZTS6

SEQ ID NO: 6106 - RNA, 477 nt, Artificial Sequence; identical to SEQ ID NO: 5386
  Cytosine_Deaminase_fcy1__Saccharomyces_cerevisiae__AJW27148

SEQ ID NO: 6107 - RNA, 477 nt, Artificial Sequence; identical to SEQ ID NO: 5387
  derived and/or modified sequence opt1 from Cytosine_Deaminase_fcy1__Saccharomyces_cerevisiae__AJW27148

SEQ ID NO: 6108 - RNA, 477 nt, Artificial Sequence; identical to SEQ ID NO: 5388
  derived and/or modified sequence opt2 from Cytosine_Deaminase_fcy1__Saccharomyces_cerevisiae__AJW27148

SEQ ID NO: 6109 - RNA, 477 nt, Artificial Sequence; identical to SEQ ID NO: 5389
  derived and/or modified sequence opt3 from Cytosine_Deaminase_fcy1__Saccharomyces_cerevisiae__AJW27148

SEQ ID NO: 6110 - RNA, 477 nt, Artificial Sequence; identical to SEQ ID NO: 5390
  derived and/or modified sequence opt4 from Cytosine_Deaminase_fcy1__Saccharomyces_cerevisiae__AJW27148

SEQ ID NO: 6111 - RNA, 477 nt, Artificial Sequence; identical to SEQ ID NO: 5391
  derived and/or modified sequence opt5 from Cytosine_Deaminase_fcy1__Saccharomyces_cerevisiae__AJW27148

SEQ ID NO: 6112 - RNA, 477 nt, Artificial Sequence
  derived and/or modified sequence opt6 from Cytosine_Deaminase_fcy1__Saccharomyces_cerevisiae__AJW27148
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaaguacauuagaaaacuguggaagauuagaaggaaaaguauauaaagauacaacauuauauacaacauuaaguccaugugacauguguacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 6113 - protein, 158 aa, Artificial Sequence; identical to SEQ ID NO: 5385
  Cytosine_Deaminase_fcy1__Saccharomyces_cerevisiae__A0A0D4ZUK0

SEQ ID NO: 6114 - RNA, 477 nt, Artificial Sequence; identical to SEQ ID NO: 5386
  Cytosine_Deaminase_fcy1__Saccharomyces_cerevisiae__AJW27576

SEQ ID NO: 6115 - RNA, 477 nt, Artificial Sequence; identical to SEQ ID NO: 5387
  derived and/or modified sequence opt1 from Cytosine_Deaminase_fcy1__Saccharomyces_cerevisiae__AJW27576

SEQ ID NO: 6116 - RNA, 477 nt, Artificial Sequence; identical to SEQ ID NO: 5388
  derived and/or modified sequence opt2 from Cytosine_Deaminase_fcy1__Saccharomyces_cerevisiae__AJW27576

SEQ ID NO: 6117 - RNA, 477 nt, Artificial Sequence; identical to SEQ ID NO: 5389
  derived and/or modified sequence opt3 from Cytosine_Deaminase_fcy1__Saccharomyces_cerevisiae__AJW27576

SEQ ID NO: 6118 - RNA, 477 nt, Artificial Sequence; identical to SEQ ID NO: 5390
  derived and/or modified sequence opt4 from Cytosine_Deaminase_fcy1__Saccharomyces_cerevisiae__AJW27576

SEQ ID NO: 6119 - RNA, 477 nt, Artificial Sequence; identical to SEQ ID NO: 5391
  derived and/or modified sequence opt5 from Cytosine_Deaminase_fcy1__Saccharomyces_cerevisiae__AJW27576

SEQ ID NO: 6120 - RNA, 477 nt, Artificial Sequence
  derived and/or modified sequence opt6 from Cytosine_Deaminase_fcy1__Saccharomyces_cerevisiae__AJW27576
augguaacaggaggaauggcaaguaaaugggaucaaaaaggaauggauauagcauaugaagaagcagcauuaggauauaaagaaggaggaguaccaauaggaggaugcuuaauaaauaauaaagacggaaguguacuaggaagaggacauaauaugagauuucaaaaaggaagugcaacauuacacggagaaauaaguacauuagaaaacuguggaagauuagaaggaaaaguauauaaagauacaacauuauauacaacauuaaguccaugugacaugugcacaggagcaauaauaauguauggaauaccaagauguguaguaggagaaaauguaaauuuuaaaaguaaaggagagaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 6121 - protein, 158 aa, Artificial Sequence; identical to SEQ ID NO: 5385
  Cytosine_Deaminase_fcy1__Saccharomyces_cerevisiae__A0A0D4ZVN6

SEQ ID NO: 6122 - RNA, 477 nt, Artificial Sequence; identical to SEQ ID NO: 5386
  Cytosine_Deaminase_fcy1__Saccharomyces_cerevisiae__AJW27843

SEQ ID NO: 6123 - RNA, 477 nt, Artificial Sequence; identical to SEQ ID NO: 5387
  derived and/or modified sequence opt1 from Cytosine_Deaminase_fcy1__Saccharomyces_cerevisiae__AJW27843

SEQ ID NO: 6124 - RNA, 477 nt, Artificial Sequence; identical to SEQ ID NO: 5388
  derived and/or modified sequence opt2 from Cytosine_Deaminase_fcy1__Saccharomyces_cerevisiae__AJW27843

SEQ ID NO: 6125 - RNA, 477 nt, Artificial Sequence; identical to SEQ ID NO: 5389
  derived and/or modified sequence opt3 from Cytosine_Deaminase_fcy1__Saccharomyces_cerevisiae__AJW27843

SEQ ID NO: 6126 - RNA, 477 nt, Artificial Sequence; identical to SEQ ID NO: 5390
  derived and/or modified sequence opt4 from Cytosine_Deaminase_fcy1__Saccharomyces_cerevisiae__AJW27843

SEQ ID NO: 6127 - RNA, 477 nt, Artificial Sequence; identical to SEQ ID NO: 5391
  derived and/or modified sequence opt5 from Cytosine_Deaminase_fcy1__Saccharomyces_cerevisiae__AJW27843

SEQ ID NO: 6128 - RNA, 477 nt, Artificial Sequence
  derived and/or modified sequence opt6 from Cytosine_Deaminase_fcy1__Saccharomyces_cerevisiae__AJW27843
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguauuaggaagagggcauaauaugagauuucaaaaaggaagugcaacauuacauggagaaauaagcacauuagaaaauuguggaagauuagaaggaaaaguauauaaagauacaacauuauauacaacauuaaguccaugugauauguguacaggagcaauaauaauguauggaauaccaagauguguaguaggagaaaauguaaauuuuaaaagcaaaggagaaaaauauuuacaaacaaggggacaugaaguaguaguaguagaugaugaaagguguaaaaaaauaaugaaacaauuuauagaugaaagaccacaagauugguuugaagauauaggagaauaa

SEQ ID NO: 6129 - protein, 158 aa, Artificial Sequence; identical to SEQ ID NO: 5385
  Cytosine_Deaminase_fcy1__Saccharomyces_cerevisiae__A0A0D4ZWP2

SEQ ID NO: 6130 - RNA, 477 nt, Artificial Sequence; identical to SEQ ID NO: 5386
  Cytosine_Deaminase_fcy1__Saccharomyces_cerevisiae__AJW28286

SEQ ID NO: 6131 - RNA, 477 nt, Artificial Sequence; identical to SEQ ID NO: 5387
  derived and/or modified sequence opt1 from Cytosine_Deaminase_fcy1__Saccharomyces_cerevisiae__AJW28286

SEQ ID NO: 6132 - RNA, 477 nt, Artificial Sequence; identical to SEQ ID NO: 5388
  derived and/or modified sequence opt2 from Cytosine_Deaminase_fcy1__Saccharomyces_cerevisiae__AJW28286

SEQ ID NO: 6133 - RNA, 477 nt, Artificial Sequence; identical to SEQ ID NO: 5389
  derived and/or modified sequence opt3 from Cytosine_Deaminase_fcy1__Saccharomyces_cerevisiae__AJW28286

SEQ ID NO: 6134 - RNA, 477 nt, Artificial Sequence; identical to SEQ ID NO: 5390
  derived and/or modified sequence opt4 from Cytosine_Deaminase_fcy1__Saccharomyces_cerevisiae__AJW28286

SEQ ID NO: 6135 - RNA, 477 nt, Artificial Sequence; identical to SEQ ID NO: 5391
  derived and/or modified sequence opt5 from Cytosine_Deaminase_fcy1__Saccharomyces_cerevisiae__AJW28286

SEQ ID NO: 6136 - RNA, 477 nt, Artificial Sequence
  derived and/or modified sequence opt6 from Cytosine_Deaminase_fcy1__Saccharomyces_cerevisiae__AJW28286
augguaacaggaggaauggcaaguaaaugggaucaaaaaggaauggauauagcauaugaagaagcagcacuaggauauaaagaaggaggaguaccaauaggaggauguuuaauaaauaauaaagauggaagcguauuaggaagaggacauaauaugagauuucaaaaaggaagugcaacauuacauggagaaauaaguacauuagaaaauuguggaagguuagaaggaaaaguauauaaagauacaacauuauauacaacacuaaguccaugugauauguguacaggagcaauaauaauguauggaauaccaagauguguaguaggagaaaauguaaauuuuaaaagcaaaggggaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 6137 - protein, 158 aa, Artificial Sequence; identical to SEQ ID NO: 5385
  Cytosine_Deaminase_fcy1__Saccharomyces_cerevisiae__A0A0D4ZX07

SEQ ID NO: 6138 - RNA, 477 nt, Artificial Sequence; identical to SEQ ID NO: 5386
  Cytosine_Deaminase_fcy1__Saccharomyces_cerevisiae__AJW28555

SEQ ID NO: 6139 - RNA, 477 nt, Artificial Sequence; identical to SEQ ID NO: 5387
  derived and/or modified sequence opt1 from Cytosine_Deaminase_fcy1__Saccharomyces_cerevisiae__AJW28555

SEQ ID NO: 6140 - RNA, 477 nt, Artificial Sequence; identical to SEQ ID NO: 5388
  derived and/or modified sequence opt2 from Cytosine_Deaminase_fcy1__Saccharomyces_cerevisiae__AJW28555

SEQ ID NO: 6141 - RNA, 477 nt, Artificial Sequence; identical to SEQ ID NO: 5389
  derived and/or modified sequence opt3 from Cytosine_Deaminase_fcy1__Saccharomyces_cerevisiae__AJW28555

SEQ ID NO: 6142 - RNA, 477 nt, Artificial Sequence; identical to SEQ ID NO: 5390
  derived and/or modified sequence opt4 from Cytosine_Deaminase_fcy1__Saccharomyces_cerevisiae__AJW28555

SEQ ID NO: 6143 - RNA, 477 nt, Artificial Sequence; identical to SEQ ID NO: 5391
  derived and/or modified sequence opt5 from Cytosine_Deaminase_fcy1__Saccharomyces_cerevisiae__AJW28555

SEQ ID NO: 6144 - RNA, 477 nt, Artificial Sequence
  derived and/or modified sequence opt6 from Cytosine_Deaminase_fcy1__Saccharomyces_cerevisiae__AJW28555
augguaacaggaggaauggcaaguaaaugggaucaaaaaggaauggacauagcauaugaagaagcagcauuaggauauaaagaaggaggaguaccaauaggaggaugcuuaauaaauaauaaagacggaaguguauuaggaagaggacauaauaugagauuucaaaaaggaagugcaacauuacacggagaaauaagcacauuagaaaacuguggaaggcuagaaggaaaaguauauaaagauacaacauuauauacaacauuaaguccaugugacaugugcacaggagcaauaauaauguauggaauaccaagauguguaguaggagaaaauguaaauuuuaaaaguaaaggagaaaaauauuuacaaacaagaggacaugaaguaguaguaguagaugacgaaagauguaaaaaaauaaugaaacaauuuauagaugaaagaccacaagauugguuugaagauauaggagaauaa

SEQ ID NO: 6145 - protein, 158 aa, Artificial Sequence; identical to SEQ ID NO: 5385
  Cytosine_Deaminase_fcy1__Saccharomyces_cerevisiae__Q12178

SEQ ID NO: 6146 - RNA, 477 nt, Artificial Sequence
  Cytosine_Deaminase_fcy1__Saccharomyces_cerevisiae__AAB67713
auggugacagggggaauggcaagcaagugggaucagaaggguauggacauugccuaugaggaggcggccuuagguuacaaagagggugguguuccuauuggcggaugucuuaucaauaacaaagacggaaguguucucggucguggucacaacaugagauuucaaaaggguuccgccacacuacauggugagaucuccacuuuggaaaacugugggagauuagagggcaaaguguacaaagauaccacuuuguauacgacgcugucuccaugcgacauguguacaggugccaucaucauguaugguauuccacgcuguguugucggugagaacguuaauuucaaaaguaagggcgagaaauauuuacaaacuagaggucacgagguuguuguuguugacgaugagagguguaaaaagaucaugaaacaauuuaucgaugaaagaccucaggauugguuugaagauauuggugaguag

SEQ ID NO: 6147 - RNA, 477 nt, Artificial Sequence; identical to SEQ ID NO: 5387
  derived and/or modified sequence opt1 from Cytosine_Deaminase_fcy1__Saccharomyces_cerevisiae__AAB67713

SEQ ID NO: 6148 - RNA, 477 nt, Artificial Sequence; identical to SEQ ID NO: 5388
  derived and/or modified sequence opt2 from Cytosine_Deaminase_fcy1__Saccharomyces_cerevisiae__AAB67713

SEQ ID NO: 6149 - RNA, 477 nt, Artificial Sequence; identical to SEQ ID NO: 5389
  derived and/or modified sequence opt3 from Cytosine_Deaminase_fcy1__Saccharomyces_cerevisiae__AAB67713

SEQ ID NO: 6150 - RNA, 477 nt, Artificial Sequence; identical to SEQ ID NO: 5390
  derived and/or modified sequence opt4 from Cytosine_Deaminase_fcy1__Saccharomyces_cerevisiae__AAB67713

SEQ ID NO: 6151 - RNA, 477 nt, Artificial Sequence; identical to SEQ ID NO: 5391
  derived and/or modified sequence opt5 from Cytosine_Deaminase_fcy1__Saccharomyces_cerevisiae__AAB67713

SEQ ID NO: 6152 - RNA, 477 nt, Artificial Sequence
  derived and/or modified sequence opt6 from Cytosine_Deaminase_fcy1__Saccharomyces_cerevisiae__AAB67713
augguaacaggaggaauggcaagcaaaugggaucaaaaaggaauggacauagcauaugaagaagcagcgcuaggauauaaagaaggaggaguaccaauaggaggaugcuuaauaaauaacaaagacggaagcguacuaggaagaggacauaauaugagauuccaaaaaggaagugcaacauuacacggagaaauaagcacacuagaaaacuguggaagacuagaaggaaaaguauauaaagauacaacacuauauacaacauuaucaccaugugacaugugcacaggagcaauaauaauguacggaauaccaagauguguaguaggagaaaauguaaauuucaaaagcaaaggagaaaaauaucuacaaacaagaggacaugaaguaguaguaguagaugacgaaagauguaaaaaaauaaugaaacaauuuauagacgaaagaccacaagauugguuugaagauauaggagaauaa

SEQ ID NO: 6153 - protein, 158 aa, Artificial Sequence; identical to SEQ ID NO: 5385
  Cytosine_Deaminase_fcy1__Saccharomyces_cerevisiae__W7PK48

SEQ ID NO: 6154 - RNA, 477 nt, Artificial Sequence; identical to SEQ ID NO: 5386
  Cytosine_Deaminase_fcy1__Saccharomyces_cerevisiae__EWG82851

SEQ ID NO: 6155 - RNA, 477 nt, Artificial Sequence; identical to SEQ ID NO: 5387
  derived and/or modified sequence opt1 from Cytosine_Deaminase_fcy1__Saccharomyces_cerevisiae__EWG82851

SEQ ID NO: 6156 - RNA, 477 nt, Artificial Sequence; identical to SEQ ID NO: 5388
  derived and/or modified sequence opt2 from Cytosine_Deaminase_fcy1__Saccharomyces_cerevisiae__EWG82851

SEQ ID NO: 6157 - RNA, 477 nt, Artificial Sequence; identical to SEQ ID NO: 5389
  derived and/or modified sequence opt3 from Cytosine_Deaminase_fcy1__Saccharomyces_cerevisiae__EWG82851

SEQ ID NO: 6158 - RNA, 477 nt, Artificial Sequence; identical to SEQ ID NO: 5390
  derived and/or modified sequence opt4 from Cytosine_Deaminase_fcy1__Saccharomyces_cerevisiae__EWG82851

SEQ ID NO: 6159 - RNA, 477 nt, Artificial Sequence; identical to SEQ ID NO: 5391
  derived and/or modified sequence opt5 from Cytosine_Deaminase_fcy1__Saccharomyces_cerevisiae__EWG82851

SEQ ID NO: 6160 - RNA, 477 nt, Artificial Sequence
  derived and/or modified sequence opt6 from Cytosine_Deaminase_fcy1__Saccharomyces_cerevisiae__EWG82851
augguaacaggaggaauggcaaguaaaugggaucaaaaaggaauggauauagcauaugaagaagcagcauuaggauauaaagaaggaggaguaccaauaggaggauguuuaauaaauaauaaagauggaaguguauuaggaaggggacauaauaugagauuucaaaaaggaagugcaacauuacauggggaaauaaguacauuagaaaauuguggaagauuagaaggaaaaguauauaaagauacaacguuauauacaacauuaaguccaugugauauguguacaggagcaauaauaauguauggaauaccaagaugcguaguaggagaaaauguaaauuuuaaaaguaaaggagaaaaauauuuacaaacaagaggacaugaaguaguaguaguagaugaugaaagauguaaaaaaauaaugaaacaauuuauagaugaaagaccacaagauugguuugaagauauaggagaauaa

SEQ ID NO: 6161 - protein, 158 aa, Artificial Sequence; identical to SEQ ID NO: 5385
  Cytosine_Deaminase_fcy1__Saccharomyces_cerevisiae__W7R647

SEQ ID NO: 6162 - RNA, 477 nt, Artificial Sequence; identical to SEQ ID NO: 5386
  Cytosine_Deaminase_fcy1__Saccharomyces_cerevisiae__EWH15533

SEQ ID NO: 6163 - RNA, 477 nt, Artificial Sequence; identical to SEQ ID NO: 5387
  derived and/or modified sequence opt1 from Cytosine_Deaminase_fcy1__Saccharomyces_cerevisiae__EWH15533

SEQ ID NO: 6164 - RNA, 477 nt, Artificial Sequence; identical to SEQ ID NO: 5388
  derived and/or modified sequence opt2 from Cytosine_Deaminase_fcy1__Saccharomyces_cerevisiae__EWH15533

SEQ ID NO: 6165 - RNA, 477 nt, Artificial Sequence; identical to SEQ ID NO: 5389
  derived and/or modified sequence opt3 from Cytosine_Deaminase_fcy1__Saccharomyces_cerevisiae__EWH15533

SEQ ID NO: 6166 - RNA, 477 nt, Artificial Sequence; identical to SEQ ID NO: 5390
  derived and/or modified sequence opt4 from Cytosine_Deaminase_fcy1__Saccharomyces_cerevisiae__EWH15533

SEQ ID NO: 6167 - RNA, 477 nt, Artificial Sequence; identical to SEQ ID NO: 5391
  derived and/or modified sequence opt5 from Cytosine_Deaminase_fcy1__Saccharomyces_cerevisiae__EWH15533

SEQ ID NO: 6168 - RNA, 477 nt, Artificial Sequence
  derived and/or modified sequence opt6 from Cytosine_Deaminase_fcy1__Saccharomyces_cerevisiae__EWH15533
augguaacaggaggaauggcaaguaaaugggaucaaaaaggaauggacauagcauaugaagaagcagcauuaggauauaaagaaggaggaguaccaauaggaggauguuuaauaaauaauaaagacggaaguguauuaggaagaggacauaauaugagauuucaaaaaggaagugcaacauuacacggagaaauaaguacacuagaaaacuguggaagacuagaaggaaaaguauauaaagauacaacauuauauacaacauuaaguccaugugacaugugcacaggagcaauaauaauguauggaauaccaagauguguaguaggagaaaauguaaauuuuaaaagcaaaggagaaaaauauuuacaaacaagaggacaugaaguaguaguaguagaugacgaaagauguaaaaaaauaaugaaacaauuuauagaugaaagaccgcaagauugguuugaagauauaggagaauaa

SEQ ID NO: 6169 - protein, 260 aa, Artificial Sequence [sequence omitted]

SEQ ID NO: 6170 - RNA, 783 nt, Artificial Sequence
  Deoxy-cytidine_Kinase_dCK__Homo_sapiens__AAA35752
auggccaccccgcccaagagaagcugcccgucuuucucagccagcucugaggggacccgcaucaagaaaaucuccaucgaagggaacaucgcugcagggaagucaacauuugugaauauccuuaaacaauugugugaagauugggaagugguuccugaaccuguugccagauggugcaauguucaaaguacucaagaugaauuugaggaacuuacaaugucucagaaaaauggugggaauguucuucagaugauguaugagaaaccugaacgauggucuuuuaccuuccaaacauaugccugucucagucgaauaagagcucagcuugccucucugaauggcaagcucaaagaugcagagaaaccuguauuauuuuuugaacgaucuguguauagugacagguauauuuuugcaucuaauuuguaugaaucugaaugcaugaaugagacagaguggacaauuuaucaagacuggcaugacuggaugaauaaccaauuuggccaaagccuugaauuggauggaaucauuuaucuucaagccacuccagagacaugcuuacauagaauauauuuacggggaagaaaugaagagcaaggcauuccucuugaauauuuagagaagcuucauuauaaacaugaaagcuggcuccugcauaggacacugaaaaccaacuucgauuaucuucaagaggugccuaucuuaacacuggauguuaaugaagacuuuaaagacaaauaugaaagucugguugaaaaggucaaagaguuuuugaguacuuuguga

SEQ ID NO: 6171 - RNA, 783 nt, Artificial Sequence
  derived and/or modified sequence opt1 from Deoxy-cytidine_Kinase_dCK__Homo_sapiens__AAA35752
auggccacgcccccgaagcgcagcugccccuccuucagcgccuccagcgagggcacccggaucaagaagaucuccaucgaggggaacaucgcggccggcaagagcaccuucgugaacauccugaagcagcucugcgaggacugggaggucgugcccgagcccguggcccgcuggugcaacguccaguccacccaggacgaguucgaggagcugaccaugagccagaagaacgggggcaacgugcugcagaugauguacgagaagccggagcggugguccuucaccuuccagacguacgccugccucagccgcauccgggcccagcuggcgucccugaacgggaagcucaaggacgccgagaagcccgugcuguucuucgagcgcagcgucuacuccgaccgguacaucuucgccagcaaccuguacgaguccgagugcaugaacgagaccgaguggaccaucuaccaggacuggcacgacuggaugaacaaccaguucggccagagccucgagcuggacggcaucaucuaccugcaggccacccccgagacgugccuccaccgcaucuaccugcgggggcgcaacgaggagcagggcaucccccuggaguaccucgagaagcugcacuacaagcacgaguccuggcugcuccaccggacccugaagaccaacuucgacuaccugcaggaggugccgauccucacccuggacgugaacgaggacuucaaggacaaguacgagagccuggucgagaaggugaaggaguuccucuccacgcuguga

SEQ ID NO: 6172 - RNA, 783 nt, Artificial Sequence
  derived and/or modified sequence opt2 from Deoxy-cytidine_Kinase_dCK__Homo_sapiens__AAA35752
auggccaccccccccaagcgcuccugccccuccuucuccgccuccuccgagggcacccgcaucaagaagaucuccaucgagggcaacaucgccgccggcaaguccaccuucgucaacauccucaagcagcucugcgaggacugggaggucguccccgagcccgucgcccgcuggugcaacguccaguccacccaggacgaguucgaggagcucaccaugucccagaagaacggcggcaacguccuccagaugauguacgagaagcccgagcgcugguccuucaccuuccagaccuacgccugccucucccgcauccgcgcccagcucgccucccucaacggcaagcucaaggacgccgagaagcccguccucuucuucgagcgcuccgucuacuccgaccgcuacaucuucgccuccaaccucuacgaguccgagugcaugaacgagaccgaguggaccaucuaccaggacuggcacgacuggaugaacaaccaguucggccagucccucgagcucgacggcaucaucuaccuccaggccacccccgagaccugccuccaccgcaucuaccuccgcggccgcaacgaggagcagggcaucccccucgaguaccucgagaagcuccacuacaagcacgaguccuggcuccuccaccgcacccucaagaccaacuucgacuaccuccaggagguccccauccucacccucgacgucaacgaggacuucaaggacaaguacgagucccucgucgagaaggucaaggaguuccucuccacccucuga

SEQ ID NO: 6173 - RNA, 783 nt, Artificial Sequence
  derived and/or modified sequence opt3 from Deoxy-cytidine_Kinase_dCK__Homo_sapiens__AAA35752
auggccacacccccuaagagaagcugcccauccuucucugcuucaagugagggcaccaggaucaaaaagauuagcauagaagggaacaucgcagccggaaaauccacuuuugugaauauucugaagcagcucugugaggacugggaagucguuccggagcccguggcgcgguggugcaacguacaaucuacgcaggaugaauuugaggagcuuaccaugucgcagaaaaaugguggcaacgugcugcagaugauguacgaaaagccugagcgcuggucauucacauuccaaacuuaugcuuguuugagccgaauccgugcccaguuagcaagucugaaugggaagcuaaaagacgccgaaaagccaguccucuuuuucgagagauccguguacucugauagguauauuuuugcuagcaaccuguacgaguccgaaugcaugaaugagaccgaauggacaaucuaucaggacuggcacgauuggaugaacaaucaguucggacaaucacuugagcuggacggcauaaucuacuugcaggcaacccccgaaacuugucuccaucggauuuaucugcgcgguagaaacgaggagcaggggaucccucuggaauaccucgagaaauuacacuacaagcaugaaaguuggcugcuucacaggacauugaaaaccaauuuugauuaucugcaggagguuccaauucuaacgcucgacgugaacgaagauuucaaggacaaguacgagagccuggucgagaaagugaaggaauuucuuucuacucuguga

SEQ ID NO: 6174 - RNA, 783 nt, Artificial Sequence
  derived and/or modified sequence opt4 from Deoxy-cytidine_Kinase_dCK__Homo_sapiens__AAA35752
auggccaccccccccaagagaagcugccccagcuucagcgccagcagcgagggcaccagaaucaagaagaucagcaucgagggcaacaucgccgccggcaagagcaccuucgugaacauccugaagcagcugugcgaggacugggagguggugcccgagcccguggccagauggugcaacgugcagagcacccaggacgaguucgaggagcugaccaugagccagaagaacggcggcaacgugcugcagaugauguacgagaagcccgagagauggagcuucaccuuccagaccuacgccugccugagcagaaucagagcccagcuggccagccugaacggcaagcugaaggacgccgagaagcccgugcuguucuucgagagaagcguguacagcgacagauacaucuucgccagcaaccuguacgagagcgagugcaugaacgagaccgaguggaccaucuaccaggacuggcacgacuggaugaacaaccaguucggccagagccuggagcuggacggcaucaucuaccugcaggccacccccgagaccugccugcacagaaucuaccugagaggcagaaacgaggagcagggcaucccccuggaguaccuggagaagcugcacuacaagcacgagagcuggcugcugcacagaacccugaagaccaacuucgacuaccugcaggaggugcccauccugacccuggacgugaacgaggacuucaaggacaaguacgagagccugguggagaaggugaaggaguuccugagcacccuguga

SEQ ID NO: 6175 - RNA, 783 nt, Artificial Sequence
  derived and/or modified sequence opt5 from Deoxy-cytidine_Kinase_dCK__Homo_sapiens__AAA35752
auggccacacccccuaagagaagcugcccguccuucucugcuagcuccgagggcacccggaucaaaaagauuucuaucgaagggaacauugccgcgggaaaaagcacguuugugaauauccugaagcagcucugugaggacugggaagucguucccgagccuguggcucgcuggugcaacgugcaauccacccaggaugaauuugaggagcugacaaugucucagaaaaauggcgggaacguccuucagaugauguacgaaaagcccgagagauggagcuucaccuuccaaacauaugccugucugucccggauucgcgcccagcucgcuagccugaauggaaaacuuaaggacgccgaaaagccugugcuguuuuucgagagaucuguuuacuccgaucgguauaucuuugcuagcaaccucuacgagucugaaugcaugaaugagaccgaauggacaaucuaucaggacuggcacgauuggaugaacaaucaguucggccaaucccuggagcuggacgggauuaucuaccuccaggccacccccgaaacgugucugcaucgcauuuaucuuagaggacggaacgaggagcagggcaucccucuggaauaccucgagaaacugcacuacaagcaugaaagcuggcuucugcaccgcacccucaaaacaaauuuugauuaucugcaggaggugccgauucugacccucgacgucaacgaagauuucaaggacaaguacgagucucugguggagaaaguuaaggaauuucuuuccacacuguga

SEQ ID NO: 6176 - RNA, 783 nt, Artificial Sequence
  derived and/or modified sequence opt6 from Deoxy-cytidine_Kinase_dCK__Homo_sapiens__AAA35752
auggcaacaccaccaaaaagaagcugcccaucauucucagcaucaucagaaggcacaagaauaaaaaaaauaaguauagaaggaaauauagcagcaggaaaaucaacauucguaaacauacuaaaacaauuaugcgaagacugggaaguaguaccagaaccaguagcaagauggugcaacguacaaucaacacaagaugaauucgaagaacuaacaaugagccaaaaaaacggaggaaacguccuacaaaugauguacgaaaaaccagaaagauggucauucacauuccaaacauacgcaugccuaucaagaauaagagcacaacuagcaucccuaaacggaaaacuaaaagacgccgaaaaaccaguacuauucuucgaaagaucaguauacagcgacagauacauauucgcaucaaacuuauaugaaagcgaaugcaugaaugaaacagaauggacaauauaccaagauuggcacgacuggaugaauaaccaauucggacaaucacuagaauuagauggaauaauauauuuacaagcaacaccagaaacaugucuacacagaauauaccuaagaggaagaaacgaagaacaaggaauaccacuagaauacuuagaaaaauuacacuacaaacacgaaucauggcuauuacacagaacacuaaaaacaaauuucgauuaccuacaagaaguaccaauacuaacacuagacguaaacgaagacuucaaagacaaauacgaaucacuaguagaaaaaguaaaagaauucuuaucaacacuauaa

SEQ ID NO: 6177 - protein, 250 aa, Artificial Sequence
  Deoxynucleoside_Kinase_dNK__Drosophila_melanogaster__Q540Z9
MAEAASCARKGTKYAEGTQPFTVLIEGNIGSGKTTYLNHFEKYKNDICLLTEPVEKWRNVNGVNLLELMYKDPKKWAMPFQSYVTLTMLQSHTAPTNKKLKIMERSIFSARYCFVENMRRNGSLEQGMYNTLEEWYKFIEESIHVQADLIIYLRTSPEVAYERIRQRARSEESCVPLKYLQELHELHEDWLIHQRRPQSCKVLVLDADLNLENIGTEYQRSESSIFDAISSNQQPSPVLVSPSKRQRVAR

SEQ ID NO: 6178 - RNA, 753 nt, Artificial Sequence
  Deoxynucleoside_Kinase_dNK__Drosophila_melanogaster__AAM27518
auggcggaggcagcauccugugcccgaaaggggaccaaguacgccgagggcacccagcccuucaccguccucaucgagggcaacaucggcagcgggaagaccacguauuugaaccacuucgagaaguacaagaacgacauuugccugcugaccgagcccgucgagaaguggcgcaacgucaacgggguaaaucugcuggagcugauguacaaagaucccaagaagugggccaugcccuuucagaguuaugucacgcugaccaugcugcagucgcacaccgccccaaccaacaagaagcuaaaaauaauggagcgcuccauuuuuagcgcucgcuauugcuucguggagaacaugcgacgaaacggcucgcuggagcagggcauguacaauacgcuggaggagugguacaaguucaucgaagaguccauucacgugcaggcggaccucaucauauaucugcgcaccucgccggagguggcguacgaacgcauccggcagcgggcucguucugaggagagcugcgugccgcuuaaguaccuucaggagcugcaugaguugcacgaggacugguugauacaccagagacgaccgcagucgugcaagguccuaguccucgaugccgaucugaaccuggaaaacauuggcaccgaguaccagcgcucggagagcagcauauucgacgccaucucaaguaaccaacagcccucgccgguucuggugucgcccagcaagcgccagagggucgccagauaa

SEQ ID NO: 6179 - RNA, 753 nt, Artificial Sequence
  derived and/or modified sequence opt1 from Deoxynucleoside_Kinase_dNK__Drosophila_melanogaster__AAM27518
auggccgaggccgcgagcugcgcccgcaagggcaccaaguacgccgaggggacccagcccuucacggugcugaucgagggcaacaucggguccggcaagaccaccuaccucaaccacuucgagaaguacaagaacgacaucugccugcugaccgagccggucgagaaguggcggaacgugaacggggugaaccuccuggagcugauguacaaggaccccaagaagugggccaugcccuuccagagcuacgucacgcucaccaugcugcagucccacaccgcccccaccaacaagaagcugaagaucauggagcgcagcaucuucuccgcgcgguacugcuucguggagaacaugcgccggaacggcagccucgagcagggcauguacaacacgcuggaggagugguacaaguucaucgaggaguccauccacgugcaggccgaccugaucaucuaccuccgcaccagcccggaggucgccuacgagcggauccgccagcgggcccgcuccgaggagagcugcgugccccugaaguaccugcaggagcuccacgagcugcacgaggacuggcugauccaccagcggcgcccccaguccugcaaggugcucguccuggacgcggaccugaaccucgagaacaucgggaccgaguaccagcggagcgaguccagcaucuucgacgccaucuccagcaaccagcagcccuccccggugcuggugagccccuccaagcgccagcgggucgcccgcuga

SEQ ID NO: 6180 - RNA, 753 nt, Artificial Sequence
  derived and/or modified sequence opt2 from Deoxynucleoside_Kinase_dNK__Drosophila_melanogaster__AAM27518
auggccgaggccgccuccugcgcccgcaagggcaccaaguacgccgagggcacccagcccuucaccguccucaucgagggcaacaucggcuccggcaagaccaccuaccucaaccacuucgagaaguacaagaacgacaucugccuccucaccgagcccgucgagaaguggcgcaacgucaacggcgucaaccuccucgagcucauguacaaggaccccaagaagugggccaugcccuuccaguccuacgucacccucaccaugcuccagucccacaccgcccccaccaacaagaagcucaagaucauggagcgcuccaucuucuccgcccgcuacugcuucgucgagaacaugcgccgcaacggcucccucgagcagggcauguacaacacccucgaggagugguacaaguucaucgaggaguccauccacguccaggccgaccucaucaucuaccuccgcaccucccccgaggucgccuacgagcgcauccgccagcgcgcccgcuccgaggaguccugcgucccccucaaguaccuccaggagcuccacgagcuccacgaggacuggcucauccaccagcgccgcccccaguccugcaagguccucguccucgacgccgaccucaaccucgagaacaucggcaccgaguaccagcgcuccgaguccuccaucuucgacgccaucuccuccaaccagcagcccucccccguccucgucucccccuccaagcgccagcgcgucgcccgcuga

SEQ ID NO: 6181 - RNA, 753 nt, Artificial Sequence
  derived and/or modified sequence opt3 from Deoxynucleoside_Kinase_dNK__Drosophila_melanogaster__AAM27518
auggccgaggcugcaagcugcgccagaaagggcaccaaauacgcggaagggacacagcccuucacugugcugaucgagggaaacauugguuccggcaagacgaccuaucucaaucacuuugaaaaauacaagaacgacauaugucuucugacagagccugucgaaaaauggaggaauguuaacggggugaauuuguuagagcugauguauaaggauccaaagaaaugggcuaugccguuccaaucuuacguaacucuaaccaugcuccagucacauacagcccccaccaacaagaaacugaagaucauggagcggaguauuuuuagcgcacgcuauugcuucguggaaaauaugcgacguaacggaucccuugagcagggcauguacaauacucuggaagagugguauaaauuuaucgaggaaucuauucacguccaggccgacuugaucauauaccucagaacaucgccugagguggcuuacgaaaggauccggcaacgcgcaagaucagaggaaagcuguguuccacugaaguaucugcaggagcuccaugaguuacacgaagauuggcugauucaucagaggcggccccagaguugcaaggugcuugucuuggacgccgaucugaaccuagagaauaucgguaccgaauaccaacgcuccgagucuagcauuuucgacgcuaucuccucaaaccagcagccuaguccagugcucguaagccccucuaaacgacagagaguugccagguga

SEQ ID NO: 6182 - RNA, 753 nt, Artificial Sequence
  derived and/or modified sequence opt4 from Deoxynucleoside_Kinase_dNK__Drosophila_melanogaster__AAM27518
auggccgaggccgccagcugcgccagaaagggcaccaaguacgccgagggcacccagcccuucaccgugcugaucgagggcaacaucggcagcggcaagaccaccuaccugaaccacuucgagaaguacaagaacgacaucugccugcugaccgagcccguggagaaguggagaaacgugaacggcgugaaccugcuggagcugauguacaaggaccccaagaagugggccaugcccuuccagagcuacgugacccugaccaugcugcagagccacaccgcccccaccaacaagaagcugaagaucauggagagaagcaucuucagcgccagauacugcuucguggagaacaugagaagaaacggcagccuggagcagggcauguacaacacccuggaggagugguacaaguucaucgaggagagcauccacgugcaggccgaccugaucaucuaccugagaaccagccccgagguggccuacgagagaaucagacagagagccagaagcgaggagagcugcgugccccugaaguaccugcaggagcugcacgagcugcacgaggacuggcugauccaccagagaagaccccagagcugcaaggugcuggugcuggacgccgaccugaaccuggagaacaucggcaccgaguaccagagaagcgagagcagcaucuucgacgccaucagcagcaaccagcagcccagccccgugcuggugagccccagcaagagacagagaguggccagauga

SEQ ID NO: 6183 - RNA, 753 nt, Artificial Sequence
  derived and/or modified sequence opt5 from Deoxynucleoside_Kinase_dNK__Drosophila_melanogaster__AAM27518
auggccgaggcugccagcugcgcgagaaagggcaccaaauacgcugaagggacacagcccuucacggugcugaucgagggaaacauuggcuccgggaagaccacauaucucaaucacuuugaaaaauacaagaacgacaucugucugcuuaccgagccugucgaaaaauggcggaauguuaacggagugaaucugcucgagcugauguauaaggauccgaagaaaugggccaugcccuuccaaucuuacgugacacuuaccaugcugcagagccauacagccccuaccaacaagaaacucaagauuauggagcgcuccaucuuuucugcuagauauugcuucgucgaaaauaugcggcgcaacggcagccuggagcaggggauguacaauacgcuggaagagugguauaaauuuauugaggaauccauccacgugcaggccgaccucaucauuuaccugagaaccucucccgagguugcuuacgaacggauccgccaaagagcccggagcgaggaauccugugugccucuuaaguaucugcaggagcuccaugagcugcacgaagauuggcuuauucaucagcgcagaccccagagcugcaagguccuggugcucgacgcggaucugaaccuggagaauaucggaacagaauaccaacggucugaguccagcauuuucgacgccaucucuuccaaccagcagccuagcccgguucucgugucucccuccaaacgccagagagucgcucgguga

SEQ ID NO: 6184 - RNA, 753 nt, Artificial Sequence
  derived and/or modified sequence opt6 from Deoxynucleoside_Kinase_dNK__Drosophila_melanogaster__AAM27518
auggcagaagcagcaucaugcgcaagaaaaggaacaaaauacgcagaaggcacacaaccauucacaguauuaauagaaggaaacauaggaucaggaaaaacaacauaccuaaaccauuucgaaaaauacaaaaacgacauaugccuacuaaccgaaccaguagaaaaauggagaaacguaaacggaguaaaccuacuagaacuaauguacaaagacccaaaaaaaugggcaaugccauuccaaucauacgucacacuaacaauguuacaaucacacaccgccccaacaaacaaaaaauuaaaaauaauggaaagaucaauauucagcgcaagauacugcuuuguagaaaacaugagaagaaacggaucacuugaacaaggcauguauaacacacuagaagaaugguacaaauucaucgaagaaucaauacauguccaagccgaccuaauaauauauuuaagaaccucaccagaaguagcauacgaaagaauaagacaaagagcaagaucugaagaaagcugcguaccauuaaaauaccuacaagaacuacacgaauuacacgaagacuggcuaauacaccaaagaagaccacaaucauguaaaguacuaguacuagacgcagacuuaaaccuagaaaacauaggaacagaauaccaaagaucagaaucaucaauauucgacgcaauaucaucaaaccaacaaccaucaccaguacuaguaucaccaucaaaaagacaaagagucgccagauaa

SEQ ID NO: 6185 - protein, 250 aa, Artificial Sequence; identical to SEQ ID NO: 6177
  Deoxynucleoside_Kinase_dNK__Drosophila_melanogaster__Q9XZT6

SEQ ID NO: 6186 - RNA, 753 nt, Artificial Sequence; identical to SEQ ID NO: 6178
  Deoxynucleoside_Kinase_dNK__Drosophila_melanogaster__AAD47355

SEQ ID NO: 6187 - RNA, 753 nt, Artificial Sequence; identical to SEQ ID NO: 6179
  derived and/or modified sequence opt1 from Deoxynucleoside_Kinase_dNK__Drosophila_melanogaster__AAD47355

SEQ ID NO: 6188 - RNA, 753 nt, Artificial Sequence; identical to SEQ ID NO: 6180
  derived and/or modified sequence opt2 from Deoxynucleoside_Kinase_dNK__Drosophila_melanogaster__AAD47355

SEQ ID NO: 6189 - RNA, 753 nt, Artificial Sequence; identical to SEQ ID NO: 6181
  derived and/or modified sequence opt3 from Deoxynucleoside_Kinase_dNK__Drosophila_melanogaster__AAD47355

SEQ ID NO: 6190 - RNA, 753 nt, Artificial Sequence; identical to SEQ ID NO: 6182
  derived and/or modified sequence opt4 from Deoxynucleoside_Kinase_dNK__Drosophila_melanogaster__AAD47355

SEQ ID NO: 6191 - RNA, 753 nt, Artificial Sequence; identical to SEQ ID NO: 6183
  derived and/or modified sequence opt5 from Deoxynucleoside_Kinase_dNK__Drosophila_melanogaster__AAD47355

SEQ ID NO: 6192 - RNA, 753 nt, Artificial Sequence
  derived and/or modified sequence opt6 from Deoxynucleoside_Kinase_dNK__Drosophila_melanogaster__AAD47355
auggcagaagcagcaucaugcgcaagaaaaggaacuaaauacgcagaaggcacacaaccauucacaguauuaauagaaggaaacauaggaagcggaaaaacaacauacuuaaaccacuucgaaaaauauaaaaacgacauaugccuacuaacugaaccaguagaaaaauggagaaacguaaacggaguaaacuuacuagaacuaauguacaaagacccuaaaaaaugggcaaugccauuccaaucauacguaacacuaacaaugcuacaaucacauacagcaccaacaaacaaaaaacuaaaaauaauggaaagaaguauauucucagcaagauauugcuucguagaaaacaugagaagaaacggaagccuagaacaaggaauguacaacacauuagaagaaugguacaaauucauagaagaaucaauacacguacaagccgaccuaauaauauaccuaagaacaucaccagaaguagcauacgaaagaauaagacaaagagcaagaagcgaagaaagcugcguaccauuaaaauaccuacaagaacuacacgaacuacacgaagacuggcuaauacaccaaagaagaccacaaaguugcaaaguauuaguauuagacgcagaccuaaaucuagaaaacauaggaacagaauaucaaagaucagaaucaaguauauucgacgcaauaucaucaaaccaacaaccaucaccaguacuaguaucacccucaaaaagacaaagaguagcaagauaa

SEQ ID NO: 6193 - protein, 239 aa, Artificial Sequence
  Purine_Nucleoside_Phosphorylase_deoD__Escherichia_coli_ _A0A023Z7B9
MATPHINAEMGDFADVVLMPGDPLRAKYIAETFLEDAREVNNVRGMLGFTGTYKGRKISVMGHGMGIPSCSIYTKELITDFGVKKIIRVGSCGAVLPHVKLRDVVIGMGACTDSKVNRIRFKDHDFAAIADFDMVRNAVDAAKALGIDARVGNLFSADLFYSPDGEMFDVMEKYGILGVEMEAAGIYGVAAEFGAKALTICTVSDHIRTHEQTTAAERQTTFNDMIKIALESVLLGDKE

SEQ ID NO: 6194 - RNA, 720 nt, Artificial Sequence
  Purine_Nucleoside_Phosphorylase_deoD__Escherichia_coli__AHY74112
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccgcauccguuuuaaagaccaugacuuugccgcuaucgcugacuucgacauggugcguaacgcaguagaugcagcuaaagcacugggcauugaugcucgcguggguaaccuguucuccgcugaccuguucuacucuccggacggcgaaauguucgacgugauggaaaaauacggcauucucggcguggaaauggaagcggcugguaucuacggcgucgcugcagaauuuggcgcgaaagcccugaccaucugcaccguaucugaccacauccgcacucacgagcagaccacugccgcugagcgucagaccaccuucaacgacaugaucaaaaucgcacuggaauccguucugcugggcgauaaagaguaa

SEQ ID NO: 6195 - RNA, 720 nt, Artificial Sequence
  derived and/or modified sequence opt1 from Purine_Nucleoside_Phosphorylase_deoD__Escherichia_coli__AHY74112
auggccacgccccacaucaacgccgagaugggcgacuucgcggacgugguccugaugccgggggacccccuccgcgccaaguacaucgccgagaccuuccuggaggacgcccgggaggugaacaacgugcgcggcaugcugggguucaccggcaccuacaaggggcggaagaucagcgucaugggccacggcauggggauccccuccugcagcaucuacaccaaggagcucaucaccgacuucggcgugaagaagaucauccgcgugggguccugcggcgccguccugccccacgugaagcugcgggacguggucaucgggaugggcgcgugcacggacagcaaggugaaccgcauccgguucaaggaccacgacuucgccgccaucgccgacuucgacauggugcgcaacgcggucgacgccgccaaggcccucggcaucgacgcccggguggggaaccuguucuccgcggaccuguucuacagcccggacggcgagauguucgacgugauggagaaguacgggauccucggcgucgagauggaggccgccggcaucuacgggguggccgccgaguucggcgcgaaggcccugaccaucugcaccguguccgaccacauccgcacccacgagcagacgaccgccgccgagcggcagaccaccuucaacgacaugaucaagaucgcccuggagagcguccuccugggggacaaggaguga

SEQ ID NO: 6196 - RNA, 720 nt, Artificial Sequence
  derived and/or modified sequence opt2 from Purine_Nucleoside_Phosphorylase_deoD__Escherichia_coli__AHY74112
auggccaccccccacaucaacgccgagaugggcgacuucgccgacgucguccucaugcccggcgacccccuccgcgccaaguacaucgccgagaccuuccucgaggacgcccgcgaggucaacaacguccgcggcaugcucggcuucaccggcaccuacaagggccgcaagaucuccgucaugggccacggcaugggcauccccuccugcuccaucuacaccaaggagcucaucaccgacuucggcgucaagaagaucauccgcgucggcuccugcggcgccguccucccccacgucaagcuccgcgacgucgucaucggcaugggcgccugcaccgacuccaaggucaaccgcauccgcuucaaggaccacgacuucgccgccaucgccgacuucgacaugguccgcaacgccgucgacgccgccaaggcccucggcaucgacgcccgcgucggcaaccucuucuccgccgaccucuucuacucccccgacggcgagauguucgacgucauggagaaguacggcauccucggcgucgagauggaggccgccggcaucuacggcgucgccgccgaguucggcgccaaggcccucaccaucugcaccgucuccgaccacauccgcacccacgagcagaccaccgccgccgagcgccagaccaccuucaacgacaugaucaagaucgcccucgaguccguccuccucggcgacaaggaguga

SEQ ID NO: 6197 - RNA, 720 nt, Artificial Sequence
  derived and/or modified sequence opt3 from Purine_Nucleoside_Phosphorylase_deoD__Escherichia_coli__AHY74112
auggccacaccccacaucaacgcugagaugggcgacuucgcagaugugguccugaugccuggggacccacucagagccaaguacauugcggaaaccuuucuugaggaugcuagggaaguuaauaacgugcggggaaugcuggguuucacuggcacguauaaagggcgcaagauaagcguaaugggacauggcauggguaucccguccugcucuauuuacaccaaagaguugaucacagacuuuggggugaagaaaauuauccgagucggaucauguggcgccguguuaccccacguuaagcugcgugauguggucauaggcaugggggcaugcacugacaguaaggugaauagaaucagguucaaagaucaugacuuugccgcuauugcagauuucgacaugguacggaacgccguugaugcugccaaggcgcuaggaaucgacgcacgcguggguaaucucuuuagcgccgaucuguucuauuccccugacggcgaaauguuugacgucauggagaaauacgggauucuuggaguggagauggaagcugccggcaucuaugguguggcagcugaguucggggccaaggcgcugaccauauguacagucucugaucacauuagaacccaugaacagacuacagccgcagagaggcaaaccacguuuaacgacaugaucaaaauugcuuuggagucgguucuccugggagauaaggaauga

SEQ ID NO: 6198 - RNA, 720 nt, Artificial Sequence
  derived and/or modified sequence opt4 from Purine_Nucleoside_Phosphorylase_deoD__Escherichia_coli__AHY74112
auggccaccccccacaucaacgccgagaugggcgacuucgccgacguggugcugaugcccggcgacccccugagagccaaguacaucgccgagaccuuccuggaggacgccagagaggugaacaacgugagaggcaugcugggcuucaccggcaccuacaagggcagaaagaucagcgugaugggccacggcaugggcauccccagcugcagcaucuacaccaaggagcugaucaccgacuucggcgugaagaagaucaucagagugggcagcugcggcgccgugcugccccacgugaagcugagagacguggugaucggcaugggcgccugcaccgacagcaaggugaacagaaucagauucaaggaccacgacuucgccgccaucgccgacuucgacauggugagaaacgccguggacgccgccaaggcccugggcaucgacgccagagugggcaaccuguucagcgccgaccuguucuacagccccgacggcgagauguucgacgugauggagaaguacggcauccugggcguggagauggaggccgccggcaucuacggcguggccgccgaguucggcgccaaggcccugaccaucugcaccgugagcgaccacaucagaacccacgagcagaccaccgccgccgagagacagaccaccuucaacgacaugaucaagaucgcccuggagagcgugcugcugggcgacaaggaguga

SEQ ID NO: 6199 - RNA, 720 nt, Artificial Sequence
  derived and/or modified sequence opt5 from Purine_Nucleoside_Phosphorylase_deoD__Escherichia_coli__AHY74112
auggccacaccccacaucaacgcugagaugggcgacuucgccgaugugguccugaugccuggggacccgcucagagcgaaguacauugcugaaaccuuucuggaggaugcccgggaaguuaauaacgugcgcggaaugcuuggcuucacggggaccuauaaaggaagaaagaucagcgugaugggccaugggaugggcauucccuccugcucuaucuacacaaaagagcugauuaccgacuuuggagucaagaaaaucauccgggugggcagcuguggggccguucucccucacgugaagcugcgcgaugucgugauuggaaugggcgcuugcacagacuccaagguuaauagaauccgguucaaagaucaugacuuugccgcuauugccgauuucgacauggugcgcaacgcggucgaugccgcuaaggcccuugggaucgacgcuagagugggaaaucuguuuucugccgaucucuucuauagccccgacggcgaaauguuugacgugauggagaaauacgggauucugggagucgagauggaagcggccggcaucuauggcguugcugccgaguucggggcuaaggcccugaccauuuguacaguguccgaucacauccggacccaugaacagacgaccgccgcugagcgccaaacaaccuuuaacgacaugaucaaaauugcgcucgagucugugcugcuuggagauaaggaauga

SEQ ID NO: 6200 - RNA, 720 nt, Artificial Sequence
  derived and/or modified sequence opt6 from Purine_Nucleoside_Phosphorylase_deoD__Escherichia_coli__AHY74112
auggcaacaccacauauaaaugcagaaaugggggacuuugcagauguaguacuaaugccaggggacccauuaagagcaaaauacauagcagaaacauuuuuagaagacgcaagagaaguaaauaacguaagaggaauguuaggauuuacaggaaccuauaaagggagaaaaauaucaguaaugggacauggaaugggcauuccaaguugcaguauauauacaaaagaauuaauaacagacuuuggaguaaaaaaaauaauaagaguaggaucauguggagcaguacuaccacacguaaaauuaagagauguaguaauaggaaugggagcauguacagauagcaaaguaaauagaauaagauuuaaagaucacgauuucgcagcaauagcagauuuugauaugguacgaaaugccguagacgcagccaaagcauuaggaauagacgcaagagugggaaaucuuuuuagcgcagacuuauuuuauagcccagacggagaaauguucgauguaauggaaaaauacggaauauuaggaguagaaauggaagcagcagggauauauggaguagcagcagaauuuggagcaaaagcacuaacaauauguaccguaagcgaccacauaagaacacacgaacaaacaacagcagcagaaagacaaacaacauucaaugacaugauaaaaauagcacuagaaaguguacuauuaggagacaaagaauaa

SEQ ID NO: 6201 - protein, 239 aa, Artificial Sequence
  Purine_Nucleoside_Phosphorylase_deoD__Escherichia_coli_ _A0A024KMI2
MATPHINAEMGDFADVVLMPGDPLRAKYIAETFLEDAREVNNVRGMLGFTGTYKGRKISVMGHGMGIPSCSIYTKELITDFGVKKIIRVGSCGAVLPHVKLRDVVIGMGACTDSKVNRIRFKDHDFAAIADFDMVRNAVDAAKALGVDARVGNLFSADLFYSPDGEMFDVMEKYGILGVEMEAAGIYGVAAEFGAKALTICTVSDHIRTHEQTTAAERQTTFNDMIKIALESVLLGDKE

SEQ ID NO: 6202 - RNA, 720 nt, Artificial Sequence
  Purine_Nucleoside_Phosphorylase_deoD__Escherichia_coli__CDU33019
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacugcgcgacgucguuaucgguaugggugccugcaccgauuccaaaguuaaccguauccguuuuaaagaccaugacuuugccgcuaucgcugacuuugacauggugcguaacgcgguagacgcggcuaaagcacuggguguugaugcucgcguggguaaccuguucuccgcugaccuguucuacucuccggacggcgaaauguucgacgugauggaaaaauacggcauccucggcguggaaauggaagcggcugguaucuacggcgucgcugcagaguuuggcgcgaaagcccugaccaucugcaccgugucugaccacauccgcacucacgagcagaccacugccgcugagcgucagaccaccuucaacgacaugaucaaaaucgcacuggaauccguucugcugggcgauaaagaguaa

SEQ ID NO: 6203 - RNA, 720 nt, Artificial Sequence
  derived and/or modified sequence opt1 from Purine_Nucleoside_Phosphorylase_deoD__Escherichia_coli__CDU33019
auggccacgccccacaucaacgccgagaugggcgacuucgcggacgugguccugaugccgggggacccccuccgcgccaaguacaucgccgagaccuuccuggaggacgcccgggaggugaacaacgugcgcggcaugcugggguucaccggcaccuacaaggggcggaagaucagcgucaugggccacggcauggggauccccuccugcagcaucuacaccaaggagcucaucaccgacuucggcgugaagaagaucauccgcgugggguccugcggcgccguccugccccacgugaagcugcgggacguggucaucgggaugggcgcgugcacggacagcaaggugaaccgcauccgguucaaggaccacgacuucgccgccaucgccgacuucgacauggugcgcaacgcggucgacgccgccaaggcccucggcguggacgcccggguggggaaccuguucuccgcggaccuguucuacagcccggacggcgagauguucgacgucauggagaaguacgggauccucggcguggagauggaggccgccggcaucuacgggguggccgccgaguucggcgcgaaggcccugaccaucugcaccgucuccgaccacauccgcacccacgagcagacgaccgccgccgagcggcagaccaccuucaacgacaugaucaagaucgcccuggagagcgugcuccugggggacaaggaguga

SEQ ID NO: 6204 - RNA, 720 nt, Artificial Sequence
  derived and/or modified sequence opt2 from Purine_Nucleoside_Phosphorylase_deoD__Escherichia_coli__CDU33019
auggccaccccccacaucaacgccgagaugggcgacuucgccgacgucguccucaugcccggcgacccccuccgcgccaaguacaucgccgagaccuuccucgaggacgcccgcgaggucaacaacguccgcggcaugcucggcuucaccggcaccuacaagggccgcaagaucuccgucaugggccacggcaugggcauccccuccugcuccaucuacaccaaggagcucaucaccgacuucggcgucaagaagaucauccgcgucggcuccugcggcgccguccucccccacgucaagcuccgcgacgucgucaucggcaugggcgccugcaccgacuccaaggucaaccgcauccgcuucaaggaccacgacuucgccgccaucgccgacuucgacaugguccgcaacgccgucgacgccgccaaggcccucggcgucgacgcccgcgucggcaaccucuucuccgccgaccucuucuacucccccgacggcgagauguucgacgucauggagaaguacggcauccucggcgucgagauggaggccgccggcaucuacggcgucgccgccgaguucggcgccaaggcccucaccaucugcaccgucuccgaccacauccgcacccacgagcagaccaccgccgccgagcgccagaccaccuucaacgacaugaucaagaucgcccucgaguccguccuccucggcgacaaggaguga

SEQ ID NO: 6205 - RNA, 720 nt, Artificial Sequence
  derived and/or modified sequence opt3 from Purine_Nucleoside_Phosphorylase_deoD__Escherichia_coli__CDU33019
auggccacaccccacaucaacgcugagaugggcgacuucgcagaugugguccugaugccuggggacccacucagagccaaguacauugcggaaaccuuucuugaggaugcuagggaaguuaauaacgugcggggaaugcuggguuucacuggcacguauaaagggcgcaagauaagcguaaugggacauggcauggguaucccguccugcucuauuuacaccaaagaguugaucacagacuuuggggugaagaaaauuauccgagucggaucauguggcgccguguuaccccacguuaagcugcgugauguggucauaggcaugggggcaugcacugacaguaaggugaauagaaucagguucaaagaucaugacuuugccgcuauugcagauuucgacaugguacggaacgccguugaugcugccaaggcgcuaggaguggacgcacgcgucgguaaucucuuuagcgccgaucuguucuauuccccugacggcgaaauguuugacgugauggagaaauacgggauccuuggaguggagauggaagcugccggcauuuauggugucgcagcugaguucggggccaaggcgcugaccaucuguacaguuucugaucacauaagaacccaugaacagacuacagccgcagagaggcaaaccacguuuaacgacaugauuaaaaucgcuuuggagucggugcuccugggagauaaggaauga

SEQ ID NO: 6206 - RNA, 720 nt, Artificial Sequence
  derived and/or modified sequence opt4 from Purine_Nucleoside_Phosphorylase_deoD__Escherichia_coli__CDU33019
auggccaccccccacaucaacgccgagaugggcgacuucgccgacguggugcugaugcccggcgacccccugagagccaaguacaucgccgagaccuuccuggaggacgccagagaggugaacaacgugagaggcaugcugggcuucaccggcaccuacaagggcagaaagaucagcgugaugggccacggcaugggcauccccagcugcagcaucuacaccaaggagcugaucaccgacuucggcgugaagaagaucaucagagugggcagcugcggcgccgugcugccccacgugaagcugagagacguggugaucggcaugggcgccugcaccgacagcaaggugaacagaaucagauucaaggaccacgacuucgccgccaucgccgacuucgacauggugagaaacgccguggacgccgccaaggcccugggcguggacgccagagugggcaaccuguucagcgccgaccuguucuacagccccgacggcgagauguucgacgugauggagaaguacggcauccugggcguggagauggaggccgccggcaucuacggcguggccgccgaguucggcgccaaggcccugaccaucugcaccgugagcgaccacaucagaacccacgagcagaccaccgccgccgagagacagaccaccuucaacgacaugaucaagaucgcccuggagagcgugcugcugggcgacaaggaguga

SEQ ID NO: 6207 - RNA, 720 nt, Artificial Sequence
  derived and/or modified sequence opt5 from Purine_Nucleoside_Phosphorylase_deoD__Escherichia_coli__CDU33019
auggccacaccccacaucaacgcugagaugggcgacuucgccgaugugguccugaugccuggggacccgcucagagcgaaguacauugcugaaaccuuucuggaggaugcccgggaaguuaauaacgugcgcggaaugcuuggcuucacggggaccuauaaaggaagaaagaucagcgugaugggccaugggaugggcauucccuccugcucuaucuacacaaaagagcugauuaccgacuuuggagucaagaaaaucauccgggugggcagcuguggggccguucucccucacgugaagcugcgcgaugucgugauuggaaugggcgcuugcacagacuccaagguuaauagaauccgguucaaagaucaugacuuugccgcuauugccgauuucgacauggugcgcaacgcggucgaugccgcuaaggcccuugggguggacgcuagagugggaaaucuguuuucugccgaucucuucuauagccccgacggcgaaauguuugacgucauggagaaauacgggauccugggaguugagauggaagcggccggcauuuauggcguggcugccgaguucggggcuaaggcccugaccaucuguacaguguccgaucacauucggacccaugaacagacgaccgccgcugagcgccaaacaaccuuuaacgacaugaucaaaaucgcgcucgagucuguccugcuuggagauaaggaauga

SEQ ID NO: 6208 - RNA, 720 nt, Artificial Sequence
  derived and/or modified sequence opt6 from Purine_Nucleoside_Phosphorylase_deoD__Escherichia_coli__CDU33019
auggcaacaccacauauaaaugcagaaaugggagacuuugcagauguaguacuaaugccaggagacccauuaagagcaaaauauauagcagaaacauuccucgaagacgcaagagaaguaaauaacguaagagggauguuaggauuuacagggacauauaaaggaagaaaaauaaguguaaugggacaugguaugggaauaccaucaugcaguauauauaccaaagaauuaauaacggacuuuggaguaaaaaaaauaauaagaguaggaucaugcggggccguacuaccacaugugaaauuaagagauguaguaauaggaaugggggcauguacagacaguaaaguaaauaggauaagauuuaaagaucacgauuucgcagcaauagcagacuucgauaugguaagaaaugcaguugacgcagcaaaagcauuaggaguagacgcaagagugggaaaucuauucagugcagacuuauucuauagcccagacggagaaauguucgauguaauggaaaaauacgggauauuaggaguggaaauggaagcagcaggaauauauggaguagcagcagaauuuggagcaaaagcguuaacaauauguacgguaagcgaucacauaagaacacacgaacaaacaacagcagcagaaagacaaacaacauucaaugauaugauaaaaauagcauuagaaaguguacuauuaggagauaaagaauga

SEQ ID NO: 6209 - protein, 235 aa, Artificial Sequence
  Purine_Nucleoside_Phosphorylase_deoD__Escherichia_coli_ _A0A0E0SRY5
MTAHINAKLGDFAPTVIMPGDPLRAKFIAENYLQDHREVTNVRNMLGYTGFYSGQLISVMGHGMGIPSMTLYAHELVNDFDVKRIIRVGSLGATQRTIKMRDIILAVASGTDSVTNFKRSSGYFMASSAYFPLLQKAWSLAQEAGLEVKAGNVFSGDIYYDPDDNLIPALEKFGVLGIDMEVAGLYALAHQFGIEALAILTVSDHCLTGEETTAEERQLTFNNMIELALNTAVAI

SEQ ID NO: 6210 - RNA, 708 nt, Artificial Sequence
  Purine_Nucleoside_Phosphorylase_deoD__Escherichia_coli__ACD54493
augacugcacauauaaaugcuaaacuaggcgauuuugcaccaacaguaauuaugccaggagauccucuaagggcgaaauuuauagccgaaaacuaucugcaggaccaccgugaagucacaaauguucggaauauguugggauacacgggauucuauucagggcaacucauuucugugauggggcacggaaugggaauuccaucaaugacauuauaugcccaugaacugguuaaugauuuugauguaaaacggauuauucguguuggcagucuuggugcaacacaacguacaauuaaaaugcgggauauuauuuuagcggucgcuuccggaacagacucugucacuaauuuuaaacguaguucggguuacuuuauggcguccuccgcauauuuccccuuauuacaaaaagcauggucauuagcucaggaagccgguuuagagguaaaagcuggcaauguauuuagcggcgacauuuauuacgauccggaugauaauuuaauuccggcacuugagaaauucggagugcuagguaucgauauggaagucgcaggguuauaugcacuugcacaucaauucgguauugaagcguuggcaauuuuaacgguauccgaucacugucugacaggagaagaaacaacagcagaagagcgacaguuaacauuuaacaacaugauugaauuggcgcugaauacugcugucgccauuuag

SEQ ID NO: 6211 - RNA, 708 nt, Artificial Sequence
  derived and/or modified sequence opt1 from Purine_Nucleoside_Phosphorylase_deoD__Escherichia_coli__ACD54493
augaccgcccacaucaacgccaagcugggcgacuucgcgcccaccgugaucaugccgggggacccccuccgcgccaaguucaucgccgagaacuaccugcaggaccaccgggaggucacgaacgugcgcaacaugcugggcuacaccggguucuacagcggccagcucaucuccgugauggggcacggcaugggcauccccagcaugacccuguacgcccacgagcuggucaacgacuucgacgugaagcggaucauccgcguggggucccucggcgccacccagcggacgaucaagaugcgcgacaucauccuggcggucgccagcgggaccgacuccgugaccaacuucaagcggagcuccggcuacuucauggccagcuccgccuacuucccccugcuccagaaggcguggagccuggcccaggaggccgggcuggaggugaaggccggcaacgucuucuccggcgacaucuacuacgacccggacgacaaccucauccccgcccuggagaaguucggggugcugggcaucgacauggagguggcggggcucuacgcccuggcccaccaguucggcaucgaggcccuggccauccucaccgucagcgaccacugccugacgggcgaggagaccaccgcggaggagcgccagcugaccuucaacaacaugaucgagcucgcccugaacacggccguggccaucuga

SEQ ID NO: 6212 - RNA, 708 nt, Artificial Sequence
  derived and/or modified sequence opt2 from Purine_Nucleoside_Phosphorylase_deoD__Escherichia_coli__ACD54493
augaccgcccacaucaacgccaagcucggcgacuucgcccccaccgucaucaugcccggcgacccccuccgcgccaaguucaucgccgagaacuaccuccaggaccaccgcgaggucaccaacguccgcaacaugcucggcuacaccggcuucuacuccggccagcucaucuccgucaugggccacggcaugggcauccccuccaugacccucuacgcccacgagcucgucaacgacuucgacgucaagcgcaucauccgcgucggcucccucggcgccacccagcgcaccaucaagaugcgcgacaucauccucgccgucgccuccggcaccgacuccgucaccaacuucaagcgcuccuccggcuacuucauggccuccuccgccuacuucccccuccuccagaaggccuggucccucgcccaggaggccggccucgaggucaaggccggcaacgucuucuccggcgacaucuacuacgaccccgacgacaaccucauccccgcccucgagaaguucggcguccucggcaucgacauggaggucgccggccucuacgcccucgcccaccaguucggcaucgaggcccucgccauccucaccgucuccgaccacugccucaccggcgaggagaccaccgccgaggagcgccagcucaccuucaacaacaugaucgagcucgcccucaacaccgccgucgccaucuga

SEQ ID NO: 6213 - RNA, 708 nt, Artificial Sequence
  derived and/or modified sequence opt3 from Purine_Nucleoside_Phosphorylase_deoD__Escherichia_coli__ACD54493
augaccgcccacaucaacgcuaagcugggcgacuucgcacccacagugauuaugccuggggauccacucagagccaaauuuauagcggagaauuaccuucaggaccauagggaagucacuaacguucggaauaugcugggauauacggguuucuacagcggccaauugaucuccgugauggggcacggaaugggcauuccgucuaugaccuuauaugcucaugagcugguaaacgauuuugacgugaagcgcaucauucgagucgguucacuaggggccacacagcguacuaucaaaaugagagauauaauccucgcaguggccaguggaaccgacagcguuacaaauuucaagagguccucuggcuacuuuauggcuucgucagcauauuucccccugcuucagaaagccuggagccuggcucaggaagccggcuuggaggugaaggcggggaacgucuuuaguggagauauuuacuaugacccugaugacaaucucaucccagcacuggaaaaguucggugugcugggcauugauauggagguagccgggcucuacgcuuuagcccaccaauuuggaaucgaggcacuggcuauacuuaccguuuccgaccauugcuugacuggcgaagagacaaccgccgaggaacggcagcugacguucaacaauaugauugagcuagcgcucaacacugccguggcaaucuga

SEQ ID NO: 6214 - RNA, 708 nt, Artificial Sequence
  derived and/or modified sequence opt4 from Purine_Nucleoside_Phosphorylase_deoD__Escherichia_coli__ACD54493
augaccgcccacaucaacgccaagcugggcgacuucgcccccaccgugaucaugcccggcgacccccugagagccaaguucaucgccgagaacuaccugcaggaccacagagaggugaccaacgugagaaacaugcugggcuacaccggcuucuacagcggccagcugaucagcgugaugggccacggcaugggcauccccagcaugacccuguacgcccacgagcuggugaacgacuucgacgugaagagaaucaucagagugggcagccugggcgccacccagagaaccaucaagaugagagacaucauccuggccguggccagcggcaccgacagcgugaccaacuucaagagaagcagcggcuacuucauggccagcagcgccuacuucccccugcugcagaaggccuggagccuggcccaggaggccggccuggaggugaaggccggcaacguguucagcggcgacaucuacuacgaccccgacgacaaccugauccccgcccuggagaaguucggcgugcugggcaucgacauggagguggccggccuguacgcccuggcccaccaguucggcaucgaggcccuggccauccugaccgugagcgaccacugccugaccggcgaggagaccaccgccgaggagagacagcugaccuucaacaacaugaucgagcuggcccugaacaccgccguggccaucuga

SEQ ID NO: 6215 - RNA, 708 nt, Artificial Sequence
  derived and/or modified sequence opt5 from Purine_Nucleoside_Phosphorylase_deoD__Escherichia_coli__ACD54493
augaccgcccacaucaacgcuaagcugggcgacuucgcccccacagugauuaugccuggggauccgcucagagcgaaauuuaucgcugagaauuaccugcaggaccaucgggaagucacgaacguucgcaauaugcuuggauauaccggcuucuacagcgggcaacugauuuccgugaugggacacggcauggggauccccucuaugacacucuaugcccaugagcuggugaacgauuuugacgucaagagaauuauccgggugggaagccuuggcgccacccagcgcacaaucaaaaugagagauauuauccuggcuguugccuccggcaccgacucugugacaaauuucaagcggagcuccggguacuuuauggcuucuagcgccuauuucccucuccugcagaaagcguggucccuggcccaggaagcuggacucgaggucaaggccggcaacguguuuagcggggauauuuacuaugaccccgaugacaaucugaucccugcucuugaaaaguucggaguucugggcauugauauggagguggccgggcucuacgcgcuggcccaccaauuuggaaucgaggcucuugccauucugaccgucucugaccauugccucacgggcgaagagaccacagcugaggaacgccagcugaccuucaacaauaugaucgagcuggcccucaacacagccguggcuaucuga

SEQ ID NO: 6216 - RNA, 708 nt, Artificial Sequence
  derived and/or modified sequence opt6 from Purine_Nucleoside_Phosphorylase_deoD__Escherichia_coli__ACD54493
augacagcacacauaaaugcaaaacuaggagauuucgcaccaacaguaauaaugccaggagacccauuaagagcaaaauucauagcagaaaacuacuuacaagaucacagggaaguaacaaacgucagaaacaugcuaggauacacaggauucuacucaggacaauuaauaaguguaaugggacacgggaugggaauaccaucaaugacauuauacgcacacgaauuaguaaacgacuucgacguuaaaagaauaauaagaguaggaagccuaggagcaacccaaagaacaauaaaaaugagagacauaauacuagcaguagcaucaggaacagacucaguaacaaacuuuaaaagaaguucaggauauuucauggcaucaucagcauacuucccacuacuacaaaaagcauggucauuagcacaagaagcaggcuuagaaguaaaagcaggaaacguauucucaggagacauauacuaugacccagacgacaacuuaauaccagcacuagaaaaauucggaguacuaggaauagacauggaaguagcuggacuauacgcauuagcacaccaauucggaauagaagcacuagcaaucuuaacaguaucagaccacugccuaacaggagaagaaacaacagcagaagaaagacaauuaacauucaacaacaugauagaauuagcacuaaauacagcaguagcaauauaa

SEQ ID NO: 6217 - protein, 239 aa, Artificial Sequence; identical to SEQ ID NO: 6201
  Purine_Nucleoside_Phosphorylase_deoD__Escherichia_coli_ _A0A0E0U7I4

SEQ ID NO: 6218 - RNA, 720 nt, Artificial Sequence
  Purine_Nucleoside_Phosphorylase_deoD__Escherichia_coli__AEE59766
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguggguuccuguggcgcaguucugccgcacguaaaacuacgcgacgucguuaucgguaugggugccugcaccgauuccaaaguuaaccgcauccguuuuaaagaccaugacuuugccgcuaucgcugacuuugacauggugcguaacgcgguagacgcggcuaaagcacugggcguugaugcucgcguggguaaccuguucuccgcugaccuguucuacucuccggacggcgaaauguucgacgugauggaaaaauacggcauccucggcguggaaauggaagcggcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucugcugggcgauaaagaguaa

SEQ ID NO: 6219 - RNA, 720 nt, Artificial Sequence; identical to SEQ ID NO: 6203
  derived and/or modified sequence opt1 from Purine_Nucleoside_Phosphorylase_deoD__Escherichia_coli__AEE59766

SEQ ID NO: 6220 - RNA, 720 nt, Artificial Sequence; identical to SEQ ID NO: 6204
  derived and/or modified sequence opt2 from Purine_Nucleoside_Phosphorylase_deoD__Escherichia_coli__AEE59766

SEQ ID NO: 6221 - RNA, 720 nt, Artificial Sequence; identical to SEQ ID NO: 6205
  derived and/or modified sequence opt3 from Purine_Nucleoside_Phosphorylase_deoD__Escherichia_coli__AEE59766

SEQ ID NO: 6222 - RNA, 720 nt, Artificial Sequence; identical to SEQ ID NO: 6206
  derived and/or modified sequence opt4 from Purine_Nucleoside_Phosphorylase_deoD__Escherichia_coli__AEE59766

SEQ ID NO: 6223 - RNA, 720 nt, Artificial Sequence; identical to SEQ ID NO: 6207
  derived and/or modified sequence opt5 from Purine_Nucleoside_Phosphorylase_deoD__Escherichia_coli__AEE59766

SEQ ID NO: 6224 - RNA, 720 nt, Artificial Sequence
  derived and/or modified sequence opt6 from Purine_Nucleoside_Phosphorylase_deoD__Escherichia_coli__AEE59766
auggcaacaccacauauaaacgcagaaaugggggacuuugcagauguaguacuaaugccaggagacccacuaagagcaaaauacauagcagaaacauuucuagaagaugcaagagaaguaaauaauguaagaggaauguuaggauuuacagggacauauaaaggaagaaaaauaaguguaaugggacauggaaugggcauaccaucaugcaguauauauacaaaagaauuaauaacagacuucggagugaaaaaaauaauaagaguaggaucaugcggagcaguacuaccacacguaaaauuaagagauguaguaauuggaaugggagcauguaccgauagcaaaguaaauagaauaagauuuaaagaucaugauuucgcagcaauagccgauuucgauaugguacgaaaugcaguagacgcagcaaaggcauuaggaguagacgcaagaguaggaaaucuauucagcgcagacuuauuuuauaguccagacggagaaauguucgauguaauggaaaaauacggaauauuaggaguagaaauggaagcagcaggaauauacggaguagccgcagaauuuggagcaaaagcacuuacaauauguacaguaagcgaucacauaagaacacacgaacaaacaacagcagcagaaagacaaacaacauucaaugacaugauaaaaauagcacucgaaagcguauuauuaggagauaaagaauaa

SEQ ID NO: 6225 - protein, 239 aa, Artificial Sequence; identical to SEQ ID NO: 6201
  Purine_Nucleoside_Phosphorylase_deoD__Escherichia_coli_ _A0A0E0VFI3

SEQ ID NO: 6226 - RNA, 720 nt, Artificial Sequence
  Purine_Nucleoside_Phosphorylase_deoD__Escherichia_coli__AEQ15845
auggcuaccccacacauuaaugcagaaaugggcgauuucgcugacguaguuuugaugccaggcgacccgcugcgugcgaaguauauugcugaaacuuuccuugaagaugcccgugaagugaacaacguucgcgguaugcugggcuucaccgguacuuacaaaggccgcaaaauuuccguaaugggucacgguauggguaucccguccugcuccaucuacaccaaagaacugaucaccgauuucggcgugaagaaaauuauccgcguaggcuccuguggcgcuguucugccacacguaaaacugcgcgacgucguuaucgguaugggugccugcaccgauuccaaaguuaaccguauccguuuuaaagaccaugacuuugccgcuaucgcugacuuugacauggugcguaacgcgguagacgcggcuaaagcacugggcguugaugcucgcguugguaaccuguucuccgcugaccuguucuacucuccggacggcgaaauguucgaugugauggaaaaauacggcauccucggcguggaaauggaagcagcugguaucuacggcgucgcugcagaauuuggcgcgaaagcccugaccaucugcaccgugucugaccacauccgcacucacgagcagaccacugccgcugagcgucagaccaccuucaacgacaugaucaaaaucgcacuggaauccguucuguugggcgauaaagaguaa

SEQ ID NO: 6227 - RNA, 720 nt, Artificial Sequence; identical to SEQ ID NO: 6203
  derived and/or modified sequence opt1 from Purine_Nucleoside_Phosphorylase_deoD__Escherichia_coli__AEQ15845

SEQ ID NO: 6228 - RNA, 720 nt, Artificial Sequence; identical to SEQ ID NO: 6204
  derived and/or modified sequence opt2 from Purine_Nucleoside_Phosphorylase_deoD__Escherichia_coli__AEQ15845

SEQ ID NO: 6229 - RNA, 720 nt, Artificial Sequence; identical to SEQ ID NO: 6205
  derived and/or modified sequence opt3 from Purine_Nucleoside_Phosphorylase_deoD__Escherichia_coli__AEQ15845

SEQ ID NO: 6230 - RNA, 720 nt, Artificial Sequence; identical to SEQ ID NO: 6206
  derived and/or modified sequence opt4 from Purine_Nucleoside_Phosphorylase_deoD__Escherichia_coli__AEQ15845

SEQ ID NO: 6231 - RNA, 720 nt, Artificial Sequence; identical to SEQ ID NO: 6207
  derived and/or modified sequence opt5 from Purine_Nucleoside_Phosphorylase_deoD__Escherichia_coli__AEQ15845
